US009290773B2

(12) United States Patent
Edgerton

(10) Patent No.: US 9,290,773 B2
(45) Date of Patent: Mar. 22, 2016

(54) TRANSGENIC PLANTS WITH ENHANCED AGRONOMIC TRAITS

(75) Inventor: Michael D. Edgerton, St. Louis, MO (US)

(73) Assignee: Monsanto Technology LLC, St. Louis, MO (US)

(*) Notice: Subject to any disclaimer, the term of this patent is extended or adjusted under 35 U.S.C. 154(b) by 855 days.

(21) Appl. No.: 13/199,773

(22) Filed: Sep. 8, 2011

(65) Prior Publication Data

US 2012/0227131 A1  Sep. 6, 2012

Related U.S. Application Data

(63) Continuation of application No. 11/982,680, filed on Nov. 2, 2007, now abandoned, which is a continuation-in-part of application No. 10/678,588, filed on Oct. 2, 2003, now abandoned, and a continuation-in-part of application No. 10/679,063, filed on Oct. 2, 2003, now abandoned.

(60) Provisional application No. 60/415,758, filed on Oct. 2, 2002, provisional application No. 60/425,157, filed on Nov. 8, 2002, provisional application No. 60/463,787, filed on Apr. 18, 2003, provisional application No. 60/415,758, filed on Oct. 2, 2002.

(51) Int. Cl.
    C12N 15/82    (2006.01)
    A01H 5/10     (2006.01)
    C07K 14/47    (2006.01)

(52) U.S. Cl.
    CPC .............. *C12N 15/8273* (2013.01); *A01H 5/10* (2013.01); *C07K 14/4702* (2013.01)

(58) Field of Classification Search
    None
    See application file for complete search history.

(56) References Cited

U.S. PATENT DOCUMENTS

| | | | |
|---|---|---|---|
| 5,322,938 A | 6/1994 | McPherson et al. | |
| 5,641,876 A | 6/1997 | McElroy et al. | |
| 6,084,089 A | 7/2000 | Mine et al. | |
| 6,140,078 A | 10/2000 | Sanders et al. | |
| 6,162,965 A * | 12/2000 | Hansen | 800/278 |
| 6,194,636 B1 | 2/2001 | McElroy et al. | |
| 6,232,526 B1 | 5/2001 | McElroy et al. | |
| 6,235,975 B1 | 5/2001 | Harada et al. | |
| 6,677,504 B2 | 1/2004 | da Costa e Silva et al. | |
| 6,717,034 B2 | 4/2004 | Jiang | |
| 7,151,204 B2 | 12/2006 | Houmard et al. | |
| 7,482,511 B2 | 1/2009 | da Costa e Silva et al. | |
| 7,511,130 B2 | 3/2009 | Heck et al. | |
| 7,511,190 B2 | 3/2009 | Creelman et al. | |
| 7,868,149 B2 | 1/2011 | Boukharov et al. | |
| 2002/0102695 A1 | 8/2002 | Silva et al. | |
| 2003/0093837 A1 | 5/2003 | Keddie et al. | |
| 2003/0233670 A1 | 12/2003 | Edgerton et al. | |
| 2004/0019927 A1 | 1/2004 | Sherman et al. | |
| 2004/0031072 A1 | 2/2004 | La Rosa et al. | |
| 2004/0034888 A1 | 2/2004 | Liu et al. | |
| 2004/0123347 A1 | 6/2004 | Hinchey et al. | |
| 2005/0022266 A1 | 1/2005 | Wu et al. | |
| 2005/0048556 A1 | 3/2005 | Heck et al. | |
| 2005/0086718 A1 | 4/2005 | Heard et al. | |
| 2005/0172361 A1 | 8/2005 | Heard | |
| 2006/0021087 A1 | 1/2006 | Baum et al. | |
| 2007/0039076 A1 | 2/2007 | Boukharov et al. | |
| 2007/0192889 A1 | 8/2007 | La Rosa et al. | |
| 2008/0040973 A1 | 2/2008 | Nelson et al. | |
| 2008/0104730 A1 | 5/2008 | Wu et al. | |
| 2008/0163397 A1 | 7/2008 | Ratcliffe et al. | |
| 2008/0313756 A1 | 12/2008 | Zhang et al. | |
| 2009/0044297 A1 * | 2/2009 | Andersen et al. | 800/289 |
| 2009/0049566 A1 | 2/2009 | Zhang et al. | |
| 2009/0049573 A1 | 2/2009 | Dotson et al. | |
| 2009/0093620 A1 | 4/2009 | Kovalic et al. | |
| 2009/0138981 A1 | 5/2009 | Repetti et al. | |
| 2009/0183270 A1 | 7/2009 | Adams et al. | |
| 2009/0217414 A1 * | 8/2009 | La Rosa et al. | 800/278 |
| 2009/0241217 A9 | 9/2009 | Wu et al. | |
| 2010/0293663 A2 | 11/2010 | La Rosa et al. | |

FOREIGN PATENT DOCUMENTS

| | | |
|---|---|---|
| EP | 03008540 A2 | 1/2003 |
| EP | 1230345 B1 | 6/2008 |
| WO | WO-02057439 A2 | 7/2002 |
| WO | WO-2005033319 A2 | 1/2005 |

OTHER PUBLICATIONS

Wells, Biochemistry 29:8509-8517, 1990.*
Ngo et al., (The Protein Folding Problem and Tertiary Structure Prediction, K. Merz., and S. Le Grand (eds.) pp. 492-495,1994).*
Guo et al. (PNAS, 101: 9205-9210, 2004).*
Keskin et al. (Protein Science, 13:1043-1055, 2004).*
Thornton et al. (Nature structural Biology, structural genomics supplement, Nov. 2000).*
Doerks et al., (TIG, 14:248-250, 1998).*
Smith et al. (Nature Biotechnology, 15:1222-1223, 1997).*
Bork et al. (TIG, 12:425-427, 1996).*
Sims et al., Plant Mol. Biol., 47:771-781, 2001.*

(Continued)

*Primary Examiner* — Vinod Kumar
(74) *Attorney, Agent, or Firm* — Schwegman Lundberg & Woessner, P.A.

(57) ABSTRACT

This invention provides transgenic plant cells with recombinant DNA for expression of proteins that are useful for imparting enhanced agronomic trait(s) to transgenic crop plants. This invention also provides transgenic plants and progeny seed comprising the transgenic plant cells where the plants are selected for having an enhanced trait selected from the group of traits consisting of enhanced water use efficiency, enhanced cold tolerance, increased yield, enhanced nitrogen use efficiency, enhanced seed protein and enhanced seed oil. Also disclosed are methods for manufacturing transgenic seed and plants with enhanced traits.

11 Claims, 5 Drawing Sheets

(56) References Cited

OTHER PUBLICATIONS

Kim et al. (The Plant Journal, 25:247-259, 2001).*
"U.S. Appl. No. 11/982,010, Office Action mailed Jan. 6, 2011".
"U.S. Appl. No. 11/982,010, Response filed Jul. 6, 2011".
"U.S. Appl. No. 11/982,274, Final Office Action mailed Aug. 1, 2011".
"U.S. Appl. No. 11/982,274, Office Action mailed Oct. 31, 2007".
"U.S. Appl. No. 11/982,274, Response filed Apr. 27, 2011 to Office Action".
"U.S. Appl. No. 11/982,680, Non Final Office Action mailed Mar. 11, 2011", 22 pgs.
"U.S. Appl. No. 11/982,680, Response filed Dec. 21, 2010 to Restriction Requirement mailed Aug. 27, 2010", 2 pgs.
"U.S. Appl. No. 11/982,680, Restriction Requirement mailed Aug. 27, 2008", 7 pgs.
"GeneBank Accession No. X59714, dated Nov. 15, 1992".
"Sequence alignment between the sequence encoded by SEQ ID No. 29", U.S. Appl. No. 11/821,176 vs. SEQ ID No. 617 in U.S. Appl. No. 11/982,680,dated May 17, 2010.
"Sequence alignment between the sequence encoded by SEQ ID No. 30", U.S. Appl. No. 11/821,176 vs. SEQ ID No. 617 in U.S. Appl. No. 11/982,680,dated May 17, 2010.
"Sequence alignment between the sequence encoded by SEQ ID No. 31", U.S. Appl. No. 11/821,176 vs. SEQ ID No. 617 in U.S. Appl. No. 11/982,680,dated May 17, 2010.
"Sequence alignment between the sequence encoded by SEQ ID No. 32", U.S. Appl. No. 11/821,176 vs. SEQ ID No. 617 in U.S. Appl. No. 11/982,680, dated May 17, 2010.
"Summary of drought tolerance data for NF-YB variants", (undated).
"Summary of SEQ ID No. 29 data for yield under stress (SEQ ID No. 29 is NFYB2-S83A modified NF-YB2 protein of U.S. Appl. No. 11/821,176)", (undated).
Bork, Peer, "Go hunting in sequence databases but watch out for the traps", Trends in Genetics, 12(10), (Oct. 1996), 425-427.
Doerks, Tobias, et al., "Protein Annotation: detective work for function prediction", Trends in Genetics, vol. 14, No. 6, (1998), 248-250.
Edwards, et al., "Multiple genes encoding the conserved CCAAT-Box transcription factor complex are expressed in arabidopsis", Plant Physiol., 117, (1998), 1015-1022.
Gordon, et al., "RNAi for insect-proof plants", Nature Biotechnology, 25(11), (2007), 1231-1232.
Guo, H. H, et al., "Protein tolerance to random amino acid change", Proc Natl Acad Sci U S A., 101(25), (2004), 9205-9210.
Keskin, O., et al., "A new, structurally nonredundant, diverse data set of protein-protein interfaces and its implications.", Protein Sci.,13(4), (Apr. 2004), 1043-55.
Lee, et al., "Arabidopsis Leafy COTYLEDON1 represents a functionally specialized subunit of the CCAAT binding transcription factor", Proc. Natl. Acad. Sci. USA, 100(4), (2003), 2152-2156.
Li, et al., "Evolutionary variation of the CCAAT-binding transcription factor NF-Y", Nucleic Acids Research, 20(5), (1992), 1087-1091.
Lotan, et al., "Arabidopsis Leafy COTYLEDON1 is sufficient to induce embryo development in vegetative cells", Cell, 93, (1998), 1195-1205.
Mantovani, "The molecular biology of the CCAAT-binding factor NF-Y", Gene, 239, (1999), 15-27.
Miyoshi, et al., "OsHAP3 genes regulate chloroplast biogenesis in rice", Plant J., 36, (2003), 532-540.
Nelson, et al., "Plant nuclear factor Y (NF-7) B subunits confer drought tolerance and lead to improved corn yields on water-limited areas", Proc. Natl. Acad. Sci.. USA, 104(42), (2007), 16450-16455.
Ngo, et al., "Computational complexity, protein structure prediction, and the leventhal paradox", In: The protein folding problem and tertiary structure prediction, Mertz, et al.. (Eds.), (1994), 1-80.
Smith, Temple F, et al., "The Challenges of Genome Sequence Annotation or "The Devil is in the Details"", Nature Biotechnology, 15(12), (Nov. 1997), 1222-1223.
Stephenson, et al., "Genome-wide identification and expression analysis of the NF-Y family of transcription factors in triticum aestivum", Plant. Mol. Biol., 65, (2007), 77-92.
Thornton, J. M., et al., "From structure to function: Approaches and limitations.", Nat Struct Biol., 7(Suppl), (Nov. 2000), 991-994.
Vilardell, "Regulation of the maize rab17 gene promoter in transgenic heterologous systems", Plant Mol. Biol., 17, (1991), 985-993.
Wells, J. A., "Additivity of Mutational Effects in Proteins", Biochemistry 29(37), (1990), 8509-8517.
Cao, Yongwei, et al., "cDNA Sequences and Uses for Plant Improvement", U.S. Appl. No. 10/219,999, filed Aug. 15, 2002, 189 pgs.
Cao, Yongwei, et al., "cDNA Sequences and Uses for Plant Improvement", U.S. Appl. No. 60/324,109, filed Sep. 21, 2001, 108 pgs.

* cited by examiner

FIG. 1A

```
SEQ ID NO
932         AIVLIPGPFISQRCRSRV------LPPLSFPLERKIGLLGLIG----------------C
9332        TALLVPIALINCACRRSQSTTSTPAQAMSCRLLFKLFLCAFLGSAGLTLQALTKFVKKSC
4683        TLVMLPFALFFEKGTR--------PKMTLRIFIKILGLALLE---------------P
3207        LALLIPFAYFLEKKNR--------PPLTFSLLAQLFFLAFCG---------------I
7313        LALLAPFAYFLEKKDR--------PPLTFSLLVEFFLLALCG---------------I
3221        LALLAPFAYFLEKKDR--------PPLTFSLLVEFFLLALCG---------------I
6752        LALLAPFAYFLEKKDR--------PPLTFSLLVEFFLLALCG---------------I
consensus   xallxPfaxfxekxxr--------ppltfxllxxxfllalxg---------------x -ASQIV-------------------GYTGISFSSPTLSSAISNLVPAFTFLLAIIFRME
QEVGGFTSLLSSSLLQGKAEHLHPQVYHASLKQTSATVASAATNSMPVVTFLLALVLRME
VLDQNL-------------------YYVGNARASASFSSALVNILPAVTFIMAIVLRME
TCNQGF-------------------YLLGLHYLSPTYASAIQNTVPAITFALAASLRLE
TANQGF-------------------YLLGLYHLSPTYASAIQNTVPAITFAMAAVLRLE
TANQGF-------------------YLLGLYHLSPTYASAIQNTVPAITFAMAAVLRLE
TANQGF-------------------YLLGLYHLSPTYASAIQNTVPAITFAMAAVLRLE
xxxqgf-------------------yxxglxxxSptxaSAixNxvPaxTFxxAxvlRxE KVIVRNTTCQAKVLGTIVSITGAFVVTFYKGPPIIIVHTPSLSLHQPIN---TLNSVDRS
TIKLRRRSGLGKLAGVALCLAGVLVIAFYVGPSI------RPLAHHPVFAHKTQSVGNGA
KLRLRSSHSQAKVAGTICTVIGAVLMIMYHG-PVVQFPWARGAHHVDQAASAAAAQSSAT
QVNINKRYGMAKVIGTVVSVGGATVITLYKGTPLMNF--NILGANT------VSQNVVLN
QVDLGKRHGVAKVVGTVVSIGGATVITLYKGLPLFNHNLNIKSL--------SSSSLILN
QVDLGKRHGVAKVVGTVVSIGGATVITLYKGLPLFNHNLNIKSL--------SSSSLILN
QVDLSRRHGLAKVVGTVVSIGGATVITLYKGLPLLHHSDDLHVKSSPVTLSSSSGSPILN
xvxlxxrxgxaKvxGtxvsxxGaxvitxYkGxpxxxxxxxxxxxxxxxxxxxxxxxxxx WAIGGLLLTAEYILVPLWYIVQVQIMKVYPNELTVIFFYNLCVSIMAAIVAIFTET-NAG
WIRGTFLLILSCTTWSLWITLQVPLLIEYPNKLMATAMQCLFSALQSFVVAVVVEK-DFT
WLKGTIAIITSCVAWAGFFVLQSNTLNSYPAALTLTTLICAMGTGINGSMALVAERHDMS
WSVGCLFLLGNCIAWSGWMVLQTPVLKKYPARLSMLALTLAFGLVQFLAIAAFWEN-DIG
WTLGCVFILGHCLSWSGWMVLQVPVLKRYPARLSVLSLTCIFGLLQFLVIAAFTEE-DLS
WTLGCVFILGHCLSWSGWMVLQVPVLKRYPARLSVLSLTCIFGLLQFLVIAAFTEE-DLS
WTLGCVFILGHCLSWSGWMVLQVPVLKRYPARLSVLSLTCIFGLLQFLAIAAFTEE-DLS
WxxGxxxxxxxcxxwsgwxvlQvpxlkxYPaxLxxxxlxcxfgxxqxxxxAxfxEx-dxx AWKIGLDTALASIVCSGIFGSFVNNAVHTWVLRIKGPVYVAMFKPLSIAIAVALGVMFLG
KWKLGLDIGLL----AAFLGTGALMYLQAWCAEMSGPVFVVMWSPLAFIFTIFSSSFFLG
AWVIGLDTRLFTVVYSGVVCSGVAFFVQGIVTETRGPVFVTAFQPLCMIITAVLGSVILK
KWRLHSGEELFTILYAGLVASGVALSLQIWCIDRGGALFTAIFQPVQTVMVAIMAAVILG
RWKVNSGSELFTILYAGLVASGVAFALQIWCIDRGGPLFTAVFQPVQTVAVAVMAAIILG
RWKVNSGSELFTILYAGLVASGVAFALQIWCIDRGGPLFTAVFQPVQTVAVAVMAAIILG
RWKVRSGGELFTILYAGLVASGVAFALQIWCIDRGGPLFTAVFQPVQTVAVAVMASAILG
xWkxxxxxxLftixyagxvxsgvaxxlqxwcxxxxGpxfxaxfqPxxxxxxaxxxxxiLg DTLHLGSLVGATVISIGFYTVMWGKATE---------------------------ENVDE
EVVHLGSILGGILLVGGLYSVLWGKSNE---------------------------RKNMIL
```

FIG. 1B

```
EETTLGSVIGAAIIVLGLYSLIWGKSNDIIDKPVHSVAEKLALAHLRQRQRQRHQRHQRD
DLLYTGGIIGAVLIVIGLYLVLWGKNEE------------------------KKSNSN
DQLYSGGIIGAVLIVIGLYFVLWGKSEE------------------------KKSKNN
DQLYSGGIIGAVLIVIGLYFVLWGKSEE------------------------KKSKNN
DQLYTGGIIGAVLIVIGLYFVLWGKSAE------------------------KKGARN
dxlxxGxiiGaxliviGlYxvlWGKsxe------------------------xkxxxx DVPGQQSPPTTENVPLLQSYKT-----DTAEKKMHGSV--------------------
PVMPEKSQGQGD-------GDGA----TTQEKHGETNLTSQV----------------
QRRQARQRRPGRPRRRDAGGEGRDLPLATTRRHLARAPTYVLRAFLRSRVWSRNLLYV
QXX---------DLSRHLLSE------ESSRPTTVTSD--------------------
NLQDQPVQGGGDDIRRHLLGQE-----DASRKDEEAAVTDELA---------------
NLQDQPVQGGGDDIRRHLLGQE-----DASRKDEEAAVTDELA---------------
LLQDQLAQGA--DVTRHLLGG------EASAKDEEAAPAMLA---------------
xxxxxxxxxxxxxxrxxxgxx------xxxxkxxxxxxxxxx---------------
```

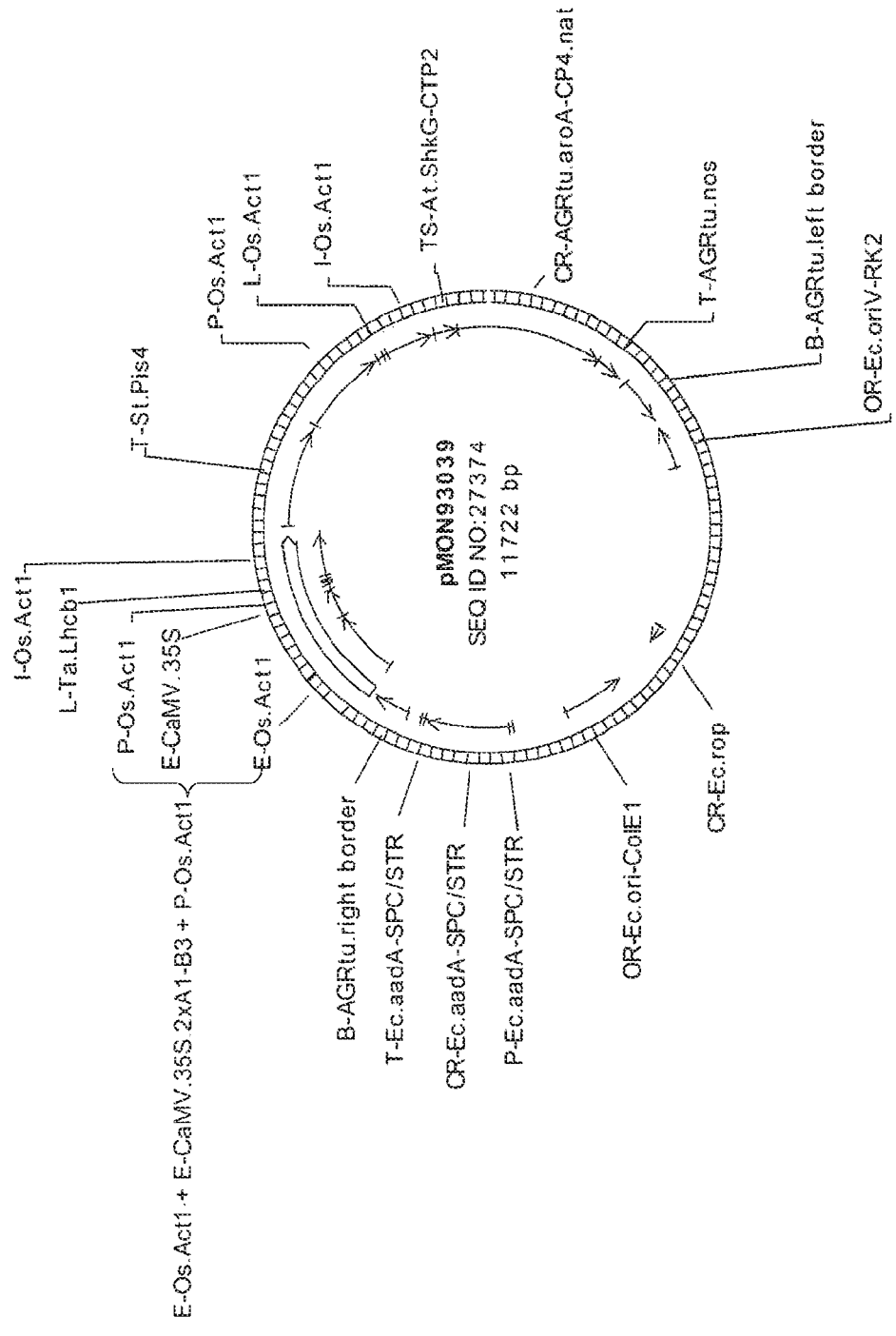
FIG. 2 Plasmid map of pMON93039

FIG. 3 Plasmid map of pMON82053
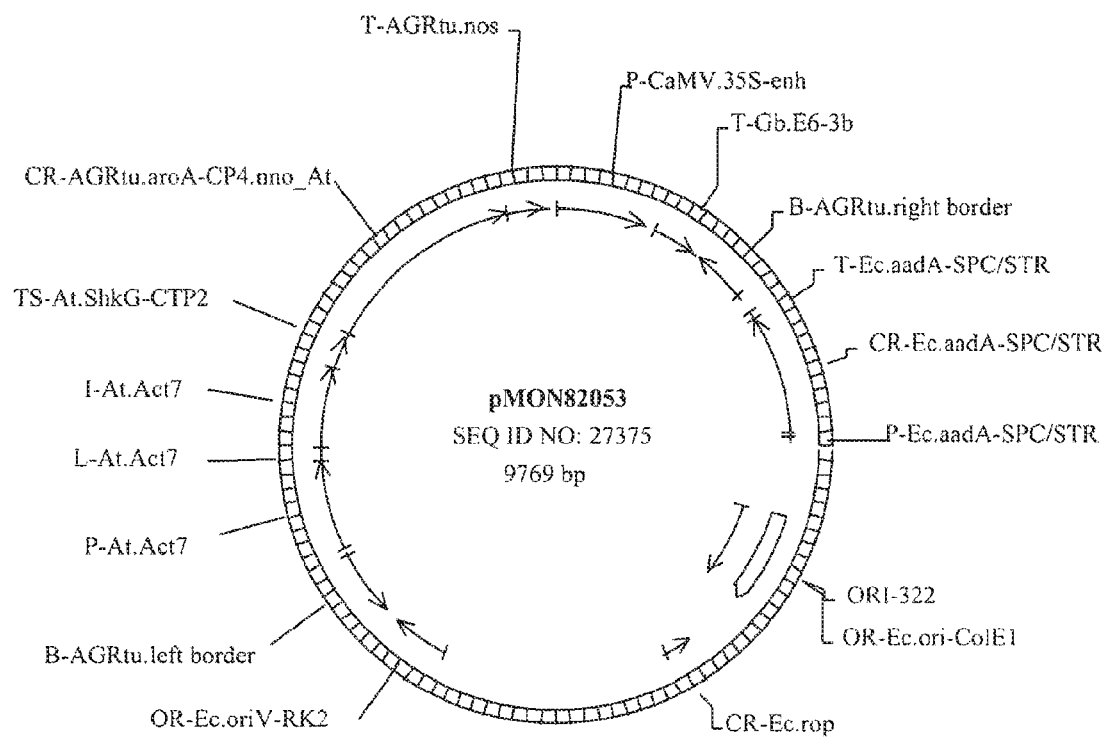

FIG. 4 Plasmid map of pMON99053
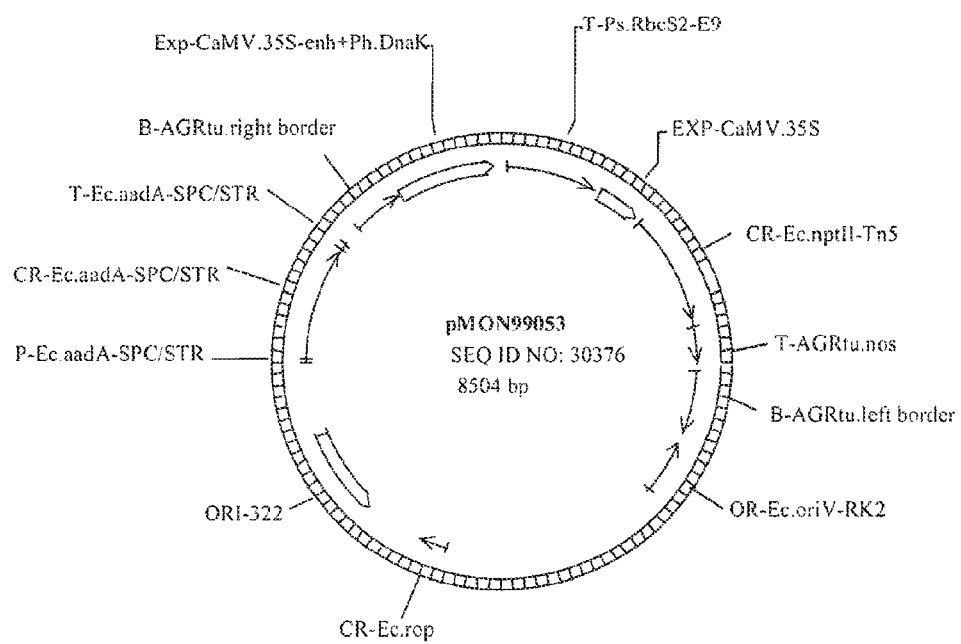

TRANSGENIC PLANTS WITH ENHANCED AGRONOMIC TRAITS

RELATED APPLICATIONS

This application is a continuation application of Ser. No. 11/982,680, filed Nov. 2, 2007 (pending). Application Ser. No. 11/982,680 is a continuation in part of application Ser. No. 10/678,588 (abandoned), filed Oct. 2, 2003, which claims the benefit under 35 U.S.C. 119(e) of provisional application Ser. Nos. 60/415,758, filed Oct. 2, 2002, 60/425,157, filed Nov. 8, 2002 and 60/463,787, filed Apr. 18, 2003, the disclosures of which are incorporated herein by reference in their entirety.

Application Ser. No. 11/982,680 (pending) is also a continuation in part of application Ser. No. 10/679,063 (abandoned), filed Oct. 2, 2003, which claims the benefit under 35 U.S.C. 119(e) of provisional application 60/415,758, filed Oct. 2, 2002, the disclosures of which are incorporated herein by reference in their entirety.

INCORPORATION OF SEQUENCE LISTING

Three copies of the a sequence listing (Copy 1 and Copy 2 and a computer readable form), in a text file named "38-21 (52054)A_seqList.txt" which is 100.3 MB (measured in MS-WINDOWS) are provided on separate CD-ROMs which were created on Oct. 30, 2007 and are herein incorpated by reference.

INCORPORATION OF COMPUTER PROGRAM LISTING

Two copies of Computer Program Listing (Copy 1 and Copy 2) containing folders "hmmer-2.3.2" and "241pfam" are provided on separate CD-ROMs that were created on Oct. 30, 2007, and have a total file size of 20.3 MB (measured in MS-WINDOWS). The "hmmer-2.3.2" folder contains the source code and other associated ASCII files for implementing the HMMer software for Pfam analysis; the "241 pfam" folder contains ASCII files of 241 Pfam Hidden. Markov Models; as well as the material on replacement CDs (Copy 1 and Copy 2) containing folders "hmmer-2.3.2" and "241pfamDir" are provided on separate CD-ROMs that were created on Dec. 12, 2011, and have a total file size of 20,480, 616 bytes, created on Dec. 12, 2011, all of which are incorporated herein by reference in their entirety.

INCORPORATION OF TABLES

Two copies of Table 7 (Copy 1 and Copy 2) are provided on CDROMs that were created on Sep. 6, 2011 and contain the file named "38-21(52054)D_table7.txt" which is 369 KB (measured in MS-WINDOWS) which comprises 71 pages when viewed in MS Word®, are herein incorporated by reference.

FIELD OF THE INVENTION

Disclosed herein are inventions in the field of plant genetics and developmental biology. More specifically, the present inventions provide plant cells with recombinant DNA for providing an enhanced trait in a transgenic plant, plants comprising such cells, seed and pollen derived from such plants, methods of making and using such cells, plants, seeds and pollen.

SUMMARY OF THE INVENTION

This invention provides plant cell nuclei with recombinant DNA that imparts enhanced agronomic traits in transgenic plants having the nuclei in their cells, e.g. enhanced water use efficiency, enhanced cold tolerance, increased yield, enhanced nitrogen use efficiency, enhanced seed protein or enhanced seed oil. Such recombinant DNA in a plant cell nucleus of this invention is provided in as a construct comprising a promoter that is functional in plant cells and that is operably linked to DNA that encodes a protein or to DNA that results in gene suppression. Such DNA in the construct is sometimes defined by protein domains of an encoded protein targeted for production or suppression, e.g. a "Pfam domain module" (as defined herein below) from the group of Pfam domain modules identified in Table 21 (page 94). Alternatively, e.g. where a Pfam domain module is not available, such DNA in the construct is defined a consensus amino acid sequence of an encoded protein that is targeted for production e.g. a protein having amino acid sequence with at least 90% identity to a consensus amino acid sequence in the group of SEQ ID NO: 27377 through SEQ ID NO: 27426. Alternatively, in other cases where neither a Pfam domain module nor a consensus amino acid sequence is available, such DNA in the construct is defined by the sequence of a specific encoded and or its homologue proteins.

Other aspects of the invention are specifically directed to transgenic plant cells comprising the recombinant DNA of the invention, transgenic plants comprising a plurality of such plant cells, progeny transgenic seed, embryo and transgenic pollen from such plants. Such transgenic plants are selected from a population of transgenic plants regenerated from plant cells transformed with recombinant DNA and expressed the protein by screening transgenic plants in the population for an enhanced trait as compared to control plants that do not have said recombinant DNA, where the enhanced trait is selected from group of enhanced traits consisting of enhanced water use efficiency, enhanced cold tolerance, increased yield, enhanced nitrogen use efficiency, enhanced seed protein and enhanced seed oil.

In yet another aspect of the invention the plant cells, plants, seeds, embryo and pollen further comprise DNA expressing a protein that provides tolerance from exposure to an herbicide applied at levels that are lethal to a wild type plant cell. Such tolerance is especially useful not only as an advantageous trait

---

LENGTHY TABLES

The patent contains a lengthy table section. A copy of the table is available in electronic form from the USPTO web site (http://seqdata.uspto.gov/?pageRequest=docDetail&DocID=US09290773B2). An electronic copy of the table will also be available from the USPTO upon request and payment of the fee set forth in 37 CFR 1.19(b)(3).

in such plants but is also useful in a selection step in the methods of the invention. In aspects of the invention the agent of such herbicide is a glyphosate, dicamba, or glufosinate compound.

Yet other aspects of the invention provide transgenic plants which are homozygous for the recombinant DNA and transgenic seed of the invention from corn, soybean, cotton, canola, alfalfa, wheat or rice plants.

This invention also provides methods for manufacturing non-natural, transgenic seed that can be used to produce a crop of transgenic plants with an enhanced trait resulting from expression of stably-integrated, recombinant DNA in the nucleus of the plant cells. More specifically the method comprises (a) screening a population of plants for an enhanced trait and recombinant DNA, where individual plants in the population can exhibit the trait at a level less than, essentially the same as or greater than the level that the trait is exhibited in control plants which do not express the recombinant DNA; (b) selecting from the population one or more plants that exhibit the trait at a level greater than the level that said trait is exhibited in control plants and (c) collecting seed from a selected plant. Such method further comprises steps (a) verifying that the recombinant DNA is stably integrated in said selected plants; and (b) analyzing tissue of a selected plant to determine the production of a protein having the function of a protein encoded by a recombinant DNA with a sequence of one of SEQ ID NO: 1-614; In one aspect of the invention the plants in the population further comprise DNA expressing a protein that provides tolerance to exposure to an herbicide applied at levels that are lethal to wild type plant cells and where the selecting is effected by treating the population with the herbicide, e.g. a glyphosate, dicamba, or glufosinate compound. In another aspect of the invention the plants are selected by identifying plants with the enhanced trait. The methods are especially useful for manufacturing corn, soybean, cotton, alfalfa, wheat or rice seed selected as having one of the enhanced traits described above.

Another aspect of the invention provides a method of producing hybrid corn seed comprising acquiring hybrid corn seed from a herbicide tolerant corn plant which also has stably-integrated, recombinant DNA comprising a promoter that is (a) functional in plant cells and (b) is operably linked to DNA that encodes a protein having at least one domain of amino acids in a sequence that exceeds the Pfam gathering cutoff for amino acid sequence alignment with a protein domain family identified by a Pfam name in the group of Pfam names identified in Table 22. The methods further comprise producing corn plants from said hybrid corn seed, wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA; selecting corn plants which are homozygous and hemizygous for said recombinant DNA by treating with an herbicide; collecting seed from herbicide-treated-surviving corn plants and planting said seed to produce further progeny corn plants; repeating the selecting and collecting steps at least once to produce an inbred corn line; and crossing the inbred corn line with a second corn line to produce hybrid seed.

Another aspect of the invention provides a method of selecting a plant comprising plant cells of the invention by using an immunoreactive antibody to detect the presence of protein expressed by recombinant DNA in seed or plant tissue. Yet another aspect of the invention provides anti-counterfeit milled seed having, as an indication of origin, a plant cell of this invention.

Still other aspects of this invention relate to transgenic plants with enhanced water use efficiency or enhanced nitrogen use efficiency. For instance, this invention provides methods of growing a corn, cotton or soybean crop without irrigation water comprising planting seed having plant cells of the invention which are selected for enhanced water use efficiency. Alternatively methods comprise applying reduced irrigation water, e.g. providing up to 300 millimeters of ground water during the production of a corn crop. This invention also provides methods of growing a corn, cotton or soybean crop without added nitrogen fertilizer comprising planting seed having plant cells of the invention which are selected for enhanced nitrogen use efficiency.

BRIEF DESCRIPTION OF THE DRAWINGS

FIGS. 1A and 1B are a consensus amino acid sequence of SEQ ID NO: 932 and its homologs.

FIGS. 2-4 are plasmid maps.

DETAILED DESCRIPTION OF THE INVENTION

In the attached sequence listing:

SEQ ID NO:1-614 are nucleotide sequences of the coding strand of DNA for "genes" used in the recombinant DNA imparting an enhanced trait in plant cells, i.e. each represents a coding sequence for a protein;

SEQ ID NO: 615-1228 are amino acid sequences of the cognate protein of the "genes" with nucleotide coding sequences 1-614;

SEQ ID NO: 1229-27373 are amino acid sequences of homologous proteins;

SEQ ID NO: 27374 is a nucleotide sequence of a base plasmid vector useful for corn transformation;

SEQ ID NO: 27375 is a nucleotide sequence of a base plasmid vector useful for soybean and canola transformation;

SEQ ID NO: 27376 is a nucleotide sequence of a base plasmid vector useful for cotton transformation;

SEQ ID NO: 27377-27426 are consensus sequences.

TABLE 1

| PEP SEQ ID NO | Gene ID | Consensus SEQ ID |
|---|---|---|
| 684 | PHE0000499 | 27377 |
| 704 | PHE0000520 | 27378 |
| 705 | PHE0000521 | 27379 |
| 706 | PHE0000523 | 27380 |
| 710 | PHE0000528 | 27381 |
| 719 | PHE0000537 | 27382 |
| 734 | PHE0000552 | 27383 |
| 735 | PHE0000553 | 27384 |
| 738 | PHE0000556 | 27385 |
| 743 | PHE0000561 | 27386 |
| 744 | PHE0000562 | 27387 |
| 745 | PHE0000563 | 27388 |
| 746 | PHE0000564 | 27389 |
| 761 | PHE0000579 | 27390 |
| 777 | PHE0000601 | 27391 |
| 779 | PHE0000604 | 27392 |
| 793 | PHE0000618 | 27393 |
| 804 | PHE0000629 | 27394 |
| 824 | PHE0000649 | 27395 |
| 891 | PHE0000798 | 27396 |
| 896 | PHE0000803 | 27397 |
| 900 | PHE0000807 | 27398 |
| 918 | PHE0000826 | 27399 |

TABLE 1-continued

| PEP SEQ ID NO | Gene ID | Consensus SEQ ID |
|---|---|---|
| 924 | PHE0000832 | 27400 |
| 932 | PHE0000840 | 27401 |
| 957 | PHE0000865 | 27402 |
| 961 | PHE0000869 | 27403 |
| 1001 | PHE0000913 | 27404 |
| 1015 | PHE0000927 | 27405 |
| 1016 | PHE0000928 | 27406 |
| 1026 | PHE0000938 | 27407 |
| 1027 | PHE0000939 | 27408 |
| 1032 | PHE0000944 | 27409 |
| 1033 | PHE0000945 | 27410 |
| 1036 | PHE0000948 | 27411 |
| 1043 | PHE0000955 | 27412 |
| 1044 | PH E0000956 | 27413 |
| 1045 | PHE0000957 | 27414 |
| 1051 | PHE0000963 | 27415 |
| 1054 | PHE0000966 | 27416 |
| 1059 | PHE0000972 | 27417 |
| 1087 | PHE0001006 | 27418 |
| 1119 | PHE0001039 | 27419 |
| 1123 | PHE0001043 | 27420 |
| 1135 | PHE0001162 | 27421 |
| 1136 | PHE0001163 | 27422 |
| 1137 | PHE0001164 | 27423 |
| 1138 | PHE0001165 | 27424 |
| 1139 | PHE0001166 | 27425 |
| 1165 | PHE0001435 | 27426 |

DETAILED DESCRIPTION OF THE INVENTION

As used herein a "plant cell" means a plant cell that is transformed with stably-integrated, non-natural, recombinant DNA, e.g. by *Agrobacterium*-mediated transformation or by bombardment using microparticles coated with recombinant DNA or other means. A plant cell of this invention can be an originally-transformed plant cell that exists as a microorganism or as a progeny plant cell that is regenerated into differentiated tissue, e.g. into a transgenic plant with stably-integrated, non-natural recombinant DNA, or seed or pollen derived from a progeny transgenic plant.

As used herein a "transgenic plant" means a plant whose genome has been altered by the stable integration of recombinant DNA. A transgenic plant includes a plant regenerated from an originally-transformed plant cell and progeny transgenic plants from later generations or crosses of a transformed plant.

As used herein "recombinant DNA" means DNA which has been a genetically engineered and constructed outside of a cell including DNA containing naturally occurring DNA or cDNA or synthetic DNA.

As used herein "consensus sequence" means an artificial sequence of amino acids in a conserved region of an alignment of amino acid sequences of homologous proteins, e.g. as determined by a CLUSTALW alignment of amino acid sequence of homolog proteins.

As used herein a "homolog" means a protein in a group of proteins that perform the same biological function, e.g. proteins that belong to the same Pfam protein family and that provide a common enhanced trait in transgenic plants of this invention. Homologs are expressed by homologous genes. Homologous genes include naturally occurring alleles and artificially-created variants. Degeneracy of the genetic code provides the possibility to substitute at least one base of the protein encoding sequence of a gene with a different base without causing the amino acid sequence of the polypeptide produced from the gene to be changed. Hence, a useful polynucleotide may have base sequence changes from SEQ ID NO:1 through SEQ ID NO: 614 in accordance with degeneracy of the genetic code. Homologs are proteins that, when optimally aligned, have at least 60% identity, more preferably about 70% or higher, more preferably at least 80% and even more preferably at least 90% identity, e.g. 95 to 98% identity, over the full length of a protein identified as being associated with imparting an enhanced trait when expressed in plant cells. Homologs include proteins with an amino acid sequence that have at least 90% identity, e.g. at least 95 to 98% identity, to a consensus amino acid sequence of proteins and homologs disclosed herein.

Homologs are identified by comparison of amino acid sequence, e.g. manually or by use of a computer-based tool using known homology-based search algorithms such as those commonly known and referred to as BLAST, FASTA, and Smith-Waterman. A local sequence alignment program, e.g. BLAST, can be used to search a database of sequences to find similar sequences, and the summary Expectation value (E-value) used to measure the sequence base similarity. As a protein hit with the best E-value for a particular organism may not necessarily be an ortholog or the only ortholog, a reciprocal query is used in the present invention to filter hit sequences with significant E-values for ortholog identification. The reciprocal query entails search of the significant hits against a database of amino acid sequences from the base organism that are similar to the sequence of the query protein. A hit is a likely ortholog, when the reciprocal query's best hit is the query protein itself or a protein encoded by a duplicated gene after speciation. A further aspect of the invention comprises functional homolog proteins that differ in one or more amino acids from those of disclosed protein as the result of conservative amino acid substitutions, for example substitutions are among: acidic (negatively charged) amino acids such as aspartic acid and glutamic acid; basic (positively charged) amino acids such as arginine, histidine, and lysine; neutral polar amino acids such as glycine, serine, threonine, cysteine, tyrosine, asparagine, and glutamine; neutral nonpolar (hydrophobic) amino acids such as alanine, leucine, isoleucine, valine, proline, phenylalanine, tryptophan, and methionine; amino acids having aliphatic side chains such as glycine, alanine, valine, leucine, and isoleucine; amino acids having aliphatic-hydroxyl side chains such as serine and threonine; amino acids having amide-containing side chains such as asparagine and glutamine; amino acids having aromatic side chains such as phenylalanine, tyrosine, and tryptophan; amino acids having basic side chains such as lysine, arginine, and histidine; amino acids having sulfur-containing side chains such as cysteine and methionine; naturally conservative amino acids such as valine-leucine, valine-isoleucine, phenylalanine-tyrosine, lysine-arginine, alanine-valine, aspartic acid-glutamic acid, and asparagine-glutamine. A further aspect of the homologs encoded by DNA useful in the transgenic plants of the invention are those proteins that differ from a disclosed protein as the result of deletion or insertion of one or more amino acids in a native sequence.

As used herein, "percent identity" means the extent to which two optimally aligned DNA or protein segments are invariant throughout one or more windows of alignment of components, for example nucleotide sequence or amino acid sequence, allowing for gaps to account to insertions and deletions. An "identity fraction" for aligned segments of a test sequence and a reference sequence is the number of identical components that are shared by sequences of the two aligned segments divided by the total number of sequence components in the aligned parts of the reference segment over window(s) of alignment which is the smaller of the full test sequence or the full reference sequence. "Percent identity" ("% identity") is the identity fraction times 100.

The "Pfam" database is a large collection of multiple sequence alignments and hidden Markov models covering many common protein families, e.g. Pfam version 19.0 (December 2005) contains alignments and models for 8183 protein families and is based on the Swissprot 47.0 and SP-TrEMBL 30.0 protein sequence databases. See S. R. Eddy, "Profile Hidden Markov Models", *Bioinformatics* 14:755-763, 1998. The Pfam database is currently maintained and updated by the Pfam Consortium. The alignments represent some evolutionary conserved structure that has implications for the protein's function. Profile hidden Markov models (profile HMMs) built from the protein family alignments are useful for automatically recognizing that a new protein belongs to an existing protein family even if the homology by alignment appears to be low.

A "Pfam domain module" is a representation of Pfam domains in a protein, in order from N terminus to C terminus. In a Pfam domain module individual Pfam domains are separated by double colons "::". The order and copy number of the Pfam domains from N to C terminus are attributes of a Pfam domain module. Although the copy number of repetitive domains is important, varying copy number often enables a similar function. Thus, a Pfam domain module with multiple copies of a domain should define an equivalent Pfam domain module with variance in the number of multiple copies. A Pfam domain module is not specific for distance between adjacent domains, but contemplates natural distances and variations in distance that provide equivalent function. The Pfam database contains both narrowly- and broadly-defined domains, leading to identification of overlapping domains on some proteins. A Pfam domain module is characterized by non-overlapping domains. Where there is overlap, the domain having a function that is more closely associated with the function of the protein (based on the E value of the Pfam match) is selected.

Once one DNA is identified as encoding a protein which imparts an enhanced trait when expressed in transgenic plants, other DNA encoding proteins with the same Pfam domain module are identified by querying the amino acid sequence of protein encoded by candidate DNA against the Hidden Markov Models which characterizes the Pfam domains using HMMER software, a current version of which is provided in the appended computer listing. Candidate proteins meeting the same Pfam domain module are in the protein family and have cognate DNA that is useful in constructing recombinant DNA for the use in the plant cells of this invention. Hidden Markov Model databases for use with HMMER software in identifying DNA expressing protein with a common Pfam domain module for recombinant DNA in the plant cells of this invention are also included in the appended computer listing. Version 19.0 of the HMMER software and Pfam databases were used to identify known domains in the proteins corresponding to amino acid sequence of SEQ ID NO: 615 through SEQ ID NO: 1228. All DNA encoding proteins that have scores higher than the gathering cutoff disclosed in Table 23 by Pfam analysis disclosed herein can be used in recombinant DNA of the plant cells of this invention, e.g. for selecting transgenic plants having enhanced agronomic traits. The relevant Pfams modules for use in this invention, as more specifically disclosed below, are DUF6::DUF6, Sterol_desat, HMG_box, GAF::HisKA::HATPase_c, Sugar_tr, Mito_carr::Mito_carr::Mito_carr, RRM_1, 14-3-3, Globin, F-box::Kelch_1::Kelch_2::Kelch_1::Kelch_2::Kelch_2, Pkinase, zf-CHY::zf-C3HC4, AUX_IAA, Cu-oxidase_3::Cu-oxidase::Cu-oxidase_2, Sigma70_r2::Sigma70_r3::Sigma70_r4, AT_hook:: DUF296, Exo_endo_phos, H_PPase, Aldo_ket_red, CHASE::HisKA::HATPase_c::Response_reg, Myb_DNA-binding, AP2::AP2, Flavodoxin_2, P-II, zf-CCCH::zf-CCCH::KH_1::zf-CCCH, PSK, adh_short, Myb_DNA-binding::Myb_DNA-binding, FLO_LFY, LRR_1::LRR_1:: LRR_1::LRR_1::LRR_1::LRR_1::LRR_1::LRR_1:: LRR_1::LRR_1::LRR_1::LRR_1::LRR_1::LRR_1:: LRR_1::LRR_1::Pkinase, Zein, Response_reg::Myb_DNA-binding, LEA_4, DAD, DUF6::DUF6, F-box::LRR_2, LEA_2, zf-C3HC4, 2OG-FeII_Oxy, WD40::WD40, DUF231, Cullin, CBFD_NFYB_HMF, Histone, U-box, HSF_DNA-bind, GH3, LIM::LIM, RPE65, GST_N:: GST_C, IMPDH, Mlo, Copine, Rieske::PaO, ADH_N:: ADH_zinc_N, PBP, F-box, Prp19::WD40::WD40::WD40, Glycos_transf_1::S6PP, PfkB, ABA_WDS, AP2, Asp, Hydrolase, OPT, TFIIS::TFIIS_M::TFTIIS_C, Peptidase_C14, TPT, NAM, SRF-TF::K-box, G-alpha, Lactamase_B, LRR_2::LRR_2, PTR2, PB1, Pkinase::Pkinase_C, S-methyl_trans, Phytochrome::HisKA::HATPase_c, Ank:: Ank::Ank::Ank::Ank::zf-C3HC4, F-box::Kelch_2:: Kelch_2::Kelch_1::Kelch_2, Cyclin_N, Dor1, F-box:: LRR_1, BCCT, B_lectin::S_locus_glycop::PAN_2::Pkinase, SAC3_GANP, F-box::Kelch_1::Kelch_1::Kelch_1, DUF6, MFMR::bZIP_1, Skp1_POZ::Skp1, U-box::Arm::Arm:: Arm, NAF1, Ribosomal_L18p, SET, F-box::LysM, Pyridoxal_deC, PPDK_N::PEP-utilizers::PEP-utilizers_C, Transket_pyr::Transketolase_C, IPP-2, zf-B_box::zf-B_box:: CCT, MFS_1, zf-D of, RRM_1::zf-CCHC, F-box::Tub, SATase_N::Hexapep::Hexapep::Hexapep, PEMT, B_lectin:: PAN_2::Pkinase, Peptidase_S10, SOH1, Methyltransf_11, bZIP_1, DXP_reductoisom::DXP_redisom_C, Flavoprotein, MatE::MatE, Homeobox::HALZ, U-box::Arm::Arm:: Arm::Arm::Arm, zf-B_box::zf-B_box, Glycos_transf_1, zf-LSD1::zf-LSD1::zf-LSD1, Aldedh, Melibiase, HEAT:: HEAT::HEAT::FAT::Rapamycin_bind::PI3_PI4_kinase:: FATC, MtN3_slv::MtN3_slv, DUF1313, S6PP, HD-ZIP_N:: Homeobox::HALZ, WRKY, FBPase_glpX, MIF4G:: MIF4G_like::MIF4G_like_2, zf-B_box::CCT, FAD_binding_4, Hpt, TLC, CK_II_beta, TPR_1::TPR_1:: TPR_2::U-box, Response_reg, AdoHcyase_NAD, P1-PLC-X::PI-PLC-Y::C2, Pkinase::Ribonuc_2-5A, Globin:: FAD_binding_6::NAD_binding_1, PMEI, Myb_DNA-binding::Linker_histone, LRRNT_2::LRR_1::LRR_1::LRR_1:: LRR_1::LRR_1::LRR_1::LRR_1::LRR_1::LRR_1:: LRR_1::LRR_1::LRR_1::LRR_1::LRR_1::LRR_1:: LRR_1::LRR_1::LRR_1::LRR_1::LRR_1::LRR_1:: Pkinase, Pkinase::efhand::efhand::efhand::efhand, Pescadillo_N::BRCT, SPX::zf-C3HC4, AdoHcyase, zf-CCCH::zf-CCCH::zf-CCCH::zf-CCCH::zf-CCCH, SBP56, DUF850, NAS, UPF0005, Alpha-amylase::Alpha-amyl_C2, Na_H_Exchanger, PAN_1::Pkinase, F-box:: Kelch_1::Kelch_1, Remorin_C, Skp1, DUF580, zf-C2H2, zf-LSD1::Peptidase_C14, Ribosomal_L10:: Ribosomal_60s, Frigida, Methyltransf_11::Methyltransf_11, dCMP_cyt_deam_1, DUF914, Enolase_N::Enolase_C, p450, Cellulose_synt, Cu_bind_like, S6PP:: S6PP_C, BRAP2::zf-C3HC4::zf-UBP, BIR::BIR, C1_1:: DAGK_cat::DAGK_acc, PA::zf-C3HC4, DPBB_1:: Pollen_allerg_1, LRRNT_2::LRR_1::LRR_1::LRR_1:: LRR_1::LRR_1::LRR_1::LRR_1::LRR_1::LRR_1:: LRR_1::LRR_1::LRR_11::LRR_1::LRR_11::LRR_1:: LRR_1::LRR_1::Pkinase, WD40::WD40::WD40::WD40:: WD40::WD40, bZIP_2, FBPase, HLH, GRAS, SBP, Sina, Remorin_N::Remorin_C, BTB::NPH3, Glutaredoxin, AA_permease, Cyclin_N::Cyclin_C, DUF810, LRR_2, B_ectin::S_locus_glycop::PAN_2::PAN_1::Pkinase, Put_Phosphatase, DUF221, Response_reg::CCT, EMP24_GP25L, VDE, Orn_Arg_deC_N::Orn_DAP_Arg_deC, HEAT::HEAT::HEAT::HEAT::HEAT::HEAT::HEAT, PHD, UPF0041, Bromodomain, Bap31, UDPGP, Pkinase::NAF, Pirin::Pirin_C, MED7.

As used herein "promoter" means regulatory DNA for initializing transcription. A "plant promoter" is a promoter capable of initiating transcription in plant cells whether or not its origin is a plant cell, e.g. is it well known that *Agrobacterium* promoters are functional in plant cells. Thus, plant promoters include promoter DNA obtained from plants, plant viruses and bacteria such as *Agrobacterium* and *Bradyrhizobium* bacteria. Examples of promoters under developmental control include promoters that preferentially initiate transcription in certain tissues, such as leaves, roots, or seeds. Such promoters are referred to as "tissue preferred". Promoters that initiate transcription only in certain tissues are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that may effect transcription by inducible promoters include anaerobic conditions, or certain chemicals, or the presence of light. Tissue specific, tissue preferred, cell type specific, and inducible promoters constitute the class of "non-constitutive" promoters. A "constitutive" promoter is a promoter which is active under most conditions.

As used herein "operably linked" means the association of two or more DNA fragments in a DNA construct so that the function of one, e.g. protein-encoding DNA, is controlled by the other, e.g. a promoter.

As used herein "expressed" means produced, e.g. a protein is expressed in a plant cell when its cognate DNA is transcribed to mRNA that is translated to the protein.

As used herein a "control plant" means a plant that does not contain the recombinant DNA that expressed a protein that impart an enhanced trait. A control plant is to identify and select a transgenic plant that has an enhance trait. A suitable control plant can be a non-transgenic plant of the parental line used to generate a transgenic plant, i.e. devoid of recombinant DNA. A suitable control plant may in some cases be a progeny of a hemizygous transgenic plant line that is does not contain the recombinant DNA, known as a negative segregant.

As used herein an "enhanced trait" means a characteristic of a transgenic plant that includes, but is not limited to, an enhance agronomic trait characterized by enhanced plant morphology, physiology, growth and development, yield, nutritional enhancement, disease or pest resistance, or environmental or chemical tolerance. In more specific aspects of this invention enhanced trait is selected from group of enhanced traits consisting of enhanced water use efficiency, enhanced cold tolerance, increased yield, enhanced nitrogen use efficiency, enhanced seed protein and enhanced seed oil. In an important aspect of the invention the enhanced trait is enhanced yield including increased yield under non-stress conditions and increased yield under environmental stress conditions. Stress conditions may include, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability and high plant density. "Yield" can be affected by many properties including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Yield can also be affected by efficiency of germination (including germination in stressed conditions), growth rate (including growth rate in stressed conditions), ear number, seed number per ear, seed size, composition of seed (starch, oil, protein) and characteristics of seed fill.

Increased yield of a transgenic plant of the present invention can be measured in a number of ways, including test weight, seed number per plant, seed weight, seed number per unit area (i.e. seeds, or weight of seeds, per acre), bushels per acre, tons per acre, kilo per hectare. For example, maize yield may be measured as production of shelled corn kernels per unit of production area, for example in bushels per acre or metric tons per hectare, often reported on a moisture adjusted basis, for example at 15.5 percent moisture. Increased yield may result from improved utilization of key biochemical compounds, such as nitrogen, phosphorous and carbohydrate, or from improved responses to environmental stresses, such as cold, heat, drought, salt, and attack by pests or pathogens. Recombinant DNA used in this invention can also be used to provide plants having improved growth and development, and ultimately increased yield, as the result of modified expression of plant growth regulators or modification of cell cycle or photosynthesis pathways. Also of interest is the generation of transgenic plants that demonstrate enhanced yield with respect to a seed component that may or may not correspond to an increase in overall plant yield. Such properties include enhancements in seed oil, seed molecules such as tocopherol, protein and starch, or oil particular oil components as may be manifest by an alteration in the ratios of seed components.

A subset of the nucleic molecules of this invention includes fragments of the disclosed recombinant DNA consisting of oligonucleotides of at least 15, preferably at least 16 or 17, more preferably at least 18 or 19, and even more preferably at least 20 or more, consecutive nucleotides. Such oligonucleotides are fragments of the larger molecules having a sequence selected from the group consisting of SEQ ID NO:1 through SEQ ID NO: 614, and find use, for example as probes and primers for detection of the polynucleotides of the present invention.

DNA constructs are assembled using methods well known to persons of ordinary skill in the art and typically comprise a promoter operably linked to DNA, the expression of which provides the enhanced agronomic trait. Other construct components may include additional regulatory elements, such as 5' leaders and introns for enhancing transcription, 3' untranslated regions (such as polyadenylation signals and sites), DNA for transit or signal peptides.

Numerous promoters that are functional in plant cells have been described in the literature. These include promoters present in plant genomes as well as promoters from other sources, including nopaline synthase (NOS) promoter and octopine synthase (OCS) promoters carried on tumor-inducing plasmids of *Agrobacterium tumefaciens*, caulimovirus promoters from the cauliflower mosaic virus. For instance, see U.S. Pat. Nos. 5,858,742 and 5,322,938, which disclose versions of the constitutive promoter derived from cauliflower mosaic virus (CaMV35S), U.S. Pat. No. 5,641,876, which discloses a rice actin promoter, U.S. Patent Application Publication 2002/0192813A1, which discloses 5', 3' and intron elements useful in the design of effective plant expression vectors, U.S. patent application Ser. No. 09/757,089, which discloses a maize chloroplast aldolase promoter, U.S.

patent application Ser. No. 08/706,946, which discloses a rice glutelin promoter, U.S. patent application Ser. No. 09/757,089, which discloses a maize aldolase (FDA) promoter, and U.S. Patent Application Ser. No. 60/310,370, which discloses a maize nicotianamine synthase promoter, all of which are incorporated herein by reference. These and numerous other promoters that function in plant cells are known to those skilled in the art and available for use in recombinant polynucleotides of the present invention to provide for expression of desired genes in transgenic plant cells.

In other aspects of the invention, preferential expression in plant green tissues is desired. Promoters for such use include those from genes such as *Arabidopsis thaliana* ribulose-1,5-bisphosphate carboxylase (Rubisco) small subunit (Fischhoff et al. (1992) *Plant Mol. Biol.* 20:81-93), aldolase and pyruvate orthophosphate dikinase (PPDK) (Taniguchi et al. (2000) *Plant Cell Physiol.* 41(1):42-48).

A promoter may be altered to contain multiple "enhancer sequences" to assist in elevating gene expression. Such enhancers are known in the art. By including an enhancer sequence with a promoter, expression may be enhanced. These enhancers often are found 5' to the start of transcription in a promoter that functions in eukaryotic cells, but can often be inserted upstream (5') or downstream (3') to the coding sequence. In some instances, these 5' enhancing elements are introns. Particularly useful as enhancers are the 5' introns of the rice actin 1 (see U.S. Pat. No. 5,641,876) and rice actin 2 genes, the maize alcohol dehydrogenase gene intron, the maize heat shock protein 70 gene intron (U.S. Pat. No. 5,593,874) and the maize shrunken 1 gene.

In other aspects of the invention, sufficient expression in plant seed tissues is desired to affect improvements in seed composition. Exemplary promoters for use for seed composition modification include promoters from seed genes such as napin (U.S. Pat. No. 5,420,034), maize L3 oleosin (U.S. Pat. No. 6,433,252), zein Z27 (Russell et al. (1997) *Transgenic Res.* 6(2): 157-166), globulin 1 (Belanger et al (1991) *Genetics* 129:863-872), glutelin 1 (Russell supra), and peroxiredoxin antioxidant (Per1) (Stacy et al. (1996) *Plant Mol Biol.* 31(6):1205-1216).

Recombinant DNA constructs prepared in accordance with the invention will also generally include a 3' element that typically contains a polyadenylation signal and site. Well-known 3' elements include those from *Agrobacterium tumefaciens* genes such as nos 3', tml 3', tmr 3', tms 3', ocs 3', tr7 3', for example disclosed in U.S. Pat. No. 6,090,627, incorporated herein by reference; 3' elements from plant genes such as wheat (*Triticum aesevitum*) heat shock protein 17 (Hsp17 3'), a wheat ubiquitin gene, a wheat fructose=1,6-biphosphatase gene, a rice glutelin gene, a rice lactate dehydrogenase gene and a rice beta-tubulin gene, all of which are disclosed in U.S. published patent application 2002/0192813 A1, incorporated herein by reference; and the pea (*Pisum sativum*) ribulose biphosphate carboxylase gene (rbs 3'), and 3' elements from the genes within the host plant.

Constructs and vectors may also include a transit peptide for targeting of a gene to a plant organelle, particularly to a chloroplast, leucoplast or other plastid organelle. For descriptions of the use of chloroplast transit peptides see U.S. Pat. No. 5,188,642 and U.S. Pat. No. 5,728,925, incorporated herein by reference.

Transgenic plants comprising or derived from plant cells of this invention transformed with recombinant DNA can be further enhanced by incorporating DNA providing other traits, e.g. herbicide and/or pest resistance traits. DNA for insect resistance can be derived from *Bacillus thuringensis* to provide resistance against lepidopteran, coliopteran, homopteran, hemiopteran, and other insects. DNA for herbicide resistance can provide resistance to glyphosate, dicamba, glufosinate, sulfonylurea, bromoxynil or norflurazon herbicides. For example, DNA encoding 5-enolpyruvylshikimate-3-phosphate synthase (EPSPS) disclosed in U.S. Pat. Nos. 5,094,945; 5,627,061; 5,633,435 and 6,040,497 can impart glyphosate tolerance; DNA encoding a glyphosate oxidoreductase (GOX) disclosed in U.S. Pat. No. 5,463,175 and a glyphosate-N-acetyl transferase (GAT) disclosed in U.S. Patent Application publication 2003/0083480 A1 can also impart glyphosate tolerance; DNA encoding a dicamba monooxygenase disclosed in U.S. Patent Application publication 2003/0135879 A1 can impart dicamba tolerance; DNA encoding bromoxynil nitrilase (Bxn) disclosed in U.S. Pat. No. 4,810,648 can impart bromoxynil tolerance; DNA encoding phytoene desaturase (crtI) described in Misawa et al, (1993) *Plant J.* 4:833-840 can impart norflurazon tolerance; DNA encoding acetohydroxyacid synthase described in Sathasiivan et al. (1990) *Nucl. Acids Res.* 18:2188-2193 can impart sulfonylurea herbicide tolerance; DNA encoding a BAR protein as disclosed in DeBlock, et al. (1987) *EMBO J.* 6:2513-2519 can impart glufosinate and bialaphos tolerance; DNA disclosed in U.S. Patent Application Publication 2003/010609 A1 can impart N-amino methyl phosphonic acid tolerance; DNA disclosed in U.S. Pat. No. 6,107,549 can impart pyridine herbicide resistance; DNA molecules and methods for imparting tolerance to multiple herbicides such as glyphosate, atrazine, ALS inhibitors, isoxoflutole and glufosinate herbicides are disclosed in U.S. Pat. No. 6,376,754 and U.S. Patent Application Publication 2002/0112260, all of said U.S. patents and Patent Application Publications are incorporated herein by reference. Molecules and methods for imparting insect/nematode/virus resistance are disclosed in U.S. Pat. Nos. 5,250,515; 5,880,275; 6,506,599; 5,986,175 and U.S. Patent Application Publication 2003/0150017 A1, all of which are incorporated herein by reference.

Plant Cell Transformation Methods

Numerous methods for transforming plant cells with recombinant DNA are known in the art and may be used to make the transgenic plants, cells and nuclei of this invention. Two commonly used methods for plant transformation are *Agrobacterium*-mediated transformation and microprojectile bombardment. Microprojectile bombardment methods are illustrated in U.S. Pat. No. 5,015,580 (soybean); U.S. Pat. No. 5,550,318 (corn); U.S. Pat. No. 5,538,880 (corn); U.S. Pat. No. 5,914,451 (soybean); U.S. Pat. No. 6,160,208 (corn); U.S. Pat. No. 6,399,861 (corn); U.S. Pat. No. 6,153,812 (wheat) and U.S. Pat. No. 6,365,807 (rice) and *Agrobacterium*-mediated transformation is described in U.S. Pat. No. 5,159,135 (cotton); U.S. Pat. No. 5,824,877 (soybean); U.S. Pat. No. 5,463,174 (canola); U.S. Pat. No. 5,591,616 (corn); U.S. Pat. No. 6,384,301 (soybean), U.S. Pat. No. 7,026,528 (wheat) and U.S. Pat. No. 6,329,571 (rice), all of which are incorporated herein by reference. For *Agrobacterium tumefaciens* based plant transformation systems, additional elements present on transformation constructs will include T-DNA left and right border sequences to facilitate incorporation of the recombinant polynucleotide into the plant genome.

In general it is useful to introduce recombinant DNA randomly, i.e. at a non-specific location, in the genome of a target plant line. In special cases it may be useful to target recombinant DNA insertion in order to achieve site-specific integration, for example, to replace an existing gene in the genome, to use an existing promoter in the plant genome, or to insert a recombinant polynucleotide at a predetermined site known to be active for gene expression. Several site specific recombination systems exist which are known to function in plants including cre-lox as disclosed in U.S. Pat. No. 4,959,317 and FLP-FRT as disclosed in U.S. Pat. No. 5,527,695, both incorporated herein by reference.

Transformation methods of this invention are preferably practiced in tissue culture on media and in a controlled environment. "Media" refers to the numerous nutrient mixtures that are used to grow cells in vitro, that is, outside of the intact living organism. Recipient cell targets include, but are not limited to, meristem cells, hypocotyls, calli, immature embryos and gametic cells such as microspores, pollen, sperm and egg cells. It is contemplated that any cell from which a fertile plant may be regenerated is useful as a recipient cell. Callus may be initiated from tissue sources including, but not limited to, immature embryos, hypocotyls, seedling apical meristems, microspores and the like. Cells capable of proliferating as callus are also recipient cells for genetic transformation. Practical transformation methods and materials for making transgenic plants of this invention, for example various media and recipient target cells, transformation of immature embryo cells and subsequent regeneration of fertile transgenic plants are disclosed in U.S. Pat. Nos. 6,194,636 and 6,232,526, which are incorporated herein by reference.

The seeds of transgenic plants can be harvested from fertile transgenic plants and be used to grow progeny generations of transformed plants of this invention including hybrid plants line for selection of plants having an enhanced trait. In addition to direct transformation of a plant with a recombinant DNA, transgenic plants can be prepared by crossing a first plant having a recombinant DNA with a second plant lacking the DNA. For example, recombinant DNA can be introduced into a first plant line that is amenable to transformation to produce a transgenic plant which can be crossed with a second plant line to introgress the recombinant DNA into the second plant line. A transgenic plant with recombinant-DNA providing an enhanced trait, e.g. enhanced yield, can be crossed with transgenic plant line having other recombinant DNA that confers another trait, for example herbicide resistance or pest resistance, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait; such plants can be identified by markers associated with parental recombinant DNA, e.g. marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as one original transgenic parental line but for the recombinant DNA of the other transgenic parental line.

In the practice of transformation DNA is typically introduced into chromosomes in the nuclei of only a small percentage of target plant cells in any one transformation experiment. Marker genes are used to provide an efficient system for identification of those cells that are stably transformed by receiving and integrating a recombinant DNA molecule into their genomes. Preferred marker genes provide selective markers which confer resistance to a selective agent, such as an antibiotic or an herbicide. Any of the herbicides to which plants of this invention may be resistant are useful agents for selective markers. Plant cells containing potentially transformed nuclei are exposed to the selective agent. In the population of surviving cells will be those cells where, generally, the resistance-conferring gene is integrated and expressed at sufficient levels to permit cell survival. Cells may be tested further to confirm stable integration of the exogenous DNA. Commonly used selective marker genes include those conferring resistance to antibiotics such as kanamycin and paromomycin (nptII), hygromycin B (aph IV); spectinomycin (aadA) and gentamycin (aac3 and aacC4) or resistance to herbicides such as glufosinate (bar or pat), dicamba (DMO) and glyphosate (aroA or EPSPS). Examples of such selectable markers are illustrated in U.S. Pat. Nos. 5,550,318; 5,633,435; 5,780,708 and 6,118,047, all of which are incorporated herein by reference. Selectable markers which provide an ability to visually identify transformants can also be employed, for example, a gene expressing a colored or fluorescent protein such as a luciferase or green fluorescent protein (GFP) or a gene expressing a beta-glucuronidase or uidA gene (GUS) for which various chromogenic substrates are known.

Plant cells that survive exposure to the selective agent, or plant cells that have been scored positive in a screening assay, may be cultured in regeneration media and allowed to mature into plants having the transformed nuclei. Developing plantlets regenerated from transformed plant cells can be transferred to plant growth mix, and hardened off, for example, in an environmentally controlled chamber at about 85% relative humidity, 600 ppm $CO_2$, and 25-250 microeinsteins $m^{-2}$ $s^{-1}$ of light, prior to transfer to a greenhouse or growth chamber for maturation. Plants are regenerated from about 6 weeks to 10 months after a transformant is identified, depending on the initial tissue, and the plant species. Plants may be pollinated using conventional plant breeding methods known to those of skill in the art and seed produced, for example self-pollination is commonly used with transgenic corn. The regenerated transformed plant or its progeny seed or plants can be tested for expression of the recombinant DNA and selected for the presence of enhanced agronomic trait.

Transgenic Plants and Seeds

Transgenic plants derived from the plant cells of this invention are grown to generate transgenic plants having an enhanced trait as compared to a control plant and produce transgenic seed and haploid pollen of this invention. Such plants with enhanced traits are identified by selection of transformed plants or progeny seed for the enhanced trait. For efficiency a selection method is designed to evaluate multiple transgenic plants (events) comprising the recombinant DNA, for example multiple plants from 2 to 20 or more transgenic events. Transgenic plants grown from transgenic seed provided herein demonstrate improved agronomic traits that contribute to increased yield or other trait that provides increased plant value, including, for example, improved seed quality. Of particular interest are plants having enhanced water use efficiency, enhanced cold tolerance, increased yield, enhanced nitrogen use efficiency, enhanced seed protein and enhanced seed oil.

Table 2 provides a list of proteins SEQ ID NO: 615 through SEQ ID NO: 1228 encoding DNA ("genes") that are useful as recombinant DNA for production of transgenic plants with enhanced agronomic trait.

Column headings in Table 2 refer to the following information: "PEP SEQ ID" refers to a particular number of amino acid sequence in the Sequence Listing. "PHE ID" refers to an arbitrary number used to identify a particular recombinant polynucleotide corresponding to the translated protein encoded by the polynucleotide. "NUC SEQ ID" refers to a particular number of a nucleic acid sequence in the Sequence Listing which defines a polynucleotide used in a recombinant polynucleotide of this invention. "GENE NAME" refers to a common name for the recombinant polynucleotide. "GENE EFFECT" refers to the effect of the expressed polypeptide in providing yield improvement or other enhanced property. "CODING SEQUENCE" refers to peptide coding segments of the polynucleotide. "SPECIES" refers to the organism from which the polynucleotide DNA was derived.

TABLE 2

| PEP SEQ ID | PHE ID | NUC SEQ ID | Gene Name | Gene Effect | Coding Sequence | Species |
|---|---|---|---|---|---|---|
| 615 | PHE0000002 | 1 | *Arabidopsis* AtHAP3a | Stress tolerance | 103-525 | *Arabidopsis thaliana* |
| 616 | PHE0000003 | 2 | corn AtHAP3a-like1 | Stress tolerance | 149-817 | *Zea mays* |
| 617 | PHE0000004 | 3 | corn AtHAP3a-like2 | Stress tolerance | 196-750 | *Zea mays* |
| 618 | PHE0000005 | 4 | corn AtHAP3a-like3 | Stress tolerance | 91-588 | *Zea mays* |
| 619 | PHE0000021 | 5 | *Arabidopsis* CCA1 | Stress tolerance | 238-2061 | *Arabidopsis thaliana* |
| 620 | PHE0000041 | 6 | corn hemoglobin 2 | Stress tolerance | 67-639 | *Zea mays* |
| 621 | PHE0000066 | 7 | At TOR1-like | Stress tolerance | 1462-1626, 1850-2188, 2267-2341, 2519-2691, 3060-3158, 3442-3634, 3703-3846, 3984-4153, 4233-4437, 4511-4699, 4907-5059, 5528-5649, 5735-5837, 5912-6007, 6309-6439, 7148-7250, 7326-7508, 7583-7675, 7914-8012, 8096-8194, 8247-8451, 8764-8888, 8999-9051, 9493-9616, 9734-9904, 10380-10532, 10599-10751, 11235-11306, 11414-11548, 11625-11686, 11819-11916, 12172-12281, 12358-12531, 12647-12712, 13059-13127, 13235-13345, 13685-13825, 13917-14045, 14168-14333, 14421-14629, 14795-15001, 15165-15278, 15383-15613, 15896-15976, 16081-16155, 16234-16300, 16400-16560, 16707-16880, 16967-17095, 17187-17270, 17379-17440, 17521-17593, 17678-18001, 18086-18385 | *Arabidopsis thaliana* |
| 622 | PHE0000078 | 8 | *E. coli* glnB | Carbon and/or nitrogen metabolism | 35-373 | *Escherichia coli* |
| 623 | PHE0000080 | 9 | G28/BAA32418 | Stress tolerance | 3-803 | *Arabidopsis thaliana* |
| 624 | PHE0000081 | 10 | G378 | Stress tolerance | 1-723 | *Arabidopsis thaliana* |
| 625 | PHE0000094 | 11 | G464 | Stress tolerance | 41-661 | *Arabidopsis thaliana* |
| 626 | PHE0000112 | 12 | Curly Leaf-variant 1 | Apomixis | 108-901, 1084-1177, 1251-3055 | *Zea mays* |
| 627 | PHE0000113 | 13 | Curly Leaf-variant 2 | Apomixis | 113-912, 1083-1191, 1257-2806 | *Zea mays* |
| 628 | PHE0000140 | 14 | casein kinase II alpha subunit | Flower development | 202-1200 | *Zea mays* |
| 629 | PHE0000151 | 15 | Adenosylhomo cysteinase | Stress tolerance | 71-1525 | *Zea mays* |
| 630 | PHE0000199 | 16 | ethylene response sensor | Ethylene signaling | 79-1986 | *Zea mays* |
| 631 | PHE0000214 | 17 | maize glycine rich protein | Stress tolerance | 70-540 | *Zea mays* |
| 632 | PHE0000364 | 18 | wilt-like 1 | Stress tolerance | 316-1644 | *Zea mays* |
| 633 | PHE0000365 | 19 | wilt-like 2 | Stress tolerance | 334-1512 | *Zea mays* |
| 634 | PHE0000366 | 20 | wilt-like 3 | Stress tolerance | 263-1552 | *Zea mays* |
| 635 | PHE0000367 | 21 | wilt-like 4 | Stress tolerance | 202-1419 | *Zea mays* |
| 636 | PHE0000373 | 23 | G1411 | Plant growth and development | 1-747 | *Arabidopsis thaliana* |
| 637 | PHE0000374 | 24 | G1449 | Plant growth and development | 1-474 | *Arabidopsis thaliana* |
| 638 | PHE0000375 | 25 | G1635 | Plant growth and development | 1-1161 | *Arabidopsis thaliana* |
| 639 | PHE0000376 | 26 | G188 | Stress tolerance | 1-1044 | *Arabidopsis thaliana* |
| 640 | PHE0000377 | 27 | G19 | Stress tolerance | 1-747 | *Arabidopsis thaliana* |

TABLE 2-continued

| PEP SEQ ID | PHE ID | NUC SEQ ID | Gene Name | Gene Effect | Coding Sequence | Species |
|---|---|---|---|---|---|---|
| 641 | PHE0000378 | 28 | G559 | Plant growth and development | 1-1194 | Arabidopsis thaliana |
| 642 | PHE0000379 | 29 | G865 | Plant growth and development | 1-636 | Arabidopsis thaliana |
| 643 | PHE0000381 | 30 | corn G214 | Stress tolerance | 1-2160 | Zea mays |
| 644 | PHE0000383 | 31 | 700151210_FLI-corn L5 a | Plant growth and development | 61-966 | Zea mays |
| 645 | PHE0000384 | 32 | LIB3957-023-C10_FLI-corn C-type cyclin | Plant growth and development | 134-904 | Zea mays |
| 646 | PHE0000405 | 33 | ASH2-F17I14_190 (Suppressor of hog1) | Stress tolerance | 370-1965 | Arabidopsis thaliana |
| 647 | PHE0000406 | 34 | soy ASH2-like 1 | Stress tolerance | 67-1329 | Glycine max |
| 648 | PHE0000407 | 35 | soy ASH2-like 3 | Stress tolerance | 37-1464 | Glycine max |
| 649 | PHE0000408 | 36 | soy ASH2-like 4 | Stress tolerance | 49-1971 | Glycine max |
| 650 | PHE0000409 | 37 | corn pescadillo-like 1 | Plant growth and development | 55-1911 | Zea mays |
| 651 | PHE0000410 | 38 | yeast pescadillo homologue-Z72888 | Plant growth and development | 657-2474 | Saccharomyces cerevisiae |
| 652 | PHE0000424 | 39 | soy GA2-oxidase | Plant growth and development | 38-1036 | Glycine max |
| 653 | PHE0000447 | 40 | corn phospholipase C 1 | Stress tolerance | 228-1985 | Zea mays |
| 654 | PHE0000448 | 41 | corn diacylglycerol kinase 2 | Stress tolerance | 141-2282 | Zea mays |
| 655 | PHE0000449 | 42 | corn Ins(1,4,5)P(3) 5-phosphatase 1 | Stress tolerance | 116-1849 | Zea mays |
| 656 | PHE0000459 | 43 | Anabaena SPP | Carbon and/or nitrogen metabolism | 1-747 | Nostoc PCC7120 |
| 657 | PHE0000460 | 44 | Corn SPP | Carbon and/or nitrogen metabolism | 1-1269 | Zea mays |
| 658 | PHE0000461 | 45 | UDPgpp | Carbon and/or nitrogen metabolism | 1-1419 | Zea mays |
| 659 | PHE0000464 | 46 | soy U-box protein 1 | Plant growth and development | 137-2119 | Glycine max |
| 660 | PHE0000465 | 47 | soy U-box protein 2 | Plant growth and development | 63-1355 | Glycine max |
| 661 | PHE0000466 | 48 | soy U-box protein 3 | Plant growth and development | 26-2053 | Glycine max |
| 662 | PHE0000467 | 49 | corn U-box protein 3 | Plant growth and development | 197-1774 | Zea mays |
| 663 | PHE0000468 | 50 | corn U-box protein 4 | Plant growth and development | 104-1183 | Zea mays |
| 664 | PHE0000474 | 51 | yeast ado1 | Stress tolerance | 567-1589 | Saccharomyces cerevisiae |
| 665 | PHE0000475 | 52 | corn adenosine kinase 1 | Stress tolerance | 264-1289 | Zea mays |
| 666 | PHE0000476 | 53 | soy adenosine kinase 2 | Stress tolerance | 90-1112 | Glycine max |
| 667 | PHE0000477 | 54 | Synechocystis hypothetical sugar kinase-BAA10827 | Stress tolerance | 86-1087 | Synechocystis sp. PCC 6803 |
| 668 | PHE0000478 | 55 | corn adenosylhomocysteinase 1 | Stress tolerance | 38-1492 | Zea mays |
| 669 | PHE0000479 | 56 | yeast S-adenosyl-L-homocysteine hydrolase-NP_010961 | Stress tolerance | 142-1491 | Saccharomyces cerevisiae |
| 670 | PHE0000480 | 57 | Synechocystis S-adenosylhomocysteine hydrolase-BAA18079 | Stress tolerance | 305-1582 | Synechocystis sp. PCC 6803 |
| 671 | PHE0000481 | 58 | soy RING finger protein 1 [BCRA1] | Plant growth and development | 64-1494 | Glycine max |
| 672 | PHE0000482 | 59 | Aspergillus yA (laccase 1)-X52552 | Stress tolerance | 913-1107, 1162-1217, 1289-1459, 1535-1705, 1759-1884, 1949-3059 | Emericella nidulans |
| 673 | PHE0000483 | 60 | Synechocystis Sucrose phosphate synthase | Carbon and/or nitrogen metabolism | 1-2160 | Synechocystis sp. PCC 6803 |
| 674 | PHE0000487 | 61 | yeast HAL3-Z28297 | Plant growth and development | 64-1752 | Saccharomyces cerevisiae |
| 675 | PHE0000488 | 62 | yeast GLC8-P41818 | Plant growth and development | 2556-3245 | Saccharomyces cerevisiae |
| 676 | PHE0000489 | 63 | corn HAL3-like 1-LIB3060-046-G12_FLI | Plant growth and development | 24-659 | Zea mays |

TABLE 2-continued

| PEP SEQ ID | PHE ID | NUC SEQ ID | Gene Name | Gene Effect | Coding Sequence | Species |
|---|---|---|---|---|---|---|
| 677 | PHE0000490 | 64 | corn HAL3-like 2- | Plant growth and development | 237-881 | *Zea mays* |
| 678 | PHE0000491 | 65 | corn GLC8-like 2 | Plant growth and development | 232-726 | *Zea mays* |
| 679 | PHE0000492 | 66 | corn GLC8-like 1 | Plant growth and development | 98-625 | *Zea mays* |
| 680 | PHE0000495 | 69 | *Agrobacterium* aiiA-like protein [attM]-AAD43990 | Stress tolerance | 98-865 | *Agrobacterium tumefaciens* |
| 681 | PHE0000496 | 70 | *Xylella* aiiA-like protein-XF1361 | Stress tolerance | 365-1204 | *Xylella fastidiosa* |
| 682 | PHE0000497 | 71 | *Xanthomonas* aiiA-like protein | Stress tolerance | 121-1044 | |
| 683 | PHE0000498 | 72 | corn histone H4 | Seed development | 83-391 | *Zea mays* |
| 684 | PHE0000499 | 73 | high sulfur zein protein precursor | Seed development | 29-661 | *Zea mays* |
| 685 | PHE0000500 | 74 | corn RING finger protein 25 | Plant growth and development | 353-1771 | *Zea mays* |
| 686 | PHE0000501 | 75 | corn MKP 1 [MAP kinase 4] | Signal transduction | 157-1278 | *Zea mays* |
| 687 | PHE0000502 | 76 | corn MKP 3 [MAP kinase 5] | Signal transduction | 110-1300 | *Zea mays* |
| 688 | PHE0000503 | 77 | corn MKP 4 | Signal transduction | 76-1185 | *Zea mays* |
| 689 | PHE0000504 | 78 | corn MKP 6 | Signal transduction | 411-2174 | *Zea mays* |
| 690 | PHE0000505 | 79 | corn MKP 7 | Signal transduction | 382-1854 | *Zea mays* |
| 691 | PHE0000506 | 80 | corn MKP 8 [cdc2 kinase] | Signal transduction | 217-1098 | *Zea mays* |
| 692 | PHE0000507 | 81 | soy MKP 1 | Signal transduction | 175-1293 | *Glycine max* |
| 693 | PHE0000508 | 82 | soy MKP 4 | Signal transduction | 334-1446 | *Glycine max* |
| 694 | PHE0000509 | 83 | corn ABF2-like 1 | Stress tolerance | 141-350, 440-1315 | *Zea mays* |
| 695 | PHE0000510 | 84 | soy ABF2-like 1 | Stress tolerance | 114-1046 | *Glycine max* |
| 696 | PHE0000511 | 85 | maize PPDK | Carbon and/or nitrogen metabolism | 131-3043 | *Zea mays* |
| 697 | PHE0000512 | 86 | yeast YOR161c-Z75069 | Stress tolerance | 1002-2621 | *Saccharomyces cerevisiae* |
| 698 | PHE0000513 | 87 | yeast HNM1-Z72599 | Stress tolerance | 419-2110 | *Saccharomyces cerevisiae* |
| 699 | PHE0000514 | 88 | *Xylella* SAG13-like-E82748 | Plant growth and development | 67-843 | *Xylella fastidiosa* |
| 700 | PHE0000515 | 89 | corn SAG13-like 1 | Plant growth and development | 74-862 | *Zea mays* |
| 701 | PHE0000516 | 90 | soy SAG13-like 1 | Plant growth and development | 49-855 | *Glycine max* |
| 702 | PHE0000517 | 91 | soy SAG13-like 2 | Plant growth and development | 25-837 | *Glycine max* |
| 703 | PHE0000518 | 92 | *Nostoc punctiforme* SAG13-like | Plant growth and development | 68-853 | *Nostoc punctiforme* |
| 704 | PHE0000520 | 93 | corn clavata3-like | Plant growth and development | 145-384 | *Zea mays* |
| 705 | PHE0000521 | 94 | corn clavata3-like | Plant growth and development | 22-255 | *Zea mays* |
| 706 | PHE0000523 | 96 | corn clv3-like 2 | Plant growth and development | 69-356 | *Zea mays* |
| 707 | PHE0000525 | 98 | corn violaxanthin de-epoxidase | Stress tolerance | 77-1414 | *Zea mays* |
| 708 | PHE0000526 | 99 | rice serine acetyltransferase 1 | Stress tolerance | 51-1070 | *Oryza sativa* |
| 709 | PHE0000527 | 100 | rice serine acetyltranferase 2 | Stress tolerance | 131-1192 | *Oryza sativa* |
| 710 | PHE0000528 | 101 | corn CEO-like protein | Stress tolerance | 134-1873 | *Zea mays* |
| 711 | PHE0000529 | 102 | wheat nicotianamine aminotransferase | Iron uptake | 43-1041 | *Triticum aestivum* |
| 712 | PHE0000530 | 103 | corn nicotianamine synthase 1 | Iron uptake | 55-1146 | *Zea mays* |
| 713 | PHE0000531 | 104 | corn ys1-like1 | Iron uptake | 277-2292 | *Zea mays* |
| 714 | PHE0000532 | 105 | rice glutamate decarboxylase | Plant growth and development | 77-1552 | *Oryza sativa* |
| 715 | PHE0000533 | 106 | rice GA2 oxidase | Plant growth and development | 74-1219 | *Oryza sativa* |

TABLE 2-continued

| PEP SEQ ID | PHE ID | NUC SEQ ID | Gene Name | Gene Effect | Coding Sequence | Species |
|---|---|---|---|---|---|---|
| 716 | PHE0000534 | 107 | corn mlo-like 1 | Plant growth and development | 57-1583 | Zea mays |
| 717 | PHE0000535 | 108 | corn G alpha 1 | Plant growth and development | 220-1329 | Zea mays |
| 718 | PHE0000536 | 109 | corn G beta 2 | Plant growth and development | 58-1059 | Zea mays |
| 719 | PHE0000537 | 110 | corn g gamma-like 1 | Plant growth and development | 64-407, 514-655 | Zea mays |
| 720 | PHE0000538 | 111 | rice tubby 1 | Plant growth and development | 4-1221 | Oryza sativa |
| 721 | PHE0000539 | 112 | maize tubby 3 | Plant growth and development | 49-1122 | Zea mays |
| 722 | PHE0000540 | 113 | maize tubby 4 | Plant growth and development | 257-1600 | Zea mays |
| 723 | PHE0000541 | 114 | corn tubby 5 | Plant growth and development | 100-1200 | Zea mays |
| 724 | PHE0000542 | 115 | maize tubby 6 | Plant growth and development | 83-1390 | Zea mays |
| 725 | PHE0000543 | 116 | maize tubby 7 | Plant growth and development | 125-1327 | Zea mays |
| 726 | PHE0000544 | 117 | corn tubby 9 | Plant growth and development | 333-1700 | Zea mays |
| 727 | PHE0000545 | 118 | rice LRR.F-box protein 1 | Plant growth and development | 83-1867 | Oryza sativa |
| 728 | PHE0000546 | 119 | corn LRR.F-box protein 7 | Plant growth and development | 167-1936 | Zea mays |
| 729 | PHE0000547 | 120 | cotton ttg1-1 | Stress tolerance | 19-1056 | Gossypium hirsutum |
| 730 | PHE0000548 | 121 | corn nucellin-like protein 1 | Seed development | 42-1424 | Zea mays |
| 731 | PHE0000549 | 122 | rice nucellin-like protein 1 | Seed development | 37-1443 | Oryza sativa |
| 732 | PHE0000550 | 123 | rice G1449-like 1 | Plant growth and development | 107-652 | Oryza sativa |
| 733 | PHE0000551 | 124 | rice LEA 1 | Stress tolerance | 87-686 | Oryza sativa |
| 734 | PHE0000552 | 125 | rice LEA 2 [wsi18] | Stress tolerance | 70-714 | Oryza sativa |
| 735 | PHE0000553 | 126 | corn LEA 1 | Stress tolerance | 94-1008 | Zea mays |
| 736 | PHE0000554 | 127 | corn LEA 2 | Stress tolerance | 85-777 | Zea mays |
| 737 | PHE0000555 | 128 | corn adenylate transporter 1 | Plant growth and development | 49-1938 | Zea mays |
| 738 | PHE0000556 | 129 | Xylella adenylate transporter-XF1738 | Plant growth and development | 54-1376 | Xylella fastidiosa |
| 739 | PHE0000557 | 130 | yeast AAC2-Z35791 | Plant growth and development | 66-1022 | Saccharomyces cerevisiae |
| 740 | PHE0000558 | 131 | yeast TFS1-X62105 | Flower development | 16-675 | Saccharomyces cerevisiae |
| 741 | PHE0000559 | 132 | yeast YLR179C-AAB67472 | Flower development | 124-729 | Saccharomyces cerevisiae |
| 742 | PHE0000560 | 133 | ZmSPS2-2 | Carbon and/or nitrogen metabolism | 29-2920 | Zea mays |
| 743 | PHE0000561 | 134 | rice FPF1-like 1 | Flower development | 93-458 | Oryza sativa |
| 744 | PHE0000562 | 135 | rice FPF1-like 3 | Flower development | 60-413 | Oryza sativa |
| 745 | PHE0000563 | 136 | corn FPF1-like 1 | Flower development | 132-473 | Zea mays |
| 746 | PHE0000564 | 137 | corn FPF1-like 6 | Flower development | 31-345 | Zea mays |
| 747 | PHE0000565 | 138 | corn FLC-like 3 | Flower development | 210-905 | Zea mays |
| 748 | PHE0000566 | 139 | corn FLC-like 9 | Flower development | 305-976 | Zea mays |
| 749 | PHE0000567 | 140 | corn selenium-binding protein | Stress tolerance | 239-1717 | Zea mays |
| 750 | PHE0000568 | 141 | maize glutathione S-transferase IV | Stress tolerance | 103-771 | Zea mays |
| 751 | PHE0000569 | 142 | calcium-dependent protein kinase | Stress tolerance | 177-1844 | Zea mays |
| 752 | PHE0000570 | 143 | protein kinase CK2 regulatory subunit CK2B3 | Stress tolerance | 178-993 | Zea mays |
| 753 | PHE0000571 | 144 | 19K zein precursor | Stress tolerance | 46-747 | Zea mays |
| 754 | PHE0000572 | 145 | corn EREBP/AP2-like transcription factor | Stress tolerance | 114-1196 | Zea mays |
| 755 | PHE0000573 | 146 | G-box binding factor 1 | Stress tolerance | 145-1275 | Zea mays |

TABLE 2-continued

| PEP SEQ ID | PHE ID | NUC SEQ ID | Gene Name | Gene Effect | Coding Sequence | Species |
|---|---|---|---|---|---|---|
| 756 | PHE0000574 | 147 | corn high mobility group protein | Stress tolerance | 145-615 | Zea mays |
| 757 | PHE0000575 | 148 | corn glycine-rich RNA-binding protein | Stress tolerance | 70-492 | Zea mays |
| 758 | PHE0000576 | 149 | corn enolase 1 | Stress tolerance | 86-1423 | Zea mays |
| 759 | PHE0000577 | 150 | maize RING finger protein | Stress tolerance | 72-680 | Zea mays |
| 760 | PHE0000578 | 151 | maize 60S acidic ribosomal protein P0 | Stress tolerance | 123-1079 | Zea mays |
| 761 | PHE0000579 | 152 | corn nucleotide-binding protein | Stress tolerance | 223-1266 | Zea mays |
| 762 | PHE0000580 | 153 | MADS affecting flowering 1-AAK37527 | Flower development | 31-618 | Arabidopsis thaliana |
| 763 | PHE0000581 | 154 | G1760-Q9SZJ6 | Flower development | 50-733 | Arabidopsis thaliana |
| 764 | PHE0000582 | 155 | G2010-CAB56582 | Flower development | 1-522 | Arabidopsis thaliana |
| 765 | PHE0000583 | 156 | SAG13-AAF09487 | Plant growth and development | 1-903 | Arabidopsis thaliana |
| 766 | PHE0000584 | 157 | Rice SAG13-like | Plant growth and development | 7-786 | Oryza sativa |
| 767 | PHE0000585 | 158 | corn FLT-like 1 | Flower development | 317-835 | Zea mays |
| 768 | PHE0000586 | 159 | corn FLT-like 2 | Flower development | 65-595 | Zea mays |
| 769 | PHE0000587 | 160 | corn FLT-like 3 | Flower development | 72-263, 626-994 | Zea mays |
| 770 | PHE0000588 | 161 | rice leafy-AB005620 | Flower development | 76-1245 | Oryza sativa |
| 771 | PHE0000589 | 162 | corn HD1-like 1 | Flower development | 93-926 | Zea mays |
| 772 | PHE0000590 | 163 | rice plastidic ATP/ADP-transporter-BAB40979 | Plant growth and development | 109-915, 2211-2480, 2563-2706, 2792-3145, 3591-3950 | Oryza sativa |
| 773 | PHE0000591 | 164 | rice L5 a | Plant growth and development | 80-991 | Oryza sativa |
| 774 | PHE0000592 | 165 | corn L5 | Plant growth and development | 61-966 | Zea mays |
| 775 | PHE0000593 | 166 | corn L5-like | Plant growth and development | 8-871 | Zea mays |
| 776 | PHE0000594 | 167 | Agrobacterium ornithine decarboxylase | Plant growth and development | 24-1562 | Agrobacterium tumefaciens |
| 777 | PHE0000601 | 168 | corn IAP-like RING finger protein 1 | Plant growth and development | 179-1291 | Zea mays |
| 778 | PHE0000603 | 170 | corn BAX inhibitor 1-like 1 | Plant growth and development | 157-906 | Zea mays |
| 779 | PHE0000604 | 171 | corn Bax inhibitor 1-like 2 | Plant growth and development | 113-697 | Zea mays |
| 780 | PHE0000605 | 172 | corn Bax inhibitor 1-like 3 | Plant growth and development | 144-890 | Zea mays |
| 781 | PHE0000606 | 173 | corn caspase-like 1 | Plant growth and development | 141-1193 | Zea mays |
| 782 | PHE0000607 | 174 | corn caspase-like 2 | Plant growth and development | 86-1018 | Zea mays |
| 783 | PHE0000608 | 175 | corn caspase-like 3 | Plant growth and development | 74-1141 | Zea mays |
| 784 | PHE0000609 | 176 | yeast YOR197w | Plant growth and development | 186-1547 | Saccharomyces cerevisiae |
| 785 | PHE0000610 | 177 | soy Lls1-like | Plant growth and development | 7-1695 | Glycine max |
| 786 | PHE0000611 | 178 | Synechocystis Rieske iron-sulfur protein | Plant growth and development | 38-1447 | Synechocystis sp. PCC 6803 |
| 787 | PHE0000612 | 179 | Arabidopsis AGL15 | Plant growth and development | 80-892 | Arabidopsis thaliana |
| 788 | PHE0000613 | 180 | yeast OST2 | Plant growth and development | 24-425 | Saccharomyces cerevisiae |
| 789 | PHE0000614 | 181 | corn DAD1 | Plant growth and development | 72-413 | Zea mays |
| 790 | PHE0000615 | 182 | corn pirin | Plant growth and development | 98-1222 | Zea mays |
| 791 | PHE0000616 | 183 | corn betaine-aldehyde dehydrogenase | Stress tolerance | 17-1531 | Zea mays |
| 792 | PHE0000617 | 184 | rice betaine aldehyde dehydrogenase | Stress tolerance | 93-1610 | Oryza sativa |

TABLE 2-continued

| PEP SEQ ID | PHE ID | NUC SEQ ID | Gene Name | Gene Effect | Coding Sequence | Species |
|---|---|---|---|---|---|---|
| 793 | PHE0000618 | 185 | yeast PEM1/CHO2 | Stress tolerance | 617-3226 | Saccharomyces cerevisiae |
| 794 | PHE0000619 | 186 | yeast PEM2/OPI3 | Stress tolerance | 160-780 | Saccharomyces cerevisiae |
| 795 | PHE0000620 | 187 | corn phosphoethanolamine N-methyltransferase 2 | Stress tolerance | 392-1894 | Zea mays |
| 796 | PHE0000621 | 188 | E. coli betT | Stress tolerance | 36-2069 | Escherichia coli |
| 797 | PHE0000622 | 189 | Xenorhabdus BetT-like 1 | Stress tolerance | 29-2068 | Xenorhabdus sp. |
| 798 | PHE0000623 | 190 | corn NHX1-like 1 | Stress tolerance | 38-1675 | Zea mays |
| 799 | PHE0000624 | 191 | OsNHX1-AB021878 | Stress tolerance | 297-1904 | Oryza sativa |
| 800 | PHE0000625 | 192 | corn vacuolar H+-pyrophosphatase 1 | Stress tolerance | 124-2409 | Zea mays |
| 801 | PHE0000626 | 193 | corn vacuolar H+-pyrophosphatase 2 | Stress tolerance | 93-2390 | Zea mays |
| 802 | PHE0000627 | 194 | corn vacuolar H+-pyrophosphatase 5 | Stress tolerance | 35-2329 | Zea mays |
| 803 | PHE0000628 | 195 | soy homeobox-leucine zipper protein homolog h1- | Light response | 66-920 | Glycine max |
| 804 | PHE0000629 | 196 | soy zinc finger protein | Light response | 98-622 | Glycine max |
| 805 | PHE0000630 | 197 | soy TGACG-motif-binding protein STF2 | Light response | 82-1053 | Glycine max |
| 806 | PHE0000631 | 198 | corn putative zinc finger protein | Light response | 225-842 | Zea mays |
| 807 | PHE0000632 | 199 | soy AP2 domain transcription factor | Light response | 227-928 | Glycine max |
| 808 | PHE0000633 | 200 | soy pseudo-response regulator | Light response | 27-2060 | Glycine max |
| 809 | PHE0000634 | 201 | soy CONSTANS-like B-box zinc finger protein | Light response | 108-1229 | Glycine max |
| 810 | PHE0000635 | 202 | soy RPT2-like | Light response | 23-1762 | Glycine max |
| 811 | PHE0000636 | 203 | corn myb-related protein | Light response | 34-1101 | Zea mays |
| 812 | PHE0000637 | 204 | Arabidopsis salt-tolerance protein | Light response | 274-1017 | Arabidopsis thaliana |
| 813 | PHE0000638 | 205 | soy AP2 domain transcription factor | Light response | 98-1555 | Glycine max |
| 814 | PHE0000639 | 206 | soy late elongated hypocotyl | Light response | 626-2875 | Glycine max |
| 815 | PHE0000640 | 207 | soy zinc finger protein | Light response | 139-1416 | Glycine max |
| 816 | PHE0000641 | 208 | soy putative protein kinase | Light response | 73-1764 | Glycine max |
| 817 | PHE0000642 | 209 | soy auxin-responsive GH3 protein | Light response | 42-1820 | Glycine max |
| 818 | PHE0000643 | 210 | corn ripening-related protein | Light response | 131-775 | Zea mays |
| 819 | PHE0000644 | 211 | corn beta-expansin 4 | Light response | 97-1020 | Zea mays |
| 820 | PHE0000645 | 212 | corn hypothetical protein | Light response | 330-716 | Zea mays |
| 821 | PHE0000646 | 213 | corn unknown protein | Light response | 69-710 | Zea mays |
| 822 | PHE0000647 | 214 | corn unknown protein | Light response | 234-563 | Zea mays |
| 823 | PHE0000648 | 215 | corn unknown protein | Light response | 169-1542 | Zea mays |
| 824 | PHE0000649 | 216 | soy unknown protein | Light response | 585-1889 | Glycine max |
| 825 | PHE0000650 | 217 | corn unknown protein | Light response | 211-2514 | Zea mays |
| 826 | PHE0000651 | 218 | rice Lls1 (CAO)-AF284781 | Light response | 100-1722 | Oryza sativa |
| 827 | PHE0000654 | 219 | G896 | Plant growth and development | 47-1147 | Arabidopsis thaliana |
| 828 | PHE0000655 | 220 | G1435 | Plant growth and development | 8-901 | Arabidopsis thaliana |
| 829 | PHE0000656 | 221 | LIB4074-003-H1__FLI-corn G1435-like | Plant growth and development | 83-856 | Zea mays |
| 830 | PHE0000658 | 222 | G1496 | Plant growth and development | 116-1120 | Arabidopsis thaliana |
| 831 | PHE0000660 | 223 | 700072387__FLI-ZmSPS3-1 | Carbon and/or nitrogen metabolism | 89-3265 | Zea mays |
| 832 | PHE0000661 | 224 | GATE90-ZmSPS2-3 | Carbon and/or nitrogen metabolism | 72-2987 | Zea mays |
| 833 | PHE0000662 | 225 | corn ELI17-like protein 1 | Disease resistance | 7-1350 | Zea mays |
| 834 | PHE0000663 | 226 | soy ELI17-like protein 1 | Disease resistance | 63-1355 | Glycine max |

TABLE 2-continued

| PEP SEQ ID | PHE ID | NUC SEQ ID | Gene Name | Gene Effect | Coding Sequence | Species |
|---|---|---|---|---|---|---|
| 835 | PHE0000664 | 227 | X58872-*E. coli* hmp1 | Nitric oxide signaling | 293-1483 | *Escherichia coli* |
| 836 | PHE0000665 | 228 | *Nostoc* sp. PCC 7120 glnB | Carbon and/or nitrogen metabolism | 1074-1412 | *Nostoc* PCC7120 |
| 837 | PHE0000666 | 229 | Brassica P-II | Carbon and/or nitrogen metabolism | 49-639 | *Brassica napus* |
| 838 | PHE0000700 | 230 | *Arabidopsis* eskimo 1 | Stress tolerance | 592-2052 | *Arabidopsis thaliana* |
| 839 | PHE0000701 | 231 | soy 1-deoxy-D-xylulose-5-phosphate reductoisomerase- | Isoprenoid biosynthesis | 76-1500 | *Glycine max* |
| 840 | PHE0000702 | 232 | *Synechocystis* 1-deoxy-D-xylulose-5-phosphate reductoisomerase-D64000 | Isoprenoid biosynthesis | 100-1284 | *Synechocystis* sp. PCC 6803 |
| 841 | PHE0000703 | 233 | *Agrobacterium* 1-deoxy-D-xylulose 5-phosphate reductoisomerase-AAK88334 | Isoprenoid biosynthesis | 52-1245 | *Agrobacterium tumefaciens* |
| 842 | PHE0000704 | 234 | corn 1-deoxy-D-xylulose-5-phosphate synthase- | Isoprenoid biosynthesis | 289-2445 | *Zea mays* |
| 843 | PHE0000705 | 235 | *Agrobacterium* 1-deoxy-D-xylulose-5-phosphate synthase-AAK86554 | Isoprenoid biosynthesis | 13-1932 | *Agrobacterium tumefaciens* |
| 844 | PHE0000706 | 236 | *Xylella* 1-deoxyxylulose-5-phosphate synthase-AAF85048 | Isoprenoid biosynthesis | 38-2050 | *Xylella fastidiosa* |
| 845 | PHE0000709 | 237 | corn HMT 1 (N-methyltransferase) | Stress tolerance | 102-1070 | *Zea mays* |
| 846 | PHE0000710 | 238 | corn HMT 2 (N-methyltransferase) | Stress tolerance | 94-1107 | *Zea mays* |
| 847 | PHE0000711 | 239 | *E. coli* yagD homocysteine S-methyltransferase-Q47690 | Stress tolerance | 21-953 | *Escherichia coli* |
| 848 | PHE0000712 | 240 | yeast Mht1-NP_013038 | Stress tolerance | 60-1034 | *Saccharomyces cerevisiae* |
| 849 | PHE0000713 | 241 | corn H2A.F/Z 1 | DNA integration | 102-515 | *Zea mays* |
| 850 | PHE0000714 | 242 | corn H2A 1 | DNA integration | 56-457 | *Zea mays* |
| 851 | PHE0000715 | 243 | corn H2A 3 | DNA integration | 71-541 | *Zea mays* |
| 852 | PHE0000716 | 244 | corn H2A 7 | DNA integration | 33-512 | *Zea mays* |
| 853 | PHE0000717 | 245 | wilt-1256 | Stress tolerance | 316-1980 | *Zea mays* |
| 854 | PHE0000735 | 246 | corn NAD(P)H quinone oxidoreductase | Stress tolerance | 67-834 | *Zea mays* |
| 855 | PHE0000736 | 247 | rice CBP80-AY017415 | Stress tolerance | 76-2808 | *Oryza sativa* |
| 856 | PHE0000737 | 248 | yeast GCR3-D10224 | Stress tolerance | 908-3484 | *Saccharomyces cerevisiae* |
| 857 | PHE0000738 | 249 | corn CBP20 | Stress tolerance | 8-736 | *Zea mays* |
| 858 | PHE0000739 | 250 | yeast CBC2-Z73534 | Stress tolerance | 2352-2978 | *Saccharomyces cerevisiae* |
| 859 | PHE0000740 | 251 | rice serine decarboxylase-AAG12476 | Stress tolerance | 37-289, 1008-1239, 1601-1794, 1915-2048, 2422-2621, 2796-2943, 3677-3790 | *Oryza sativa* |
| 860 | PHE0000741 | 252 | corn serine decarboxylase | Stress tolerance | 21-1376 | *Zea mays* |
| 861 | PHE0000742 | 253 | soy serine decarboxylase | Stress tolerance | 94-1542 | *Glycine max* |
| 862 | PHE0000743 | 254 | yeast DBF2-P22204 | Plant growth and development | 1-1716 | *Saccharomyces cerevisiae* |
| 863 | PHE0000744 | 255 | yeast DBF20-P32328 | Plant growth and development | 1-1692 | *Saccharomyces cerevisiae* |
| 864 | PHE0000745 | 256 | *Arabidopsis* agl8-Q38876 | Plant growth and development | 1-726 | *Arabidopsis thaliana* |
| 865 | PHE0000746 | 257 | corn AGL8-like B | Plant growth and development | 1-753 | *Zea mays* |
| 866 | PHE0000747 | 258 | corn PHR1-like 1 | Plant growth and development | 150-1496 | *Zea mays* |

TABLE 2-continued

| PEP SEQ ID | PHE ID | NUC SEQ ID | Gene Name | Gene Effect | Coding Sequence | Species |
|---|---|---|---|---|---|---|
| 867 | PHE0000748 | 259 | corn PHR1-like 2 | Plant growth and development | 55-1302 | Zea mays |
| 868 | PHE0000749 | 260 | Nitrosomonas europaea dual function SBPase/FBPase- | Carbon and/or nitrogen metabolism | 94-1095 | Nitrosomonas europaea |
| 869 | PHE0000750 | 261 | rice VP14-like 1 | Stress tolerance | 23-1936 | Oryza sativa |
| 870 | PHE0000751 | 262 | rice VP14-like 2 | Stress tolerance | 220-1947 | Oryza sativa |
| 871 | PHE0000754 | 263 | rice ANT-like | Flower development | 1-1926 | Oryza sativa |
| 872 | PHE0000755 | 264 | Nostoc sp. PCC 7120 GlpX protein | Carbon and/or nitrogen metabolism | 1-1035 | Nostoc PCC7120 |
| 873 | PHE0000756 | 265 | Nostoc punctiforme strain ATCC 29133 GlpX protein-NOS1c0617 | Carbon and/or nitrogen metabolism | 1-1035 | Nostoc punctiforme |
| 874 | PHE0000757 | 266 | Anabaena SPS C154 | Carbon and/or nitrogen metabolism | 1-1275 | Nostoc PCC7120 |
| 875 | PHE0000758 | 267 | Anabaena SPS C287 | Carbon and/or nitrogen metabolism | 1-1266 | Nostoc PCC7120 |
| 876 | PHE0000762 | 268 | G557 (HY5) | Light response | 1-507 | Arabidopsis thaliana |
| 877 | PHE0000763 | 269 | G189 | Plant growth and development | 1-951 | Arabidopsis thaliana |
| 878 | PHE0000764 | 270 | G736 | Plant growth and development | 1-510 | Arabidopsis thaliana |
| 879 | PHE0000766 | 272 | G671 | Plant growth and development | 1-1056 | Arabidopsis thaliana |
| 880 | PHE0000767 | 273 | G247 | Plant growth and development | 1-660 | Arabidopsis thaliana |
| 881 | PHE0000768 | 274 | G1384 | Plant growth and development | 1-942 | Arabidopsis thaliana |
| 882 | PHE0000769 | 275 | G779 | Plant growth and development | 1-594 | Arabidopsis thaliana |
| 883 | PHE0000770 | 276 | G1795 | Plant growth and development | 1-393 | Arabidopsis thaliana |
| 884 | PHE0000771 | 277 | G977 | Plant growth and development | 1-543 | Arabidopsis thaliana |
| 885 | PHE0000772 | 278 | G568 | Plant growth and development | 1-858 | Arabidopsis thaliana |
| 886 | PHE0000773 | 279 | G1269 | Plant growth and development | 1-861 | Arabidopsis thaliana |
| 887 | PHE0000774 | 280 | G1050 | Plant growth and development | 1-1557 | Arabidopsis thaliana |
| 888 | PHE0000779 | 281 | yeast GPA2 | Stress tolerance | 1-1347 | Saccharomyces cerevisiae |
| 889 | PHE0000796 | 282 | phytosulfokine 4-13399211 | Plant growth and development | 67-315 | Oryza sativa |
| 890 | PHE0000797 | 283 | rice phytosulfokine 2-13399209 | Plant growth and development | 107-463 | Oryza sativa |
| 891 | PHE0000798 | 284 | rice phytosulfokine-alpha-11907498 | Plant growth and development | 102-368 | Oryza sativa |
| 892 | PHE0000799 | 285 | rice phytosulphokine SH27A-3201971 | Plant growth and development | 9-314 | Oryza sativa |
| 893 | PHE0000800 | 286 | AtSUC1 | Carbon and/or nitrogen metabolism | 1-1539 | Arabidopsis thaliana |
| 894 | PHE0000801 | 287 | Arabidopsis SUT2 | Carbon and/or nitrogen metabolism | 1-1773 | Arabidopsis thaliana |
| 895 | PHE0000802 | 288 | Arabidopsis SUT4 | Carbon and/or nitrogen metabolism | 1-1530 | Arabidopsis thaliana |
| 896 | PHE0000803 | 289 | OsSUT1-D87819 | Carbon and/or nitrogen metabolism | 67-1680 | Oryza sativa |
| 897 | PHE0000804 | 290 | OsSUT3-AB071809 | Carbon and/or nitrogen metabolism | 85-1605 | Oryza sativa |
| 898 | PHE0000805 | 291 | Aspergillis phytochrome | Light response | 1-2013 | Emericella nidulans |
| 899 | PHE0000806 | 292 | corn histidine phosphotransfer protein 1 | Plant growth and development | 103-561 | Zea mays |

TABLE 2-continued

| PEP SEQ ID | PHE ID | NUC SEQ ID | Gene Name | Gene Effect | Coding Sequence | Species |
|---|---|---|---|---|---|---|
| 900 | PHE0000807 | 293 | corn histidine phosphotransfer protein 2 | Plant growth and development | 57-512 | *Zea mays* |
| 901 | PHE0000808 | 294 | soy histidine phosphotransfer protein 1 | Plant growth and development | 63-527 | *Glycine max* |
| 902 | PHE0000809 | 295 | YPD1-Z74283 | Plant growth and development | 320-823 | *Saccharomyces cerevisiae* |
| 903 | PHE0000810 | 296 | rice ethylene receptor-AF013979 | Plant growth and development | 66-1976 | *Oryza sativa* |
| 904 | PHE0000811 | 297 | rice ethylene responsive factor-AAK70909 | Plant growth and development | 9-917, 1160-1528, 1646-1912, 2188-2312, 2425-2662 | *Oryza sativa* |
| 905 | PHE0000812 | 298 | CYP79F1 (supershoot)-AF370512 | Plant growth and development | 75-1688 | *Arabidopsis thaliana* |
| 906 | PHE0000813 | 299 | AtSUC2 | Carbon and/or nitrogen metabolism | 1-1536 | *Arabidopsis thaliana* |
| 907 | PHE0000814 | 300 | soy G28 like | Stress tolerance | 1-753 | *Glycine max* |
| 908 | PHE0000815 | 301 | corn G1792-like 2 | Stress tolerance | 104-661 | *Zea mays* |
| 909 | PHE0000816 | 302 | G1792 | Stress tolerance | 77-493 | *Arabidopsis thaliana* |
| 910 | PHE0000817 | 303 | corn duf6 2 | Carbon and/or nitrogen metabolism | 54-1394 | *Zea mays* |
| 911 | PHE0000818 | 304 | corn duf6 3 | Carbon and/or nitrogen metabolism | 30-1112 | *Zea mays* |
| 912 | PHE0000819 | 305 | corn duf6 | Carbon and/or nitrogen metabolism | 62-1324 | *Zea mays* |
| 913 | PHE0000820 | 306 | corn duf6 6 | Carbon and/or nitrogen metabolism | 174-1271 | *Zea mays* |
| 914 | PHE0000822 | 307 | corn duf6 11 | Carbon and/or nitrogen metabolism | 5-1072 | *Zea mays* |
| 915 | PHE0000823 | 308 | corn duf6 12 | Carbon and/or nitrogen metabolism | 113-1261 | *Zea mays* |
| 916 | PHE0000824 | 309 | corn duf6 13 | Carbon and/or nitrogen metabolism | 48-1127 | *Zea mays* |
| 917 | PHE0000825 | 310 | corn duf6 14 | Carbon and/or nitrogen metabolism | 112-1290 | *Zea mays* |
| 918 | PHE0000826 | 311 | corn duf6 15 | Carbon and/or nitrogen metabolism | 197-1327 | *Zea mays* |
| 919 | PHE0000827 | 312 | corn duf6 16 | Carbon and/or nitrogen metabolism | 111-1142 | *Zea mays* |
| 920 | PHE0000828 | 313 | corn duf6 17 | Carbon and/or nitrogen metabolism | 6-1097 | *Zea mays* |
| 921 | PHE0000829 | 314 | corn duf6 18 | Carbon and/or nitrogen metabolism | 149-1375 | *Zea mays* |
| 922 | PHE0000830 | 315 | corn duf6 19 | Carbon and/or nitrogen metabolism | 153-1193 | *Zea mays* |
| 923 | PHE0000831 | 316 | corn duf6 20 | Carbon and/or nitrogen metabolism | 145-1641 | *Zea mays* |
| 924 | PHE0000832 | 317 | soy duf6 1 | Carbon and/or nitrogen metabolism | 52-1170 | *Glycine max* |
| 925 | PHE0000833 | 318 | soy duf6 2 | Carbon and/or nitrogen metabolism | 151-1203 | *Glycine max* |
| 926 | PHE0000834 | 319 | soy duf6 3 | Carbon and/or nitrogen metabolism | 36-1073 | *Glycine max* |
| 927 | PHE0000835 | 320 | soy duf6 4 | Carbon and/or nitrogen metabolism | 69-1118 | *Glycine max* |

TABLE 2-continued

| PEP SEQ ID | PHE ID | NUC SEQ ID | Gene Name | Gene Effect | Coding Sequence | Species |
|---|---|---|---|---|---|---|
| 928 | PHE0000836 | 321 | soy duf6 5 | Carbon and/or nitrogen metabolism | 55-1140 | *Glycine max* |
| 929 | PHE0000837 | 322 | soy duf6 6 | Carbon and/or nitrogen metabolism | 36-1271 | *Glycine max* |
| 930 | PHE0000838 | 323 | soy duf6 7 | Carbon and/or nitrogen metabolism | 228-1226 | *Glycine max* |
| 931 | PHE0000839 | 324 | soy duf6 8 | Carbon and/or nitrogen metabolism | 140-1126 | *Glycine max* |
| 932 | PHE0000840 | 325 | soy duf6 9 | Carbon and/or nitrogen metabolism | 61-1173 | *Glycine max* |
| 933 | PHE0000841 | 326 | soy duf6 10 | Carbon and/or nitrogen metabolism | 99-1265 | *Glycine max* |
| 934 | PHE0000842 | 327 | soy duf6 11 | Carbon and/or nitrogen metabolism | 167-1084 | *Glycine max* |
| 935 | PHE0000843 | 328 | soy duf6 12 | Carbon and/or nitrogen metabolism | 158-1258 | *Glycine max* |
| 936 | PHE0000844 | 329 | soy duf6 13 | Carbon and/or nitrogen metabolism | 250-1284 | *Glycine max* |
| 937 | PHE0000845 | 330 | soy duf6 15 | Carbon and/or nitrogen metabolism | 96-1157 | *Glycine max* |
| 938 | PHE0000846 | 331 | rice Crinkly4-AB057787 | Seed development | 805-3510 | *Oryza sativa* |
| 939 | PHE0000847 | 332 | rice S-domain receptor-like protein kinase 1-BAA94516 | Seed development | 89-2395 | *Oryza sativa* |
| 940 | PHE0000848 | 333 | rice S-domain receptor-like protein kinase 2-BAB07906.1 | Seed development | 89-2437 | *Oryza sativa* |
| 941 | PHE0000849 | 334 | rice S-domain receptor-like protein kinase 3-BAB07905.1 | Seed development | 98-2539 | *Oryza sativa* |
| 942 | PHE0000850 | 335 | rice S-domain receptor-like protein kinase 4-BAB07904.1 | Seed development | 72-2321 | *Oryza sativa* |
| 943 | PHE0000851 | 336 | rice S-domain receptor-like protein kinase 5 | Seed development | 28-44, 145-173, 272-397, 1180-3476 | *Oryza sativa* |
| 944 | PHE0000852 | 337 | rice S-receptor kinase PK3-BAB64641.1 | Seed development | 67-2562 | *Oryza sativa* |
| 945 | PHE0000853 | 338 | OsPK10-L27821 | Seed development | 1-2475 | *Oryza sativa* |
| 946 | PHE0000854 | 339 | soy 14-3-3 22 | Stress tolerance | 32-802 | *Glycine max* |
| 947 | PHE0000855 | 340 | soy 14-3-3 22 N-terminus | Stress tolerance | 32-382 | *Glycine max* |
| 948 | PHE0000856 | 341 | 14-3-3-like protein N-terminus | Stress tolerance | 6-365 | *Oryza sativa* |
| 949 | PHE0000857 | 342 | *sorghum* 14-3-3 10 | Stress tolerance | 116-874 | *Sorghum bicolor* |
| 950 | PHE0000858 | 343 | *sorghum* 14-3-3 10 N-terminus | Stress tolerance | 116-460 | *Sorghum bicolor* |
| 951 | PHE0000859 | 344 | rice 14-3-3 15 | Stress tolerance | 70-855 | *Oryza sativa* |
| 952 | PHE0000860 | 345 | rice 14-3-3 15 N-terminus | Stress tolerance | 70-429 | *Oryza sativa* |
| 953 | PHE0000861 | 346 | corn 14-3-3 13 | Stress tolerance | 62-808 | *Zea mays* |
| 954 | PHE0000862 | 347 | corn 14-3-3 13 N-terminus | Stress tolerance | 62-409 | *Zea mays* |
| 955 | PHE0000863 | 348 | 14-3-3 protein N-terminus | Stress tolerance | 42-389 | *Glycine max* |
| 956 | PHE0000864 | 349 | rice 14-3-3 10 | Stress tolerance | 105-875 | *Oryza sativa* |
| 957 | PHE0000865 | 350 | rice 14-3-3 10 N-terminus | Stress tolerance | 105-449 | *Oryza sativa* |
| 958 | PHE0000866 | 351 | soy 14-3-3 21 | Stress tolerance | 84-860 | *Glycine max* |
| 959 | PHE0000867 | 352 | soy 14-3-3 21 N-terminus | Stress tolerance | 84-443 | *Glycine max* |
| 960 | PHE0000868 | 353 | wheat 14-3-3 10 | Stress tolerance | 64-840 | *Triticum aestivum* |
| 961 | PHE0000869 | 354 | wheat 14-3-3 10 N-terminus | Stress tolerance | 64-420 | *Triticum aestivum* |

TABLE 2-continued

| PEP SEQ ID | PHE ID | NUC SEQ ID | Gene Name | Gene Effect | Coding Sequence | Species |
|---|---|---|---|---|---|---|
| 962 | PHE0000870 | 355 | corn 14-3-3 17 | Stress tolerance | 132-929 | Zea mays |
| 963 | PHE0000871 | 356 | corn 14-3-3 17 N-terminus | Stress tolerance | 132-506 | Zea mays |
| 964 | PHE0000872 | 357 | rice G alpha XL-BAA93022 | Plant growth and development | 48-1040, 1127-1264, 2100-2204, 2500-2682, 3113-3290, 3374-3618, 3937-4109, 4430-4627, 4988-5378 | Oryza sativa |
| 965 | PHE0000873 | 358 | yeast casein kinase II alpha-CAA86916 | Flower development | 2-1120 | Saccharomyces cerevisiae |
| 966 | PHE0000874 | 359 | rice casein kinase alpha subunit-AAL34126 | Flower development | 29-363, 471-600, 1034-1228, 2564-2721, 3082-3172, 3250-3315, 3657-3739, 3821-3884, 3967-4035, 4124-4159 | Oryza sativa |
| 967 | PHE0000875 | 360 | soy casein kinase alpha | Flower development | 129-1127 | Glycine max |
| 968 | PHE0000876 | 361 | rice casein kinase II beta subunit-AAG60201 | Flower development | 52-262, 2992-3213, 3477-3586, 3679-3844, 4365-4498 | Oryza sativa |
| 969 | PHE0000877 | 362 | yeast CKB1-Z72541 | Flower development | 286-1122 | Saccharomyces cerevisiae |
| 970 | PHE0000878 | 363 | corn casein kinase beta 1 | Flower development | 231-1055 | Zea mays |
| 971 | PHE0000879 | 364 | corn casein kinase beta 2 | Flower development | 178-993 | Zea mays |
| 972 | PHE0000884 | 365 | CAR1-like 1 | Stress tolerance | 82-546 | Zea mays |
| 973 | PHE0000885 | 366 | corn CAR1-like 3 | Stress tolerance | 161-775 | Zea mays |
| 974 | PHE0000886 | 367 | corn CAR1-like 4 | Stress tolerance | 192-659 | Zea mays |
| 975 | PHE0000887 | 368 | corn CAR1-like 5 | Stress tolerance | 86-484 | Zea mays |
| 976 | PHE0000888 | 369 | yeast hnRNP methyltransferase-CAA53689 | Stress tolerance | 76-1122 | Saccharomyces cerevisiae |
| 977 | PHE0000889 | 370 | corn arginine N-methyl transferase 1 | Stress tolerance | 44-1318 | Zea mays |
| 978 | PHE0000890 | 371 | corn arginine N-methyl transferase 2 | Stress tolerance | 102-1232 | Zea mays |
| 979 | PHE0000891 | 372 | CAR1-corn ABA inducible RNA-binding protein | Stress tolerance | 68-538 | Zea mays |
| 980 | PHE0000892 | 373 | corn RING finger 100 | Plant growth and development | 292-1404 | Zea mays |
| 981 | PHE0000893 | 374 | corn RING finger 101 | Plant growth and development | 103-1077 | Zea mays |
| 982 | PHE0000894 | 375 | corn RING finger 103 | Plant growth and development | 20-1093 | Zea mays |
| 983 | PHE0000895 | 376 | corn RING finger 102 | Plant growth and development | 252-1295 | Zea mays |
| 984 | PHE0000896 | 377 | corn RING finger 104 | Plant growth and development | 293-925 | Zea mays |
| 985 | PHE0000897 | 378 | corn RING finger 105 | Plant growth and development | 95-934 | Zea mays |
| 986 | PHE0000898 | 379 | corn RING finger 106 | Plant growth and development | 99-563 | Zea mays |
| 987 | PHE0000899 | 380 | corn RING finger 108 | Plant growth and development | 308-1054 | Zea mays |
| 988 | PHE0000900 | 381 | corn RING finger 109 | Plant growth and development | 71-622 | Zea mays |
| 989 | PHE0000901 | 382 | corn RING finger 110 [ReMembR-H2 protein JR702]- | Plant growth and development | 215-1756 | Zea mays |
| 990 | PHE0000902 | 383 | corn RING finger 111 | Plant growth and development | 162-599 | Zea mays |
| 991 | PHE0000903 | 384 | corn RING finger 112 | Plant growth and development | 411-2375 | Zea mays |
| 992 | PHE0000904 | 385 | corn RING finger 113 | Plant growth and development | 269-1828 | Zea mays |
| 993 | PHE0000905 | 386 | corn RING finger 114 | Plant growth and development | 167-781 | Zea mays |
| 994 | PHE0000906 | 387 | corn RING finger 115 | Plant growth and development | 294-806 | Zea mays |
| 995 | PHE0000907 | 388 | corn RING finger 116 | Plant growth and development | 187-1374 | Zea mays |
| 996 | PHE0000908 | 389 | corn Skp1-like 118 [UIP2] | Plant growth and development | 94-597 | Zea mays |

TABLE 2-continued

| PEP SEQ ID | PHE ID | NUC SEQ ID | Gene Name | Gene Effect | Coding Sequence | Species |
|---|---|---|---|---|---|---|
| 997 | PHE0000909 | 390 | corn Skp1-like 119 | Plant growth and development | 158-1159 | Zea mays |
| 998 | PHE0000910 | 391 | corn Skp1-like 120 [UIP2] | Plant growth and development | 106-633 | Zea mays |
| 999 | PHE0000911 | 392 | corn F-box 123 | Plant growth and development | 184-1980 | Zea mays |
| 1000 | PHE0000912 | 393 | corn F-box 124 [TIR1] | Plant growth and development | 167-1936 | Zea mays |
| 1001 | PHE0000913 | 394 | corn F-box 125 [TIR1] | Plant growth and development | 174-1892 | Zea mays |
| 1002 | PHE0000914 | 395 | corn F-box 126 | Plant growth and development | 107-1894 | Zea mays |
| 1003 | PHE0000915 | 396 | corn RING finger 128 [response regulator 6] | Plant growth and development | 42-746 | Zea mays |
| 1004 | PHE0000916 | 397 | corn RING finger 132 | Plant growth and development | 107-985 | Zea mays |
| 1005 | PHE0000917 | 398 | corn RING finger 133 | Plant growth and development | 597-1496 | Zea mays |
| 1006 | PHE0000918 | 399 | corn ASH1 | Stress tolerance | 144-899 | Zea mays |
| 1007 | PHE0000919 | 400 | corn RING finger 136 | Plant growth and development | 95-1012 | Zea mays |
| 1008 | PHE0000920 | 401 | corn RING finger 138 | Plant growth and development | 117-902 | Zea mays |
| 1009 | PHE0000921 | 402 | corn F-box 141 | Plant growth and development | 487-1428 | Zea mays |
| 1010 | PHE0000922 | 403 | corn F-box 142 | Plant growth and development | 227-1114 | Zea mays |
| 1011 | PHE0000923 | 404 | corn F-box 143 | Plant growth and development | 352-1410 | Zea mays |
| 1012 | PHE0000924 | 405 | corn F-box 144 | Plant growth and development | 96-1406 | Zea mays |
| 1013 | PHE0000925 | 406 | corn F-box 145 | Plant growth and development | 436-1524 | Zea mays |
| 1014 | PHE0000926 | 407 | corn RING finger 147 | Plant growth and development | 79-927 | Zea mays |
| 1015 | PHE0000927 | 408 | corn RING finger 149 [anaphase promoting complex subunit 11]- | Plant growth and development | 128-379 | Zea mays |
| 1016 | PHE0000928 | 409 | corn RING finger 151 [ROC1] | Plant growth and development | 77-442 | Zea mays |
| 1017 | PHE0000929 | 410 | corn U-box 153 | Plant growth and development | 166-1743 | Zea mays |
| 1018 | PHE0000930 | 411 | corn RING finger 154 [VIP2] | Plant growth and development | 262-1560 | Zea mays |
| 1019 | PHE0000931 | 412 | corn RING finger 155 [VIP2] | Plant growth and development | 161-1498 | Zea mays |
| 1020 | PHE0000932 | 413 | rice U-box 100 | Plant growth and development | 121-939 | Oryza sativa |
| 1021 | PHE0000933 | 414 | corn RING finger protein 157 | Plant growth and development | 168-857 | Zea mays |
| 1022 | PHE0000934 | 415 | corn F-box 159 [FKF1-like] | Plant growth and development | 195-2021 | Zea mays |
| 1023 | PHE0000935 | 416 | corn F-box 160 [FKF-like] | Plant growth and development | 77-1930 | Zea mays |
| 1024 | PHE0000936 | 417 | corn RING finger 161 [cellulose synthase] | Plant growth and development | 78-3026 | Zea mays |
| 1025 | PHE0000937 | 418 | corn RING finger 162 [cellulose synthase] | Plant growth and development | 193-3414 | Zea mays |
| 1026 | PHE0000938 | 419 | corn RING finger 163 | Plant growth and development | 277-1059 | Zea mays |
| 1027 | PHE0000939 | 420 | corn RING finger 164 | Plant growth and development | 218-1033 | Zea mays |
| 1028 | PHE0000940 | 421 | corn RING finger 165 | Plant growth and development | 167-754 | Zea mays |
| 1029 | PHE0000941 | 422 | corn F-box 166 | Plant growth and development | 62-814 | Zea mays |
| 1030 | PHE0000942 | 423 | corn RING finger 167 [seven in absentia-like] | Plant growth and development | 266-1288 | Zea mays |
| 1031 | PHE0000943 | 424 | corn F-box 168 | Plant growth and development | 203-1402 | Zea mays |
| 1032 | PHE0000944 | 425 | corn RING finger 169 [S-ribonuclease binding protein] | Plant growth and development | 103-1113 | Zea mays |
| 1033 | PHE0000945 | 426 | corn F-box 170 | Plant growth and development | 123-1184 | Zea mays |

TABLE 2-continued

| PEP SEQ ID | PHE ID | NUC SEQ ID | Gene Name | Gene Effect | Coding Sequence | Species |
|---|---|---|---|---|---|---|
| 1034 | PHE0000946 | 427 | corn F-box 172 | Plant growth and development | 42-803 | Zea mays |
| 1035 | PHE0000947 | 428 | corn RING finger 174 | Plant growth and development | 255-1280 | Zea mays |
| 1036 | PHE0000948 | 429 | corn RING 175 | Plant growth and development | 179-1291 | Zea mays |
| 1037 | PHE0000949 | 430 | corn Cullin 176 | Plant growth and development | 221-931 | Zea mays |
| 1038 | PHE0000950 | 431 | corn RING finger 177 | Plant growth and development | 33-863 | Zea mays |
| 1039 | PHE0000951 | 432 | corn RING finger 178 | Plant growth and development | 227-1492 | Zea mays |
| 1040 | PHE0000952 | 433 | corn RING finger 179 [alpha-galactosidase] | Plant growth and development | 68-1342 | Zea mays |
| 1041 | PHE0000953 | 434 | corn RING finger 180 | Plant growth and development | 265-1431 | Zea mays |
| 1042 | PHE0000954 | 435 | corn F-box 181 | Plant growth and development | 354-1397 | Zea mays |
| 1043 | PHE0000955 | 436 | corn RING finger 182 | Plant growth and development | 113-1282 | Zea mays |
| 1044 | PHE0000956 | 437 | corn RING finger 183 | Plant growth and development | 293-997 | Zea mays |
| 1045 | PHE0000957 | 438 | corn RING finger 185 | Plant growth and development | 104-829 | Zea mays |
| 1046 | PHE0000958 | 439 | corn F-box 186 | Plant growth and development | 47-1303 | Zea mays |
| 1047 | PHE0000959 | 440 | corn F-box 187 | Plant growth and development | 195-1199 | Zea mays |
| 1048 | PHE0000960 | 441 | corn RING/U-box 188 | Plant growth and development | 63-1142 | Zea mays |
| 1049 | PHE0000961 | 442 | corn SPS2-4 | Carbon and/or nitrogen metabolism | 105-3035 | Zea mays |
| 1050 | PHE0000962 | 443 | rice IRE1-AB031396 | Seed development | 239-2920 | Oryza sativa |
| 1051 | PHE0000963 | 444 | rice IRE1 N-terminal domain-AB031396 | Seed development | 239-1483 | Oryza sativa |
| 1052 | PHE0000964 | 445 | rice IRE1 C-terminal domain-AB031396 | Seed development | 1481-2920 | Oryza sativa |
| 1053 | PHE0000965 | 446 | yeast IRE1-P32361 | Seed development | 80-3427 | Saccharomyces cerevisiae |
| 1054 | PHE0000966 | 447 | yeast IRE1 N-terminal domain-P32361 | Seed development | 80-1798 | Saccharomyces cerevisiae |
| 1055 | PHE0000967 | 448 | yeast IRE1 C-terminal domain-P32361 | Seed development | 1799-3427 | Saccharomyces cerevisiae |
| 1056 | PHE0000968 | 449 | corn cytosine deaminase-like | Seed development | 80-1339 | Zea mays |
| 1057 | PHE0000969 | 450 | corn aldose reductase | Seed development | 106-1041 | Zea mays |
| 1058 | PHE0000970 | 451 | soy NADPH dependent mannose 6-phosphate reductase- | Seed development | 32-958 | Glycine max |
| 1059 | PHE0000972 | 453 | yeast Ydr210w-NP_010496 | Seed development | 101-325 | Saccharomyces cerevisiae |
| 1060 | PHE0000974 | 455 | yeast Soh1-NP_011388 | Seed development | 101-481 | Saccharomyces cerevisiae |
| 1061 | PHE0000975 | 456 | yeast TAD2-NP_012499 | Seed development | 101-850 | Saccharomyces cerevisiae |
| 1062 | PHE0000978 | 459 | yeast Ynl010w-NP_014388 | Seed development | 101-823 | Saccharomyces cerevisiae |
| 1063 | PHE0000979 | 460 | yeast Ynl124w-NP_014275 | Seed development | 101-1576 | Saccharomyces cerevisiae |
| 1064 | PHE0000980 | 461 | yeast Ydl124w-NP_010159 | Seed development | 101-1036 | Saccharomyces cerevisiae |
| 1065 | PHE0000984 | 465 | yeast Glutaredoxin-NP_009895 | Seed development | 101-430 | Saccharomyces cerevisiae |
| 1066 | PHE0000985 | 466 | soy unknown protein | Seed development | 228-1226 | Saccharomyces cerevisiae |
| 1067 | PHE0000986 | 467 | soy putative protein | Seed development | 265-1002 | Glycine max |
| 1068 | PHE0000987 | 468 | corn CLC1 | Stress tolerance | 102-599 | Zea mays |
| 1069 | PHE0000988 | 469 | corn CLD1 | Stress tolerance | 69-461 | Zea mays |
| 1070 | PHE0000989 | 470 | rice Asr1-AF039573 | Stress tolerance | 71-487 | Oryza sativa |
| 1071 | PHE0000990 | 471 | rice CLC1-like 1-BAB19059 | Stress tolerance | 37-326, 451-703 | Oryza sativa |
| 1072 | PHE0000991 | 472 | corn Asr1-like 1 | Stress tolerance | 151-690 | Zea mays |

TABLE 2-continued

| PEP SEQ ID | PHE ID | NUC SEQ ID | Gene Name | Gene Effect | Coding Sequence | Species |
|---|---|---|---|---|---|---|
| 1073 | PHE0000992 | 473 | corn Asr1-like 5 | Stress tolerance | 89-511 | *Zea mays* |
| 1074 | PHE0000993 | 474 | corn sigma factor 1 | Plant growth and development | 219-1715 | *Zea mays* |
| 1075 | PHE0000994 | 475 | corn sigma factor 2 [Sig3] | Plant growth and development | 166-1815 | *Zea mays* |
| 1076 | PHE0000995 | 476 | corn sigma factor 3 [Sig1] | Plant growth and development | 101-1717 | *Zea mays* |
| 1077 | PHE0000996 | 477 | corn bromodomain protein | Seed development | 417-2147 | *Zea mays* |
| 1078 | PHE0000997 | 478 | corn homeodomain leucine zipper protein | Seed development | 292-1269 | *Zea mays* |
| 1079 | PHE0000998 | 479 | corn bZIP protein 3 | Seed development | 63-908 | *Zea mays* |
| 1080 | PHE0000999 | 480 | corn bZIP protein 4 [G-box binding factor 1] | Seed development | 95-1225 | *Zea mays* |
| 1081 | PHE0001000 | 481 | corn remorin like DNA-binding protein 1 | Seed development | 84-1637 | *Zea mays* |
| 1082 | PHE0001001 | 482 | corn remorin like DNA-binding protein 2 | Seed development | 43-639 | *Zea mays* |
| 1083 | PHE0001002 | 483 | corn Gld-Tea protein 2 | Seed development | 47-811 | *Zea mays* |
| 1084 | PHE0001003 | 484 | corn homeobox protein 1 | Seed development | 370-1179 | *Zea mays* |
| 1085 | PHE0001004 | 485 | corn homeobox protein 3 | Seed development | 485-1300 | *Zea mays* |
| 1086 | PHE0001005 | 486 | corn heat shock transcription factor 1 | Seed development | 75-875 | *Zea mays* |
| 1087 | PHE0001006 | 487 | corn heat shock transcription factor 2 | Seed development | 895-1575 | *Zea mays* |
| 1088 | PHE0001007 | 488 | corn heat shock transcription factor 3 | Seed development | 195-965 | *Zea mays* |
| 1089 | PHE0001008 | 489 | corn heat shock transcription factor 4 | Seed development | 383-1276 | *Zea mays* |
| 1090 | PHE0001009 | 490 | corn IAA-like 1 | Seed development | 65-724 | *Zea mays* |
| 1091 | PHE0001010 | 491 | corn IAA-like 4 | Seed development | 762-1448 | *Zea mays* |
| 1092 | PHE0001011 | 492 | corn MADS box protein 100 | Seed development | 114-286, 383-819 | *Zea mays* |
| 1093 | PHE0001012 | 493 | corn MADS box protein 102 | Seed development | 293-1027 | *Zea mays* |
| 1094 | PHE0001013 | 494 | corn MADS box protein 103 | Seed development | 63-731 | *Zea mays* |
| 1095 | PHE0001014 | 495 | corn MADS box protein 104 | Seed development | 213-890 | *Zea mays* |
| 1096 | PHE0001015 | 496 | corn MADS box protein 105 | Seed development | 101-853 | *Zea mays* |
| 1097 | PHE0001016 | 497 | corn MADS box protein 108 | Seed development | 115-741 | *Zea mays* |
| 1098 | PHE0001018 | 498 | corn MADS box protein 114 | Seed development | 246-980 | *Zea mays* |
| 1099 | PHE0001019 | 499 | corn LIM domain protein 1 | Seed development | 99-1160 | *Zea mays* |
| 1100 | PHE0001020 | 500 | corn LIM domain protein 2 | Seed development | 171-782 | *Zea mays* |
| 1101 | PHE0001021 | 501 | corn myb-like DNA binding protein | Seed development | 248-1105 | *Zea mays* |
| 1102 | PHE0001022 | 502 | corn myb domain protein 1 | Seed development | 112-945 | *Zea mays* |
| 1103 | PHE0001023 | 503 | corn myb domain protein 3 | Seed development | 125-1030 | *Zea mays* |
| 1104 | PHE0001024 | 504 | corn myb domain protein 4 | Seed development | 34-1101 | *Zea mays* |
| 1105 | PHE0001025 | 505 | corn NAM-like protein | Seed development | 139-1563 | *Zea mays* |
| 1106 | PHE0001026 | 506 | corn transcriptional co-activator-like protein 1 | Seed development | 165-686 | *Zea mays* |
| 1107 | PHE0001027 | 507 | corn LSD1-like protein 1 | Seed development | 222-650 | *Zea mays* |
| 1108 | PHE0001028 | 508 | corn GS1-like protein | Seed development | 84-806 | *Zea mays* |
| 1109 | PHE0001029 | 509 | corn RING finger 200 | Seed development | 268-1470 | *Zea mays* |
| 1110 | PHE0001030 | 510 | corn RING finger protein 202 | Seed development | 187-1158 | *Zea mays* |

TABLE 2-continued

| PEP SEQ ID | PHE ID | NUC SEQ ID | Gene Name | Gene Effect | Coding Sequence | Species |
|---|---|---|---|---|---|---|
| 1111 | PHE0001031 | 511 | corn PGPD14-like protein | Seed development | 107-985 | Zea mays |
| 1112 | PHE0001032 | 512 | corn Ankyrin protein 1 | Seed development | 440-1891 | Zea mays |
| 1113 | PHE0001033 | 513 | corn zinc finger protein 10 [corn G325-like 3] | Seed development | 424-1644 | Zea mays |
| 1114 | PHE0001034 | 514 | corn scarecrow protein 100 | Seed development | 242-1903 | Zea mays |
| 1115 | PHE0001035 | 515 | corn transcription elongation factor | Seed development | 131-1234 | Zea mays |
| 1116 | PHE0001036 | 516 | corn constans-like protein 10 | Seed development | 128-904 | Zea mays |
| 1117 | PHE0001037 | 517 | corn copine-like protein 1 | Seed development | 518-1861 | Zea mays |
| 1118 | PHE0001038 | 518 | corn copine-like protein 2 | Seed development | 281-1513 | Zea mays |
| 1119 | PHE0001039 | 519 | corn RING finger protein 201 | Seed development | 311-1579 | Zea mays |
| 1120 | PHE0001040 | 520 | corn zinc finger protein | Seed development | 65-1138 | Zea mays |
| 1121 | PHE0001041 | 521 | corn IAA-like 10 | Seed development | 146-823 | Zea mays |
| 1122 | PHE0001042 | 522 | corn constans-like 5 | Seed development | 215-829 | Zea mays |
| 1123 | PHE0001043 | 523 | soy G-gamma subunit DC-terminus | Plant growth and development | 210-518 | Glycine max |
| 1124 | PHE0001044 | 524 | soy AGL8-like 1 | Plant growth and development | 346-1077 | Glycine max |
| 1125 | PHE0001045 | 525 | soy AGL8-like 3 | Plant growth and development | 147-863 | Glycine max |
| 1126 | PHE0001046 | 526 | corn Agl8D (LIB5131-001-H1) | Plant growth and development | 1-735 | Zea mays |
| 1127 | PHE0001047 | 527 | corn Agl8E (LIB5131-001-H2) | Plant growth and development | 1-798 | Zea mays |
| 1128 | PHE0001048 | 528 | corn Agl8F (LIB5131-001-H3) | Plant growth and development | 1-798 | Zea mays |
| 1129 | PHE0001050 | 529 | Arabidopsis LFY | Flower development | 40-1311 | Arabidopsis thaliana |
| 1130 | PHE0001103 | 530 | corn Isr | Plant growth and development | 220-1254 | Zea mays |
| 1131 | PHE0001104 | 531 | soy Isr-like 1 | Plant growth and development | 365-1495 | Glycine max |
| 1132 | PHE0001105 | 532 | rice Isr-like 1 | Plant growth and development | 110-1159 | Oryza sativa |
| 1133 | PHE0001160 | 533 | soy G1792-like | Stress tolerance | 20-391 | Glycine max |
| 1134 | PHE0001161 | 534 | corn sucrose export defective 1 (sdx1)-AF302187 | Carbon and/or nitrogen metabolism | 1-1425 | Zea mays |
| 1135 | PHE0001162 | 535 | rice sdx1 delta ctp | Carbon and/or nitrogen metabolism | 345-409, 581-692, 710-827, 2019-2098, 3567-3646, 5059-5228, 5675-5772, 6541-6645, 7487-7603, 7908-8057, 9155-9328 | Oryza sativa |
| 1136 | PHE0001163 | 536 | Arabidopsis sucrose export defective 1-AF302188 | Carbon and/or nitrogen metabolism | 1-1467 | Arabidopsis thaliana |
| 1137 | PHE0001164 | 537 | Nostoc sp. PCC 7120 sdx1-like-17134979 | Carbon and/or nitrogen metabolism | 1-1092 | Nostoc PCC7120 |
| 1138 | PHE0001165 | 538 | Synechocystis sp. PCC 6803 sdx1-like-1652844 | Carbon and/or nitrogen metabolism | 1-1092 | Synechocystis sp. PCC 6803 |
| 1139 | PHE0001166 | 539 | Nostoc punctiforme sdx1-like | Carbon and/or nitrogen metabolism | 294-1388 | Nostoc punctiforme |
| 1140 | PHE0001173 | 540 | corn CVY-CIK | Stress tolerance | 217-1563 | Zea mays |
| 1141 | PHE0001187 | 541 | corn spa1-like | Light response | 104-2467 | Zea mays |
| 1142 | PHE0001188 | 542 | corn calcium dependant protein kinase | Stress tolerance | 649-2424 | Zea mays |
| 1143 | PHE0001189 | 543 | corn unknown protein | Stress tolerance | 127-813 | Zea mays |
| 1144 | PHE0001190 | 544 | corn putative splicing factor | Stress tolerance | 153-671 | Zea mays |
| 1145 | PHE0001191 | 545 | rice hydroxyproline-rich glycoprotein | Stress tolerance | 120-1769 | Oryza sativa |

TABLE 2-continued

| PEP SEQ ID | PHE ID | NUC SEQ ID | Gene Name | Gene Effect | Coding Sequence | Species |
|---|---|---|---|---|---|---|
| 1146 | PHE0001192 | 546 | rice unknown protein-AAK14418 | Stress tolerance | 605-719, 800-864, 1161-1503, 1666-1732, 1833-1986, 2283-2450, 2553-2663, 2773-2883, 3025-3042, 3078-3179, 3748-3978, 4551-4625, 4905-4976, 5758-5943, 6029-6187, 6412-6504, 6891-6962, 7497-7587, 7830-8008, 8413-8494, 8687-8797, 8876-8982, 9355-9432, 9518-9613, 9788-9883, 11533-11700 | *Oryza sativa* |
| 1147 | PHE0001193 | 547 | corn unknown protein | Stress tolerance | 87-1147, 1229-1919 | *Zea mays* |
| 1148 | PHE0001194 | 548 | corn alpha-amylase | Stress tolerance | 553-1797 | *Zea mays* |
| 1149 | PHE0001233 | 549 | rice G1073-like 1 | Plant growth and development | 1-1008 | *Oryza sativa* |
| 1150 | PHE0001234 | 550 | rice inosine monophosphate dehydrogenase-AAK09225 | Plant growth and development | 45-1040, 2559-2738, 3841-4098, 4927-4998 | *Oryza sativa* |
| 1151 | PHE0001235 | 551 | yeast IMP dehydrogenase [Imd2p]-NP_012088 | Plant growth and development | 101-1669 | *Saccharomyces cerevisiae* |
| 1152 | PHE0001236 | 552 | *E. coli* guaB-NP_417003 | Plant growth and development | 1-1467 | *Escherichia coli* |
| 1153 | PHE0001237 | 553 | *Agrobacterium* GuaB-AE007996 | Plant growth and development | 7-1512 | *Agrobacterium tumefaciens* |
| 1154 | PHE0001276 | 554 | corn Transcription Factor #1 | Seed development | 1-921 | *Zea mays* |
| 1155 | PHE0001277 | 555 | corn Transcription Factor #2 | Seed development | 1-2028 | *Zea mays* |
| 1156 | PHE0001325 | 556 | corn RING finger protein 25 | Plant growth and development | 353-1771 | *Zea mays* |
| 1157 | PHE0001326 | 557 | yeast VHT1-YGR065C | Carbon and/or nitrogen metabolism | 101-1879 | *Saccharomyces cerevisiae* |
| 1158 | PHE0001327 | 558 | *Arabidopsis* Suc5-AJ252133 | Carbon and/or nitrogen metabolism | 63-1592 | *Arabidopsis thaliana* |
| 1159 | PHE0001400 | 559 | soy G1792-like 2 | Stress tolerance | 18-431 | *Glycine max* |
| 1160 | PHE0001401 | 560 | corn G1792-like 3 | Stress tolerance | 247-639 | *Zea mays* |
| 1161 | PHE0001423 | 561 | Glutamate Decarboxylase | Plant growth and development | 268-1761 | *Zea mays* |
| 1162 | PHE0001432 | 562 | putative carnitine/acylcarnitine translocase- | Plant growth and development | 94-909 | *Zea mays* |
| 1163 | PHE0001433 | 563 | corn cycA-like [GATE80] | Plant growth and development | 196-1230 | *Zea mays* |
| 1164 | PHE0001434 | 564 | corn cycA-like [GAT81] | Plant growth and development | 188-1306 | *Zea mays* |
| 1165 | PHE0001435 | 565 | corn E4/E8 binding protein-like [GATE68] | Plant growth and development | 253-2259 | *Zea mays* |
| 1166 | PHE0001438 | 566 | *Arabidopsis* G748 | Plant growth and development | 98-1441 | *Arabidopsis thaliana* |
| 1167 | PHE0001439 | 567 | *Arabidopsis* NAM (no apical meristem)-like protein- | Plant growth and development | 175-1293 | *Arabidopsis thaliana* |
| 1168 | PHE0001440 | 568 | soy G1452-like protein | Plant growth and development | 207-1319 | *Glycine max* |
| 1169 | PHE0001497 | 569 | corn cytochrome P450 | Plant growth and development | 143-1588 | *Zea mays* |
| 1170 | PHE0001498 | 570 | rice receptor-like protein | Plant growth and development | 1-3885 | *Oryza sativa* |
| 1171 | PHE0001499 | 571 | rice receptor-like protein kinase | Plant growth and development | 1-3333 | *Oryza sativa* |
| 1172 | PHE0001500 | 572 | rice putative brassinosteroid-insensitive protein | Plant growth and development | 1-3366 | *Oryza sativa* |
| 1173 | PHE0001501 | 573 | rice cell elongation protein DIMINUTO | Plant growth and development | 1-1686 | *Oryza sativa* |
| 1174 | PHE0001502 | 574 | corn Dwarf1-like 1 | Plant growth and development | 138-1823 | *Zea mays* |
| 1175 | PHE0001503 | 575 | rice putative sterol-C5(6)-desaturase | Plant growth and development | 1-717 | *Oryza sativa* |

TABLE 2-continued

| PEP SEQ ID | PHE ID | NUC SEQ ID | Gene Name | Gene Effect | Coding Sequence | Species |
|---|---|---|---|---|---|---|
| 1176 | PHE0001504 | 576 | corn sterol-C5(6)-desaturase 2 | Plant growth and development | 60-881 | Zea mays |
| 1177 | PHE0001505 | 577 | corn sterol-C5(6)-desaturase 1 | Plant growth and development | 43-870 | Zea mays |
| 1178 | PHE0001506 | 578 | soy sterol-C5(6)-desaturase | Plant growth and development | 158-1006 | Glycine max |
| 1179 | PHE0001507 | 579 | rice BRS1-like protease 4 | Plant growth and development | 78-1490 | Oryza sativa |
| 1180 | PHE0001508 | 580 | corn BRS1-like protease 1 | Plant growth and development | 109-1548 | Zea mays |
| 1181 | PHE0001509 | 581 | soy FKF1-like protein | Plant growth and development | 19-1878 | Glycine max |
| 1182 | PHE0001510 | 582 | corn FKF-like protein 2 | Plant growth and development | 70-2115 | Zea mays |
| 1183 | PHE0001552 | 583 | yeast YDL168W/SFA1-NP_010113 | Nitric oxide signaling | 101-1258 | Saccharomyces cerevisiae |
| 1184 | PHE0001543 | 584 | E. coli adhC-AE000142 | Nitric oxide signaling | 1-1110 | Escherichia coli |
| 1185 | PHE0001544 | 585 | Nostoc sp. PCC 7120 glutathione dependent formaldehyde dehydrogenase-BAB74509 | Nitric oxide signaling | 1-1110 | Nostoc PCC7120 |
| 1186 | PHE0001545 | 586 | rice glutathione dependent formaldehyde dehydrogenase-U77637 | Nitric oxide signaling | 204-243, 391-527, 1160-1206, 1296-1621, 1946-2028, 2107-2182, 2805-2962, 3285-3446, 3541-3657 | Oryza sativa |
| 1187 | PHE0001546 | 587 | corn glutathione-dependent formaldehyde dehydrogenase-Y11029 | Nitric oxide signaling | 82-1227 | Zea mays |
| 1188 | PHE0001547 | 588 | corn corn glutathione-dependent formaldehyde dehydrogenase 2- | Nitric oxide signaling | 108-1265 | Zea mays |
| 1189 | PHE0001548 | 589 | corn corn glutathione-dependent formaldehyde dehydrogenase 3- | Nitric oxide signaling | 95-1231 | Zea mays |
| 1190 | PHE0001549 | 590 | soy glutathione dependent formaldehyde dehydrogenase- | Nitric oxide signaling | 30-1166 | Glycine max |
| 1191 | PHE0001550 | 591 | rice putative phosphate translocator-AAK21346 | Carbon and/or nitrogen metabolism | 1-1113 | Oryza sativa |
| 1192 | PHE0001551 | 592 | rice glucose-6-phosphate/phosphate-tranlocator-13486660 | Carbon and/or nitrogen metabolism | 1-1071 | Oryza sativa |
| 1193 | PHE0001552 | 593 | corn glucose-6-phosphate/phosphate-tranlocator- | Carbon and/or nitrogen metabolism | 165-1184 | Zea mays |
| 1194 | PHE0001553 | 594 | rice putative sugar transporter-AF416867 | Carbon and/or nitrogen metabolism | 3-1736 | Oryza sativa |
| 1195 | PHE0001554 | 595 | soy cycD4-like protein | Plant growth and development | 222-1277 | Glycine max |
| 1196 | PHE0001578 | 596 | rice RPN12-AB037153 | Plant growth and development | 76-879 | Oryza sativa |
| 1197 | PHE0001579 | 597 | YFR052W/RPN12-NP_116710 | Plant growth and development | 101-922 | Saccharomyces cerevisiae |
| 1198 | PHE0001580 | 598 | corn rpn12 | Plant growth and development | 83-883 | Zea mays |
| 1199 | PHE0001581 | 599 | soy rpn12 | Plant growth and development | 113-913 | Glycine max |
| 1200 | PHE0001583 | 600 | sorghum TTG1-like | Stress tolerance | 107-1288 | Sorghum bicolor |
| 1201 | PHE0001584 | 601 | corn TTG1-like protein 2 | Stress tolerance | 141-1388 | Zea mays |
| 1202 | PHE0001595 | 602 | ZmHK1 | Plant growth and development | 77-3001 | Zea mays |
| 1203 | PHE0001596 | 603 | Arabidopsis CRE1b | Plant growth and development | 69-3311 | Arabidopsis thaliana |
| 1204 | PHE0001597 | 604 | Arabidopsis HK2 | Plant growth and development | 1-3531 | Arabidopsis thaliana |

TABLE 2-continued

| PEP SEQ ID | PHE ID | NUC SEQ ID | Gene Name | Gene Effect | Coding Sequence | Species |
|---|---|---|---|---|---|---|
| 1205 | PHE0001598 | 605 | Arabidopsis HK3 | Plant growth and development | 1-3111 | Arabidopsis thaliana |
| 1206 | PHE0001607 | 606 | maize nitrate transporter like 1 sequence | Seed development | 494-2068 | Zea mays |
| 1207 | PHE0001608 | 607 | rice nitrate transporter like 1 sequence | Seed development | 97-1698 | Oryza sativa |
| 1208 | PHE0001609 | 608 | rice nitrate transporter like 2 sequence | Seed development | 1-1551 | Oryza sativa |
| 1209 | PHE0001667 | 609 | rice histidine kinase | Plant growth and development | 201-3239 | Oryza sativa |
| 1210 | PHE0002018 | 610 | Arabidopsis nitrate transporter NTL1 like sequence | Seed development | 76-1833 | Arabidopsis thaliana |
| 1211 | PHE0002019 | 611 | maize nitrate transporter NTL1 like sequence | Seed development | 75-1907 | Zea mays |
| 1212 | PHE0002020 | 612 | maize nitrate transporter NTL1 like 2 sequence | Seed development | 212-1954 | Zea mays |
| 1213 | PHE0002021 | 613 | rice nitrate transporter NTL1 like 1 sequence | Seed development | 163-1944 | Oryza sativa |
| 1214 | PHE0002022 | 614 | rice nitrate transporter NTL1 like 2 sequence | Seed development | 1-1743 | Oryza sativa |
| 1215 | PHE0000372 | 22 | G1073 | Plant growth and development | 1-810 | Arabidopsis thaliana |
| 1216 | PHE0000493 | 67 | Synechocystis ssr3189-BAA17701 | Stress tolerance | 54-221 | Synechocystis sp. PCC 6803 |
| 1217 | PHE0000494 | 68 | Synechocystis ssr2315-BAA17190 | Stress tolerance | 242-457 | Synechocystis sp. PCC 6803 |
| 1218 | PHE0000522 | 95 | wheat clv3-like | Plant growth and development | 102-365 | Triticum aestivum |
| 1219 | PHE0000524 | 97 | corn ESR2 | Plant growth and development | 46-441 | Zea mays |
| 1220 | PHE0000602 | 169 | yeast BIR1 | Plant growth and development | 345-3209 | Saccharomyces cerevisiae |
| 1221 | PHE0000765 | 271 | G1073 | Plant growth and development | 1-810 | Arabidopsis thaliana |
| 1222 | PHE0000971 | 452 | yeast YBL107c-Z35868 | Seed development | 29-619 | Saccharomyces cerevisiae |
| 1223 | PHE0000973 | 454 | yeast YDR209c-S61572 | Seed development | 101-511 | Saccharomyces cerevisiae |
| 1224 | PHE0000976 | 457 | yeast Yet1-NP_012858 | Seed development | 101-718 | Saccharomyces cerevisiae |
| 1225 | PHE0000977 | 458 | yeast Ylr162w-NP_013263 | Seed development | 101-454 | Saccharomyces cerevisiae |
| 1226 | PHE0000981 | 462 | yeast Ygr039w-NP_011553 | Seed development | 101-409 | Saccharomyces cerevisiae |
| 1227 | PHE0000982 | 463 | yeast Usa1-NP_013683 | Seed development | 101-2614 | Saccharomyces cerevisiae |
| 1228 | PHE0000983 | 464 | yeast Ynr061c-NP_014459 | Seed development | 101-757 | Saccharomyces cerevisiae |

Selection Methods for Transgenic Plants with Enhanced Agronomic Trait

Within a population of transgenic plants regenerated from plant cells transformed with the recombinant DNA in their nucleus many plants that survive to fertile transgenic plants that produce seeds and progeny plants will not exhibit an enhanced agronomic trait. Selection from the population is necessary to identify one or more transgenic plant cells that can provide plants with the enhanced trait. Transgenic plants having enhanced traits are selected from populations of plants regenerated or derived from plant cells transformed as described herein by evaluating the plants in a variety of assays to detect an enhanced trait, e.g. enhanced water use efficiency, enhanced cold tolerance, increased yield, enhanced nitrogen use efficiency, enhanced seed protein and enhanced seed oil. These assays also may take many forms including, but not limited to, direct screening for the trait in a greenhouse or field trial or by screening for a surrogate trait. Such analyses can be directed to detecting changes in the chemical composition, biomass, physiological properties, morphology of the plant. Changes in chemical compositions such as nutritional composition of grain can be detected by analysis of the seed composition and content of protein, free amino acids, oil, free fatty acids, starch or tocopherols. Changes in biomass characteristics can be made on greenhouse or field grown plants and can include plant height, stem diameter, root and shoot dry weights; and, for corn plants, ear length and diameter. Changes in physiological properties can be identified by evaluating responses to stress conditions, for example assays using imposed stress conditions such as water deficit, nitrogen deficiency, cold growing conditions, pathogen or insect attack or light deficiency, or increased plant density. Changes in morphology can be measured by visual observation of tendency of a transformed plant with an enhanced agronomic trait to also appear to be a normal plant as compared to changes toward bushy, taller, thicker, narrower leaves, striped leaves, knotted trait, chlorosis, albino, anthocyanin production, or altered tassels, ears or roots. Other selection properties include days to pollen shed, days to silking, leaf extension rate, chlorophyll content, leaf temperature, stand, seedling vigor, internode length, plant height, leaf number, leaf area, tillering, brace roots, stay green, stalk lodging, root lodging, plant health, barreness/prolificacy; green snap, and pest resistance. In addition, phenotypic characteristics of harvested grain may be evaluated, including number of kernels per row on the ear, number of rows of kernels on the ear, kernel abortion, kernel weight, kernel size, kernel density and physical grain quality.

Although the transgenic plant nuclei, plant cells, plant pollen, plants and methods of this invention can be applied to a wide variety of plant species such as fruits, vegetables, grasses and trees, they are particularly useful when applied to crops such as corn, soybean, cotton, oilseed rape (canola), alfalfa, rice, wheat, sugar beet, sugar cane and sunflower.

The following examples illustrate aspects of the inventions.

Example 1

Plant Expression Constructs

This example illustrates the construction of a several alternative base transformation vectors for transferring recombinant DNA into the nucleus of a plant cell which can be regenerated into a transgenic plant of this invention.

A base transformation vector for bombardment transformation is produced using GATEWAY™ Destination (Invitrogen Life Technologies, Carlsbad, Calif.) vectors. pMON65154 is constructed for use in preparation of constructs comprising recombinant polynucleotides for corn transformation. The elements of the expression vector are summarized in Table 3 below. Generally, pMON65154 comprises a selectable marker expression cassette comprising a Cauliflower Mosaic Virus 35S promoter operably linked to a gene encoding neomycin phosphotransferase II (nptII). The 3' region of the selectable marker expression cassette comprises the 3' region of the Agrobacterium tumefaciens nopaline synthase gene (nos) followed 3' by the 3' region of the potato proteinase inhibitor II (pinII) gene. The plasmid pMON 65154 further comprises a plant expression cassette into which a gene of interest may be inserted using GATEWAY™ cloning methods. The GATEWAY™ cloning cassette is flanked 5' by a rice actin 1 promoter, exon and intron and flanked 3' by the 3' region of the potato pinII gene. Using GATEWAY™ methods, the cloning cassette may be replaced with a gene of interest. The vector pMON65154, and derivatives thereof comprising a gene of interest, are particularly useful in methods of plant transformation via direct DNA delivery, such as microprojectile bombardment.

TABLE 3

Elements of Plasmid pMON65154

| FUNCTION | ELEMENT | REFERENCE |
| --- | --- | --- |
| Plant gene of interest expression cassette | Rice actin 1 promoter Rice actin 1 exon 1, intron 1 enhancer | U.S. Pat. No. 5,641,876 U.S. Pat. No. 5,641,876 |
| Gene of interest insertion site | AttR1 | GATEWAY ™Cloning Technology Instruction Manual |
| | CmR gene | GATEWAY ™Cloning Technology Instruction Manual |

TABLE 3-continued

Elements of Plasmid pMON65154

| FUNCTION | ELEMENT | REFERENCE |
| --- | --- | --- |
| | ccdA, ccdB genes | GATEWAY ™Cloning Technology Instruction Manual |
| | attR2 | GATEWAY ™Cloning Technology Instruction Manual |
| Plant gene of interest expression cassette | Potato pinII 3' region | An et al. (1989) Plant Cell 1:115-122 |
| Plant selectable marker expression cassette | CaMV 35S promoter nptII selectable marker nos 3' region PinII 3' region | U.S. Pat. No. 5,858,742 U.S. Pat. No. 5,858,742 U.S. Pat. No. 5,858,742 An et al. (1989) Plant Cell 1:115-122 |
| Maintenance in E. coli | ColE1 origin of replication F1 origin of replication Bla ampicillin resistance | |

A similar plasmid vector, pMON72472, is constructed for use in Agrobacterium-mediated methods of plant transformation. pMON72472 comprises the gene of interest plant expression cassette, GATEWAY™ cloning, and plant selectable marker expression cassettes present in pMON65154. In addition, left and right T-DNA border sequences from Agrobacterium are added to the plasmid (Zambryski et al. (1982)). The right border sequence is located 5' to the rice actin 1 promoter and the left border sequence is located 3' to the pinII 3' sequence situated 3' to the nptII gene. Furthermore, pMON72472 comprises a plasmid backbone to facilitate replication of the plasmid in both E. coli and Agrobacterium tumefaciens. The backbone has an oriV wide host range origin of DNA replication functional in Agrobacterium, a pBR322 origin of replication functional in E. coli, and a spectinomycin/streptomycin resistance gene for selection in both E. coli and Agrobacterium.

Vectors similar to those described above may be constructed for use in Agrobacterium or microprojectile bombardment maize transformation systems where the rice actin 1 promoter in the plant expression cassette portion is replaced with other desirable promoters including, but not limited to a corn globulin 1 promoter, a maize oleosin promoter, a glutelin 1 promoter, an aldolase promoter, a zein Z27 promoter, a pyruvate orthophosphate dikinase (PPDK) promoter, a soybean 7S alpha promoter, a peroxiredoxin antioxidant (Per1) promoter and a CaMV 35S promoter. Protein coding segments are amplified by PCR prior to insertion into vectors such as described above. Primers for PCR amplification can be designed at or near the start and stop codons of the coding sequence, in order to eliminate most of the 5' and 3' untranslated regions. For GATEWAY cloning methods, PCR products are tailed with attB1 and attB2 sequences, purified then recombined into a destination vectors to produce an expression vector for use in transformation.

An alternative base transformation vector specifically useful for inserting a recombinant DNA construct into a chromosome in a nucleus in a corn plant cell by Agrobacterium-mediated transformation is pMON93039 which has the DNA in the nucleotide sequence of SEQ ID NO:27374 and the elements described in Table 4 and illustrated in FIG. 2.

TABLE 4

| Function | Name | Annotation | Coordinates of SEQ ID NO: 27374 |
|---|---|---|---|
| Agrobacterium T-DNA transfer | B-AGRtu.right border | Agro right border sequence, essential for transfer of T-DNA. | 11364-11720 |
| Gene of interest expression cassette | E-Os.Act1 | Upstream promoter region of the rice actin 1 gene | 19-775 |
| | E-CaMV.35S.2xA1-B3 | Duplicated 35S A1-B3 domain without TATA box | 788-1120 |
| | P-Os.Act1 | Promoter region of the rice actin 1 gene | 1125-1204 |
| | L-Ta.Lhcb1 | 5' untranslated leader of wheat major chlorophyll a/b binding protein | 1210-1270 |
| | I-Os.Act1 | First intron and flanking UTR exon sequences from the rice actin 1 gene | 1287-1766 |
| | T-St.Pis4 | 3' non-translated region of the potato proteinase inhibitor II gene which functions to direct polyadenylation of the mRNA | 1838-2780 |
| Plant selectable marker expression cassette | P-Os.Act1 | Promoter from the rice actin 1 gene | 2830-3670 |
| | L-Os.Act1 | First exon of the rice actin 1 gene | 3671-3750 |
| | I-Os.Act1 | First intron and flanking UTR exon sequences from the rice actin 1 gene | 3751-4228 |
| | TS-At.ShkG-CTP2 | Transit peptide region of Arabidopsis EPSPS | 4238-4465 |
| | CR-AGRtu.aroA-CP4.nat | Coding region for bacterial strain CP4 native aroA gene. | 4466-5833 |
| | T-AGRtu.nos | A 3' non-translated region of the nopaline synthase gene of Agrobacterium tumefaciens Ti plasmid which functions to direct polyadenylation of the mRNA. | 5849-6101 |
| Agrobacterium T-DNA transfer | B-AGRtu.left border. | Agro left border sequence, essential for transfer of T-DNA. | 6168-6609 |
| Maintenance in E. coli | OR-Ec.oriV-RK2 | The vegetative origin of replication from plasmid RK2. | 6696-7092 |
| | CR-Ec.rop | Coding region for repressor of primer from the ColE1 plasmid. Expression of this gene product interferes with primer binding at the origin of replication, keeping plasmid copy number low. | 8601-8792 |
| | OR-Ec.ori-ColE1 | The minimal origin of replication from the E. coli plasmid ColE1. | 9220-9808 |
| | P-Ec.aadA-SPC/STR | Promoter for Tn7 adenylyltransferase (AAD(3")) | 10339-10380 |
| | CR-Ec.aadA-SPC/STR | Coding region for Tn7 adenylyltransferase (AAD(3")) conferring spectinomycin and streptomycin resistance. | 10381-11169 |
| | T-Ec.aadA-SPC/STR | 3' UTR from the Tn7 adenylyltransferase (AAD(3")) gene of E. coli. | 11170-11227 |

An alternative base transformation vector specifically useful for inserting a recombinant DNA construct into a chromosome in a nucleus in a dicot plant cell, e.g. soybean or oilseed rape, by *Agrobacterium*-mediated transformation is pMON82053 which has the DNA in the nucleotide sequence of SEQ ID NO:27375 and the elements described in Table 5 and illustrated in FIG. 3.

TABLE 5

| Function | Name | Annotation | Coordinates of SEQ ID NO: 27375 |
|---|---|---|---|
| Agrobacterium T-DNA transfer | B-AGRtu.left border | Agro left border sequence, essential for transfer of T-DNA. | 6144-6585 |
| Plant selectable marker expression cassette | P-At.Act7 | Promoter from the Arabidopsis actin 7 gene | 6624-7861 |
| | L-At.Act7 | 5'UTR of Arabidopsis Act7 gene | |
| | I-At.Act7 | Intron from the Arabidopsis actin7 gene | |

TABLE 5-continued

| Function | Name | Annotation | Coordinates of SEQ ID NO: 27375 |
|---|---|---|---|
| | TS-At.ShkG-CTP2 | Transit peptide region of Arabidopsis EPSPS | 7864-8091 |
| | CR-AGRtu.aroA-CP4.nno_At | Synthetic CP4 coding region with dicot preferred codon usage. | 8092-9459 |
| | T-AGRtu.nos | A 3' non-translated region of the nopaline synthase gene of Agrobacterium tumefaciens Ti plasmid which functions to direct polyadenylation of the mRNA. | 9466-9718 |
| Gene of interest expression cassette | P-CaMV.35S-enh | Promoter for 35S RNA from CaMV containing a duplication of the −90 to −350 region. | 1-613 |
| | T-Gb.E6-3b | 3' untranslated region from the fiber protein E6 gene of sea-island cotton. | 688-1002 |
| Agrobacterium T-DNA transfer | B-AGRtu.right border | Agro right border sequence, essential for transfer of T-DNA. | 1033-1389 |
| Maintenance in E. coli | OR-Ec.oriV-RK2 | The vegetative origin of replication from plasmid RK2. | 5661-6057 |
| | CR-Ec.rop | Coding region for repressor of primer from the ColE1 plasmid. Expression of this gene product interferes with primer binding at the origin of replication, keeping plasmid copy number low. | 3961-4152 |
| | OR-Ec.ori-ColE1 | The minimal origin of replication from the E. coli plasmid ColE1. | 2945-3533 |
| | P-Ec.aadA-SPC/STR | Promoter for Tn7 adenylyltransferase (AAD(3")) | 2373-2414 |
| | CR-Ec.aadA-SPC/STR | Coding region for Tn7 adenylyltransferase (AAD(3")) conferring spectinomycin and streptomycin resistance. | 1584-2372 |
| | T-Ec.aadA-SPC/STR | 3' UTR from the Tn7 adenylyltransferase (AAD(3")) gene of E. coli. | 1526-1583 |

An alternative base transformation vector specifically useful for inserting a recombinant DNA construct into a chromosome in a nucleus in a dicot plant cell, e.g. cotton, by Agrobacterium-mediated transformation is pMON99053 which has the DNA in the nucleotide sequence of SEQ ID NO:27376 and the elements described in Table 6 and illustrated in FIG. 4.

TABLE 6

| Function | Name | Annotation | Coordinates of SEQ ID NO: 27376 |
|---|---|---|---|
| Agrobacterium T-DNA transfer | B-AGRtu.right border | Agro right border sequence, essential for transfer of T-DNA. | 11364-11720 |
| Gene of interest expression cassette | Exp-CaMV.35S-enh + Ph.DnaK | Enhanced version of the 35S RNA promoter from CaMV plus the petunia hsp70 5' untranslated region | 7794-8497 |
| | T-Ps.RbcS2-E9 | The 3' non-translated region of the pea RbcS2 gene which functions to direct polyadenylation of the mRNA. | 67-699 |
| Plant selectable marker expression cassette | Exp-CaMV.35S | Promoter and 5' untranslated region from the 35S RNA of CaMV | 730-1053 |
| | CR-Ec.nptII-Tn5 | Coding region for neomycin phosphotransferase gene from transposon Tn5 which confers resistance to neomycin and kanamycin. | 1087-1881 |
| | T-AGRtu.nos | A 3' non-translated region of the nopaline synthase gene of Agrobacterium tumefaciens Ti plasmid which functions to direct polyadenylation of the mRNA. | 1913-2165 |
| Agrobacterium T-DNA transfer | B-AGRtu.left border | Agro left border sequence, essential for transfer of T-DNA. | 2211-2652 |
| Maintenance in E. coli | OR-Ec.oriV-RK2 | The vegetative origin of replication from plasmid RK2. | 2739-3135 |
| | CR-Ec.rop | Coding region for repressor of primer from the ColE1 plasmid. Expression | 4644-4835 |

TABLE 6-continued

| Function | Name | Annotation | Coordinates of SEQ ID NO: 27376 |
|---|---|---|---|
| | | of this gene product interferes with primer binding at the origin of replication, keeping plasmid copy number low. | |
| | OR-Ec.ori-ColE1 | The minimal origin of replication from the *E. coli* plasmid ColE1. | 5263-5851 |
| | P-Ec.aadA-SPC/STR | Promoter for Tn7 adenylyltransferase (AAD(3")) | 6382-6423 |
| | CR-Ec.aadA-SPC/STR | Coding region for Tn7 adenylyltransferase (AAD(3")) conferring spectinomycin and streptomycin resistance. | 6424-7212 |
| | T-Ec.aadA-SPC/STR | 3' UTR from the Tn7 adenylyltransferase (AAD(3")) gene of *E. coli*. | 7213-7270 |

Primers for PCR amplification of protein coding nucleotides of recombinant DNA are designed at or near the start and stop codons of the coding sequence, in order to eliminate most of the 5' and 3' untranslated regions. Each recombinant DNA coding for a protein identified in Table 2 is amplified by PCR prior to insertion into the insertion site within the gene of interest expression cassette of one of the base transformation vectors.

Example 2

Corn Transformation

This example illustrates transformation methods useful in introducing recombinant DNA into corn chromosomes to produce the transgenic nuclei, plant cells, plants and pollen and the production and identification of transgenic corn plants and seed with an enhanced trait, i.e. enhanced water use efficiency, enhanced cold tolerance, increased yield, enhanced nitrogen use efficiency, enhanced seed protein and enhanced seed oil. Plasmid vectors were prepared by cloning DNA identified in Table 1 and inserting the cloned DNA into a base transformation vector.

In *Agrobacterium*-mediated transformation corn embryo cells from a corn line that is readily transformable (e.g. corn line designated LH59) are grown in a greenhouse to produce ears that are harvested when the embryos are 1.5 to 2.0 mm in length. The ears are surface sterilized by spraying or soaking in 80% ethanol, followed by air drying. Immature embryos are isolated from individual kernels on surface sterilized ears. Prior to inoculation of maize cells, *Agrobacterium* cells are grown overnight at room temperature. Immature maize embryo cells are inoculated with *Agrobacterium* shortly after excision, and incubated at room temperature with *Agrobacterium* for 5-20 minutes. Immature embryo plant cells are then co-cultured with *Agrobacterium* for 1 to 3 days at 23° C. in the dark. Co-cultured embryos are transferred to selection media and cultured for approximately two weeks to allow embryogenic callus to develop. Embryogenic callus is transferred to culture medium containing 100 mg/L paromomycin and subcultured at about two week intervals. Transformed plant cells are recovered 6 to 8 weeks after initiation of selection.

For transformation by microprojectile bombardment maize immature embryos are isolated and cultured 3-4 days prior to bombardment. Prior to microprojectile bombardment, a suspension of gold particles is prepared onto which the desired recombinant DNA expression cassettes are precipitated. DNA is introduced into maize cells as described in U.S. Pat. Nos. 5,550,318 and 6,399,861 using the electric discharge particle acceleration gene delivery device. Following microprojectile bombardment, tissue is cultured in the dark at 27° C. Additional transformation methods and materials for making transgenic plants of this invention, for example, various media and recipient target cells, transformation of immature embryos and subsequence regeneration of fertile transgenic plants are disclosed in U.S. Pat. Nos. 6,194,636 and 6,232,526 and U.S. patent application Ser. No. 09/757,089, which are incorporated herein by reference.

To regenerate transgenic corn plants a callus of transgenic plant cells resulting from transformation and selection is placed on media to initiate shoot development into plantlets which are transferred to potting soil for initial growth in a growth chamber at 26° C. followed by a mist bench before transplanting to 5 inch pots where plants are grown to maturity. The regenerated plants are self-fertilized and seed is harvested for use in one or more methods to select seeds, seedlings or progeny second generation transgenic plants (R2 plants) or hybrids, e.g. by selecting transgenic plants exhibiting an enhanced trait as compared to a control plant.

Transgenic corn plant cells are transformed with recombinant DNA from each of the genes identified in Table 1, e.g. with DNA having the nucleotide sequence of SEQ ID NO:1-614. Progeny transgenic plants and seed of the transformed plant cells are screened for enhanced water-use efficiency, enhanced cold tolerance, increased yield, enhanced nitrogen use efficiency, enhanced seed protein and enhanced seed oil as reported in Example 7.

Example 3

Soybean Transformation

This example illustrates transformation methods useful in introducing recombinant DNA into soybean chromosomes to produce the transgenic nuclei, plant cells, plants and pollen and the production and identification of transgenic soybean plants and seed with an enhanced trait, i.e. enhanced water use efficiency, enhanced cold tolerance, increased yield, enhanced nitrogen use efficiency, enhanced seed protein and enhanced seed oil. Plasmid vectors were prepared by cloning DNA identified in Table 1 and inserting the cloned DNA into a base transformation vector.

For *Agrobacterium*-mediated transformation, soybean seeds are imbibed overnight and the meristem explants excised. The explants are placed in a wounding vessel. Soybean explants and induced *Agrobacterium* cells from a strain containing plasmid DNA with the gene of interest cassette and a plant selectable marker cassette are mixed no later than 14 hours from the time of initiation of seed imbibition, and wounded using sonication. Following wounding, explants are placed in co-culture for 2-5 days at which point they are transferred to selection media for 6-8 weeks to allow selection and growth of transgenic shoots. Resistant shoots are harvested approximately 6-8 weeks and placed into selective rooting media for 2-3 weeks. Shoots producing roots are transferred to the greenhouse and potted in soil. Shoots that remain healthy on selection, but do not produce roots are transferred to non-selective rooting media for an additional two weeks. Roots from any shoots that produce roots off selection are tested for expression of the plant selectable marker before they are transferred to the greenhouse and potted in soil. Additionally, a DNA construct can be transferred into the genome of a soybean cell by particle bombardment and the cell regenerated into a fertile soybean plant as described in U.S. Pat. No. 5,015,580, herein incorporated by reference.

Transgenic soybean plant cells are transformed with recombinant DNA from each of the genes identified in Table 2, i.e. with DNA having the nucleotide sequence of SEQ ID NO: 1-614. Transgenic progeny plants and seed of the transformed plant cells are screened for enhanced water use efficiency, enhanced cold tolerance, increased yield, enhanced nitrogen use efficiency, enhanced seed protein and enhanced seed oil as reported in Example 7.

Example 4

Cotton Transgenic Plants with Enhanced Agronomic Traits

This example illustrates transformation methods useful in introducing recombinant DNA into cotton chromosomes to produce the transgenic nuclei, plant cells, plants and pollen and the production and identification of transgenic cotton plants and seed with an enhanced trait, i.e. enhanced water use efficiency, enhanced cold tolerance, increased yield, enhanced nitrogen use efficiency, enhanced seed protein and enhanced seed oil. Plasmid vectors were prepared by cloning DNA identified in Table 1 and inserting the cloned DNA into a base transformation vector.

Cotton transformation is performed as generally described in WO0036911 and in U.S. Pat. No. 5,846,797. Transgenic cotton plants containing each of the recombinant DNA having a sequence of SEQ ID NO: 1 through SEQ ID NO: 614 are obtained by transforming with recombinant DNA from each of the genes identified in Table 2. Progeny transgenic plants are selected from a population of transgenic cotton events under specified growing conditions and are compared with control cotton plants. Control cotton plants are substantially the same cotton genotype but without the recombinant DNA, for example, either a parental cotton plant of the same genotype that was not transformed with the identical recombinant DNA or a negative isoline of the transformed plant. Additionally, a commercial cotton cultivar adapted to the geographical region and cultivation conditions, i.e. cotton variety ST474, cotton variety FM 958, and cotton variety Siokra L-23, are used to compare the relative performance of the transgenic cotton plants containing the recombinant DNA. The specified culture conditions are growing a first set of transgenic and control plants under "wet" conditions, i.e. irrigated in the range of 85 to 100 percent of evapotranspiration to provide leaf water potential of −14 to −18 bars, and growing a second set of transgenic and control plants under "dry" conditions, i.e. irrigated in the range of 40 to 60 percent of evapotranspiration to provide a leaf water potential of −21 to −25 bars. Pest control, such as weed and insect control is applied equally to both wet and dry treatments as needed. Data gathered during the trial includes weather records throughout the growing season including detailed records of rainfall; soil characterization information; any herbicide or insecticide applications; any gross agronomic differences observed such as leaf morphology, branching habit, leaf color, time to flowering, and fruiting pattern; plant height at various points during the trial; stand density; node and fruit number including node above white flower and node above crack boll measurements; and visual wilt scoring. Cotton boll samples are taken and analyzed for lint fraction and fiber quality. The cotton is harvested at the normal harvest timeframe for the trial area. Enhanced water use efficiency is indicated by increased yield, improved relative water content, enhanced leaf water potential, increased biomass, enhanced leaf extension rates, and improved fiber parameters.

The transgenic cotton plants of this invention are identified from among the transgenic cotton plants by agronomic trait screening as having increased yield and enhanced water use efficiency.

Example 5

Oilseed Rape Transformation

This example illustrates transformation methods useful in introducing recombinant DNA into oilseed-rape (canola) chromosomes to produce the transgenic nuclei, plant cells, plants and pollen and the production and identification of transgenic canola plants and seed with an enhanced trait, i.e. enhanced water use efficiency, enhanced cold tolerance, increased yield, enhanced nitrogen use efficiency, enhanced seed protein and enhanced seed oil.

Tissues from in vitro grown canola seedlings are prepared and inoculated with overnight-grown *Agrobacterium* cells containing plasmid DNA with the gene of interest cassette and a plant selectable marker cassette. Following co-cultivation with *Agrobacterium*, the infected tissues are allowed to grow on selection to promote growth of transgenic shoots, followed by growth of roots from the transgenic shoots. The selected plantlets are then transferred to the greenhouse and potted in soil. Molecular characterization are performed to confirm the presence of the gene of interest, and its expression in transgenic plants and progenies. Progeny transgenic plants are selected from a population of transgenic canola events under specified growing conditions and are compared with control canola plants. Control canola plants are substantially the same canola genotype but without the recombinant DNA, for example, either a parental canola plant of the same genotype that is not transformed with the identical recombinant DNA or a negative isoline of the transformed plant Transgenic canola plant cells are transformed with recombinant DNA from each of the genes identified in Table 2. Transgenic progeny plants and seed of the transformed plant cells are screened for enhanced water use efficiency, enhanced cold tolerance, increased yield, enhanced nitrogen use efficiency, enhanced seed protein and enhanced seed oil as reported in Example 7.

Example 6

Homolog Identification

This example illustrates the identification of homologs of proteins encoded by the DNA identified in Table 2 which is used to provide transgenic seed and plants having enhanced agronomic traits. From the sequence of the homologs, homologous DNA sequence can be identified for preparing additional transgenic seeds and plants of this invention with enhanced agronomic traits.

An "All Protein Database" was constructed of known protein sequences using a proprietary sequence database and the National Center for Biotechnology Information (NCBI) non-redundant amino acid database (nr.aa). For each organism from which a polynucleotide sequence provided herein was obtained, an "Organism Protein Database".was constructed of known protein sequences of the organism; it is a subset of the All Protein Database based on the NCBI taxonomy ID for the organism.

The All Protein Database was queried using amino acid sequences provided herein as SEQ ID NO: 615 through SEQ ID NO: 1228 using NCBI "blastp" program with E-value cutoff of 1e-8. Up to 1000 top hits were kept, and separated by organism names. For each organism other than that of the query sequence, a list was kept for hits from the query organism itself with a more significant E-value than the best hit of the organism. The list contains likely duplicated genes of the polynucleotides provided herein, and is referred to as the Core List. Another list was kept for all the hits from each organism, sorted by E-value, and referred to as the Hit List.

The Organism Protein Database was queried using polypeptide sequences provided herein as SEQ ID NO: 615 through SEQ ID NO: 1228 using NCBI "blastp" program with E-value cutoff of 1e-4. Up to 1000 top hits were kept. A BLAST searchable database was constructed based on these hits, and is referred to as "SubDB". SubDB was queried with each sequence in the Hit List using NCBI "blastp" program with E-value cutoff of 1e-8. The hit with the best E-value was compared with the Core List from the corresponding organism. The hit is deemed a likely ortholog if it belongs to the Core List, otherwise it is deemed not a likely ortholog and there is no further search of sequences in the Hit List for the same organism. Homologs from a large number of distinct organisms were identified and are reported by amino acid sequences of SEQ ID NO: 1229 through SEQ ID NO: 27373. These relationships of proteins of SEQ ID NO: 615 through 1228 and homologs of SEQ ID NO: 1229 through 27373 are identified in Table 7. The source organism for each homolog is found in the Sequence Listing.

Example 7

Selection of Transgenic Plants with Enhanced Agronomic Trait(s)

This example illustrates identification of plant cells of the invention by screening derived plants and seeds for enhanced trait. Transgenic corn, soybean, cotton and canola seeds and plants with recombinant DNA from each of the genes identified in Table 2 are prepared using plant cells transformed with DNA that is stably integrated into a chromosome of the nuclei in a plant cell. Progeny transgenic plants and seed of the transformed plant cells are screened for enhanced water use efficiency, enhanced cold tolerance, increased yield, enhanced nitrogen use efficiency, enhanced seed protein and enhanced seed oil as compared to control plants.

A. Selection for Enhanced Nitrogen Use Efficiency

The physiological efficacy of transgenic plants, e.g. transgenic corn plants (tested as hybrids), can be tested for nitrogen use efficiency (NUE) traits in a high-throughput nitrogen (N) selection method compared to the measurements from testing of control plants.

Plants are allowed to grow for 28 days in a low nitrogen nutrient environment or for 23 days in a high nitrogen nutrient environment. The nitrogen nutrients are dispensed in the form of a macronutrient solution (see composition below) containing different amounts of nitrogen nutrient (2 mM $NH_4NO_3$ for a low nitrogen environment or 20 mM $NH_4NO_3$ for a high nitrogen environment). Pots with corn plants a provided with 100 ml of nutrient solution three times a week on alternate days starting at eight days after planting for low nitrogen and ten days after planting for high nitrogen. Matting under the pots should be changed as needed to avoid nitrogen accumulation and buildup of root matter. Table 8 shows the amount of nutrients in the low and high nitrogen solutions.

TABLE 8

| Nutrient Stock | 2 mM $NH_4NO_3$ solution (mL/L) | 20 mM $NH_4NO_3$ solution (mL/L) |
|---|---|---|
| 1M $NH_4NO_3$ | 2 | 20 |
| 1M $KH_2PO_4$ | 0.5 | 0.5 |
| 1M $MgSO_4 \cdot 7H_2O$ | 2 | 2 |
| 1M $CaCl_2$ | 2.5 | 2.5 |
| 1M $K_2SO_4$ | 1 | 1 | pH adjusted to 5.6 with HCl or KOH

After 28 days of plant growth under low nitrogen and 23 days of plant growth under high nitrogen, the following variables are measured: total shoot fresh mass (SFM) in grams (g), V6 leaf chlorophyll (LC) measured by Minolta SPAD meter in "relative units", V6 leaf area (LA) measured in square centimeters ($cm^2$), V6 leaf fresh mass (LFM) measured in grams and V6 leaf dry mass (LDM) measured in grams. Leaf fresh mass is measure on leaves that have been dried in a forced air oven at 80° C. for 3 days. From the collected data, two derived measurements are made: (1) Leaf chlorophyll area (LCA), which is a product of V6 relative chlorophyll content and its leaf area (relative units), indicates the spread of chlorophyll over the entire leaf area; and (2) specific leaf area (LSA), which is the ratio of V6 leaf area to its dry mass ($cm^2$/g dry mass), serves as an indicator of nitrogen use efficiency (NUE).

A list of recombinant DNA constructs which improved growth in high nitrogen environments in transgenic plants is reported in Table 9.

TABLE 9

| NUC SEQ ID | PHE ID | Construct | Positive events/Total events screened | Confirmed events/Actual events with confirmation attempted |
|---|---|---|---|---|
| 3 | PHE0000004 | PMON67819 | 2/2 | 2/2 |
| 4 | PHE0000005 | PMON67820 | 2/2 | 2/2 |
| 9 | PHE0000080 | PMON68366 | 1/1 | 0/0 |
| 22 | PHE0000372 | PMON72460 | 2/4 | 1/1 |
| 43 | PHE0000459 | PMON68390 | 2/2 | 0/0 |
| 44 | PHE0000460 | PMON73751 | 3/3 | 2/2 |
| 66 | PHE0000492 | PMON69490 | 3/3 | 2/3 |
| 67 | PHE0000493 | PMON68403 | 2/5 | 0/0 |
| 72 | PHE0000498 | PMON76305 | 5/5 | 0/5 |
| 74 | PHE0000500 | PMON69495 | 1/4 | 0/0 |
| 124 | PHE0000551 | PMON74450 | 1/2 | 0/0 |

TABLE 9-continued

| NUC SEQ ID | PHE ID | Construct | Positive events/Total events screened | Confirmed events/Actual events with confirmation attempted |
|---|---|---|---|---|
| 137 | PHE0000564 | PMON68619 | 6/7 | 0/2 |
| 165 | PHE0000592 | PMON68639 | 4/4 | 2/4 |
| 166 | PHE0000593 | PMON68634 | 5/5 | 1/5 |
| 220 | PHE0000655 | PMON68607 | 5/7 | 1/5 |
| 227 | PHE0000664 | PMON69471 | 4/4 | 3/4 |
| 229 | PHE0000666 | PMON68398 | 6/9 | 2/9 |
| 285 | PHE0000799 | PMON75317 | 1/4 | 0/0 |
| 293 | PHE0000807 | PMON76309 | 1/3 | 0/0 |
| 295 | PHE0000809 | PMON76311 | 3/8 | 0/0 |
| 296 | PHE0000810 | PMON75319 | 1/2 | 0/0 |
| 339 | PHE0000854 | PMON73795 | 1/1 | 0/0 |
| 340 | PHE0000855 | PMON75347 | 1/2 | 0/0 |
| 347 | PHE0000862 | PMON75335 | 2/2 | 0/0 |
| 348 | PHE0000863 | PMON75349 | 1/2 | 0/0 |
| 354 | PHE0000869 | PMON75339 | 1/2 | 0/0 |
| 476 | PHE0000995 | PMON77871 | 1/3 | 0/0 |
| 487 | PHE0001006 | PMON73814 | 1/1 | 0/0 |
| 508 | PHE0001028 | PMON73823 | 1/1 | 0/0 |
| 560 | PHE0001401 | PMON84122 | 7/9 | 0/0 |
| 587 | PHE0001546 | PMON79717 | 2/5 | 0/0 |
| 589 | PHE0001548 | PMON75547 | 2/6 | 0/0 |

A list of recombinant DNA constructs which improved growth in a low (limiting) nitrogen environment in transgenic plants is reported in Table 10.

TABLE 10

| NUC SEQ ID | PHE ID | Construct | Positive events/Total events screened | Confirmed events/Actual events with confirmation attempted |
|---|---|---|---|---|
| 1 | PHE0000002 | PMON80861 | 3/4 | 2/4 |
| 3 | PHE0000004 | PMON67819 | 2/3 | 0/3 |
| 4 | PHE0000005 | PMON67820 | 3/7 | 0/4 |
| 9 | PHE0000080 | PMON68366 | 2/3 | 0/2 |
| 13 | PHE0000113 | PMON68365 | 1/3 | 0/0 |
| 14 | PHE0000140 | PMON73157 | 1/1 | 0/0 |
| 22 | PHE0000372 | PMON72460 | 3/8 | 1/5 |
| 25 | PHE0000375 | PMON73153 | 1/2 | 0/1 |
| 28 | PHE0000378 | PMON72461 | 1/2 | 0/0 |
| 30 | PHE0000381 | PMON72469 | 1/1 | 0/0 |
| 32 | PHE0000384 | PMON68621 | 2/3 | 1/3 |
| 43 | PHE0000459 | PMON68390 | 3/5 | 0/5 |
| 44 | PHE0000460 | PMON73751 | 4/6 | 2/3 |
| 45 | PHE0000461 | PMON67829 | 2/2 | 2/2 |
| 56 | PHE0000479 | PMON68402 | 4/8 | 0/0 |
| 58 | PHE0000481 | PMON75472 | 5/7 | 2/7 |
| 61 | PHE0000487 | PMON80267 | 2/3 | 0/0 |
| 62 | PHE0000488 | PMON75473 | 3/5 | 0/5 |
| 65 | PHE0000491 | PMON72489 | 1/2 | 0/2 |
| 66 | PHE0000492 | PMON69490 | 3/3 | 0/3 |
| 67 | PHE0000493 | PMON68403 | 3/5 | 1/5 |
| 68 | PHE0000494 | PMON75459 | 1/1 | 0/1 |
| 72 | PHE0000498 | PMON76305 | 4/5 | 2/5 |
| 74 | PHE0000500 | PMON69495 | 3/5 | 1/4 |
| 77 | PHE0000503 | PMON69493 | 1/5 | 0/0 |
| 81 | PHE0000507 | PMON69492 | 4/2 | 0/0 |
| 90 | PHE0000516 | PMON72492 | 1/2 | 0/0 |
| 91 | PHE0000517 | PMON72493 | 1/2 | 0/1 |
| 96 | PHE0000523 | PMON69487 | 1/2 | 0/0 |
| 102 | PHE0000529 | PMON69482 | 1/4 | 1/1 |
| 106 | PHE0000533 | PMON84135 | 1/7 | 0/0 |
| 113 | PHE0000540 | PMON75451 | 1/4 | 0/0 |
| 116 | PHE0000543 | PMON69499 | 1/4 | 0/0 |
| 124 | PHE0000551 | PMON74450 | 2/2 | 0/2 |
| 125 | PHE0000552 | PMON75460 | 1/2 | 1/2 |
| 131 | PHE0000558 | PMON68637 | 1/3 | 0/0 |
| 132 | PHE0000559 | PMON74431 | 2/3 | 0/0 |

TABLE 10-continued

| NUC SEQ ID | PHE ID | Construct | Positive events/Total events screened | Confirmed events/Actual events with confirmation attempted |
|---|---|---|---|---|
| 134 | PHE0000561 | PMON68620 | 4/7 | 1/7 |
| 134 | PHE0000561 | PMON68620 | 4/7 | 1/7 |
| 135 | PHE0000562 | PMON75303 | 3/9 | 0/0 |
| 137 | PHE0000564 | PMON68619 | 3/3 | 1/3 |
| 139 | PHE0000566 | PMON75304 | 5/6 | 0/0 |
| 144 | PHE0000571 | PMON69484 | 3/4 | 0/0 |
| 151 | PHE0000578 | PMON69485 | 2/6 | 0/0 |
| 153 | PHE0000580 | PMON68611 | 1/4 | 0/0 |
| 157 | PHE0000584 | PMON68610 | 1/2 | 1/2 |
| 165 | PHE0000592 | PMON68639 | 2/4 | 2/4 |
| 166 | PHE0000593 | PMON68634 | 5/5 | 5/5 |
| 171 | PHE0000604 | PMON68625 | 2/3 | 0/0 |
| 178 | PHE0000611 | PMON68405 | 2/3 | 0/0 |
| 190 | PHE0000623 | PMON74438 | 2/7 | 0/0 |
| 196 | PHE0000629 | PMON68631 | 3/5 | 0/0 |
| 197 | PHE0000630 | PMON68648 | 2/3 | 0/0 |
| 198 | PHE0000631 | PMON75454 | 1/3 | 0/0 |
| 206 | PHE0000639 | PMON75457 | 3/5 | 2/5 |
| 216 | PHE0000649 | PMON78901 | 1/3 | 0/0 |
| 219 | PHE0000654 | PMON68605 | 1/6 | 1/1 |
| 220 | PHE0000655 | PMON84121 | 11/18 | 2/15 |
| 221 | PHE0000656 | PMON80923 | 6/17 | 2/8 |
| 227 | PHE0000664 | PMON69471 | 4/4 | 3/4 |
| 228 | PHE0000665 | PMON84120 | 5/13 | 0/0 |
| 229 | PHE0000666 | PMON68398 | 7/9 | 4/7 |
| 233 | PHE0000703 | PMON75517 | 1/1 | 0/0 |
| 234 | PHE0000704 | PMON76315 | 1/4 | 0/0 |
| 238 | PHE0000710 | PMON84772 | 1/2 | 0/0 |
| 259 | PHE0000748 | PMON75479 | 5/9 | 4/9 |
| 260 | PHE0000749 | PMON84133 | 1/12 | 0/0 |
| 268 | PHE0000762 | PMON75464 | 1/1 | 1/1 |
| 285 | PHE0000799 | PMON75317 | 4/4 | 2/4 |
| 293 | PHE0000807 | PMON76309 | 3/3 | 3/3 |
| 295 | PHE0000809 | PMON76311 | 7/8 | 2/8 |
| 296 | PHE0000810 | PMON75319 | 2/2 | 0/2 |
| 334 | PHE0000849 | PMON82608 | 1/4 | 1/1 |
| 339 | PHE0000854 | PMON73795 | 1/3 | 1/1 |
| 340 | PHE0000855 | PMON75347 | 2/4 | 2/2 |
| 342 | PHE0000857 | PMON75348 | 2/5 | 2/5 |
| 344 | PHE0000859 | PMON73798 | 1/8 | 0/0 |
| 347 | PHE0000862 | PMON75335 | 2/2 | 1/2 |
| 348 | PHE0000863 | PMON75349 | 2/5 | 0/2 |
| 350 | PHE0000865 | PMON75336 | 1/5 | 0/1 |
| 351 | PHE0000866 | PMON84970 | 2/10 | 0/0 |
| 354 | PHE0000869 | PMON75339 | 1/2 | 0/0 |
| 366 | PHE0000885 | PMON77853 | 3/3 | 0/3 |
| 378 | PHE0000897 | PMON73833 | 4/5 | 3/4 |
| 384 | PHE0000903 | PMON77865 | 1/4 | 0/0 |
| 390 | PHE0000909 | PMON73845 | 1/3 | 1/2 |
| 391 | PHE0000910 | PMON73846 | 1/3 | 0/0 |
| 394 | PHE0000913 | PMON78201 | 2/3 | 2/3 |
| 400 | PHE0000919 | PMON73848 | 1/2 | 0/0 |
| 406 | PHE0000925 | PMON73835 | 1 | 0/0 |
| 421 | PHE0000940 | PMON76317 | 1/1 | 0/1 |
| 425 | PHE0000944 | PMON76319 | 1/3 | 1/2 |
| 428 | PHE0000947 | PMON75493 | 1/1 | 1/1 |
| 434 | PHE0000953 | PMON76322 | 1/2 | 0/0 |
| 436 | PHE0000955 | PMON76324 | 1/1 | 0/0 |
| 445 | PHE0000964 | PMON77867 | 2/3 | 0/0 |
| 465 | PHE0000984 | PMON73809 | 1/2 | 0/0 |
| 470 | PHE0000989 | PMON0515 | 2/7 | 0/7 |
| 471 | PHE0000990 | PMON77858 | 6/9 | 2/9 |
| 476 | PHE0000995 | PMON77871 | 3/8 | 0/3 |
| 487 | PHE0001006 | PMON73814 | 1/2 | 1/2 |
| 488 | PHE0001007 | PMON84742 | 2/4 | 0/0 |
| 499 | PHE0001019 | PMON73817 | 1/3 | 0/0 |
| 508 | PHE0001028 | PMON73823 | 2/5 | 2/2 |
| 523 | PHE0001043 | PMON77881 | 1/2 | 1/2 |
| 524 | PHE0001044 | PMON77876 | 1/3 | 0/0 |
| 525 | PHE0001045 | PMON77872 | 2/7 | 0/7 |
| 528 | PHE0001048 | PMON80862 | 1/2 | 1/2 |
| 540 | PHE0001173 | PMON80469 | 6/11 | 0/1 |
| 548 | PHE0001194 | PMON78918 | 1/5 | 0/0 |
| 550 | PHE0001234 | PMON82646 | 2/6 | 0/0 |

TABLE 10-continued

| NUC SEQ ID | PHE ID | Construct | Positive events/Total events screened | Confirmed events/Actual events with confirmation attempted |
|---|---|---|---|---|
| 554 | PHE0001276 | PMON79652 | 2/2 | 1/2 |
| 560 | PHE0001401 | PMON84122 | 6/6 | 5/6 |
| 561 | PHE0001423 | PMON79672 | 2/7 | 0/0 |
| 575 | PHE0001503 | PMON84706 | 1/8 | 0/4 |
| 577 | PHE0001505 | PMON75536 | 2/2 | 0/2 |
| 578 | PHE0001506 | PMON75537 | 1 | 0/0 |
| 581 | PHE0001509 | PMON75540 | 1/3 | 0/0 |
| 587 | PHE0001546 | PMON79717 | 3/6 | 1/6 |
| 588 | PHE0001547 | PMON79184 | 1/3 | 0/2 |
| 589 | PHE0001548 | PMON75547 | 6/6 | 2/6 |
| 600 | PHE0001583 | PMON84780 | 6/7 | 0/0 |
| 608 | PHE0001609 | PMON84709 | 7/7 | 1/7 |
| 611 | PHE0002019 | PMON84744 | 1/3 | 0/0 |
| 612 | PHE0002020 | PMON84769 | 9/9 | 5/9 |
| 613 | PHE0002021 | PMON80309 | 1/4 | 1/1 |
| 614 | PHE0002022 | PMON84753 | 2/3 | 0/0 |

Nitrogen Use Efficacy Field Assay

Transgenic plants of this invention and control plants are planted in field without any supplemental nitrogen being applied. Nitrogen levels in the fields are analyzed in early April pre-planting, e.g. by collecting 30 sample soil cores from 0-24" and 24 to 48" soil layer and analyzing for nitrate-nitrogen, phosphorus (P), potassium (K), organic matter and pH. P, K and micronutrients are applied based upon soil test recommendations. Recombinant DNA constructs which improved growth without any nitrogen source in transgenic plants is reported in Table 11.

TABLE 11

| NUC SEQ ID | PHE ID | Construct | Positive events/Total events screened | Confirmed events/Actual events with confirmation attempted |
|---|---|---|---|---|
| 166 | PHE0000593 | PMON68634 | 1/3 | 0/3 |
| 302 | PHE0000816 | PMON93867 | 2/3 | 0/0 |
| 560 | PHE0001401 | PMON84122 | 3/9 | 0/0 |
| 561 | PHE0001423 | PMON79672 | 1/5 | 0/0 |
| 608 | PHE0001609 | PMON84709 | 1/3 | 0/0 |
| 612 | PHE0002020 | PMON84769 | 2/9 | 0/0 |
| 614 | PHE0002022 | PMON84753 | 1/3 | 0/0 |

B. Selection for Increased Yield

Many transgenic plants with recombinant DNA of this invention in a chromosome in the nucleus of their cells exhibit improved yield as compared to a control plant. Recombinant DNA constructs which show improved yield or enhancement in a surrogate indicators for yield in transgenic corn plants is reported in Table 12. Useful surrogate indicators for yield include source capacity (biomass), source output (sucrose and photosynthesis), sink components (kernel size, ear size, starch in the seed), development (light response, height, density tolerance), maturity, early flowering trait and physiological responses to high density planting, e.g., at 45,000 plants per acre.

TABLE 12

| NUC SEQ ID | PHE ID | Construct | Positive events/Total events screened | Confirmed events/Actual events with confirmation attempted |
|---|---|---|---|---|
| 3 | PHE0000004 | PMON67819 | 1/7 | 0/3 |
| 4 | PHE0000005 | PMON67820 | 1/11 | 0/6 |
| 4 | PHE0000005 | PMON73601 | 1/2 | 0/1 |
| 8 | PHE0000078 | PMON77877 | 1/4 | 0/3 |
| 9 | PHE0000080 | PMON68366 | 1/3 | 0/2 |
| 22 | PHE0000372 | PMON72460 | 2/7 | 0/3 |
| 26 | PHE0000376 | PMON73154 | 1/3 | 0/1 |
| 43 | PHE0000459 | PMON68390 | 1/5 | 0/4 |
| 61 | PHE0000487 | PMON80267 | 1/4 | 0/4 |
| 66 | PHE0000492 | PMON69490 | 1/3 | 0/3 |
| 69 | PHE0000495 | PMON73763 | 1/3 | 0/1 |
| 91 | PHE0000517 | PMON72493 | 3/4 | 0/2 |
| 106 | PHE0000533 | PMON84135 | 1/6 | 0/0 |
| 108 | PHE0000535 | PMON68615 | 1/5 | 1/2 |
| 109 | PHE0000536 | PMON74447 | 1/7 | 0/1 |
| 138 | PHE0000565 | PMON69483 | 1/3 | 0/2 |
| 166 | PHE0000593 | PMON68634 | 1/5 | 0/3 |
| 178 | PHE0000611 | PMON68405 | 2/3 | 0/3 |
| 181 | PHE0000614 | PMON68632 | 1/8 | 0/3 |
| 190 | PHE0000623 | PMON74438 | 2/7 | 1/5 |
| 196 | PHE0000629 | PMON68631 | 1/5 | 0/1 |
| 219 | PHE0000654 | PMON68605 | 1/6 | 0/4 |
| 220 | PHE0000655 | PMON68607 | 1/12 | 1/8 |
| 221 | PHE0000656 | PMON80923 | 1/11 | 0/0 |
| 227 | PHE0000664 | PMON69471 | 1/4 | 0/3 |
| 237 | PHE0000709 | PMON68643 | 1/6 | 0/1 |
| 240 | PHE0000712 | PMON73753 | 1/7 | 0/3 |
| 242 | PHE0000714 | PMON68642 | 2/6 | 1/4 |
| 246 | PHE0000735 | PMON75481 | 1/3 | 0/2 |
| 254 | PHE0000743 | PMON71005 | 3/4 | 0/0 |
| 254 | PHE0000743 | PMON81215 | 1/9 | 0/6 |
| 259 | PHE0000748 | PMON75479 | 1/9 | 0/6 |
| 262 | PHE0000751 | PMON75321 | 1/4 | 0/3 |
| 296 | PHE0000810 | PMON75319 | 1/1 | 0/1 |
| 314 | PHE0000829 | PMON73800 | 1/1 | 0/1 |
| 352 | PHE0000867 | PMON75337 | 1/2 | 0/2 |
| 355 | PHE0000870 | PMON75340 | 1/1 | 0/1 |
| 425 | PHE0000944 | PMON76319 | 2/3 | 1/2 |
| 465 | PHE0000984 | PMON73809 | 1/2 | 0/2 |
| 467 | PHE0000986 | PMON80929 | 2/4 | 0/2 |
| 527 | PHE0001047 | PMON75318 | 1/6 | 0/1 |
| 548 | PHE0001194 | PMON78918 | 1/5 | 0/2 |
| 550 | PHE0001234 | PMON82646 | 1/6 | 0/0 |
| 574 | PHE0001502 | PMON80908 | 1/2 | 0/1 |
| 589 | PHE0001548 | PMON75547 | 1/6 | 0/4 |

C. Selection for Enhanced Water Use Efficiency (WUE)

Water use efficiency can be evaluated by high-throughput methods in greenhouse screening of potted corn plants. This selection process imposes 3 drought/re-water cycles on plants over a total period of 15 days after an initial stress free growth period of 11 days. Each cycle consists of 5 days, with no water being applied for the first four days and water quenching on the 5th day of the cycle. The primary phenotypes analyzed by the selection method are the changes in plant growth rate as determined by height and biomass during a vegetative drought treatment. The hydration status of the shoot tissues following the drought is also measured. The plant height are measured at three time points. The first is taken just prior to the onset drought when the plant is 11 days old, which is the shoot initial height (SIH). The plant height is also measured halfway throughout the drought/re-water regimen, on day 18 after planting, to give rise to the shoot mid-drought height (SMH). Upon the completion of the final drought cycle on day 26 after planting, the shoot portion of the plant is harvested and measured for a final height, which is the shoot wilt height (SWH) and also measured for shoot wilted biomass (SWM). The shoot is placed in water at 40 degrees Celsius in the dark. Three days later, the shoot is weighted to give rise to the shoot turgid weight (STM). After drying in an oven for four days, the shoots are weighted for shoot dry biomass (SDM). The shoot average height (SAH) is the mean plant height across the 3 height measurements.

To correct for slight differences between plants, a size corrected growth value is derived from SIH and SWH. This is the Relative Growth Rate (RGR). Relative Growth Rate (RGR) is calculated for each shoot using the formula [RGR %=(SWH−SIH)/((SWH+SIH)/2)*100]. Relative water content (RWC) is a measurement of how much (%) of the plant was water at harvest. Water Content (RWC) is calculated for each shoot using the formula [RWC %=(SWM−SDM)/(STM−SDM)*100]. Fully watered corn plants of this age run around 98% RWC. Transgenic plants with recombinant DNA constructs which provide improved water use efficiency in transgenic corn plants are reported in Table 15.

TABLE 15

| NUC SEQ ID | PHE ID | Construct | Positive events/Total events screened | Confirmed events/ Actual events with confirmation attempted |
|---|---|---|---|---|
| 3 | PHE0000004 | PMON67819 | 3/7 | 2/4 |
| 3 | PHE0000004 | PMON82452 | 6/11 | 0/0 |
| 4 | PHE0000004 | PMON67820 | 4/11 | 2/11 |
| 8 | PHE0000078 | PMON77877 | 1/1 | 0/0 |
| 9 | PHE0000080 | PMON68366 | 2/3 | 2/3 |
| 10 | PHE0000081 | PMON67814 | 3/6 | 3/6 |
| 13 | PHE0000113 | PMON68365 | 2/3 | 0/3 |
| 15 | PHE0000151 | PMON67822 | 2/4 | 0/2 |
| 21 | PHE0000367 | PMON72500 | 1/1 | 0/1 |
| 22 | PHE0000372 | PMON72460 | 5/8 | 0/7 |
| 23 | PHE0000373 | PMON73151 | 1/2 | 1/2 |
| 27 | PHE0000377 | PMON73155 | 1/1 | 0/1 |
| 29 | PHE0000379 | PMON72457 | 3/3 | 0/2 |
| 30 | PHE0000381 | PMON72469 | 1/4 | 0/4 |
| 34 | PHE0000406 | PMON67841 | 1/1 | 0/0 |
| 43 | PHE0000459 | PMON68390 | 2/5 | 0/5 |
| 44 | PHE0000460 | PMON73751 | 2/5 | 0/3 |
| 45 | PHE0000461 | PMON67829 | 2/2 | 1/2 |
| 54 | PHE0000477 | PMON68401 | 2/4 | 0/0 |
| 58 | PHE0000481 | PMON75472 | 1/7 | 0/0 |
| 62 | PHE0000488 | PMON75473 | 2/6 | 0/0 |
| 63 | PHE0000489 | PMON74432 | 1/5 | 0/5 |
| 72 | PHE0000498 | PMON76305 | 3/5 | 0/0 |
| 76 | PHE0000502 | PMON75474 | 2/9 | 0/0 |
| 81 | PHE0000507 | PMON69492 | 1/4 | 0/0 |
| 84 | PHE0000510 | PMON72491 | 2/2 | 0/2 |
| 86 | PHE0000512 | PMON74444 | 3/9 | 0/2 |
| 91 | PHE0000517 | PMON72493 | 1/4 | 0/3 |
| 108 | PHE0000535 | PMON68615 | 2/5 | 0/0 |
| 109 | PHE0000536 | PMON74447 | 2/5 | 0/0 |
| 124 | PHE0000551 | PMON74450 | 1/2 | 0/2 |
| 125 | PHE0000552 | PMON75460 | 1/2 | 0/2 |
| 132 | PHE0000559 | PMON74431 | 2/4 | 0/2 |
| 135 | PHE0000562 | PMON75303 | 7/9 | 0/0 |
| 137 | PHE0000564 | PMON68619 | 2/3 | 0/0 |
| 138 | PHE0000565 | PMON69483 | 1/3 | 0/0 |
| 139 | PHE0000566 | PMON75304 | 6/7 | 0/0 |
| 152 | PHE0000579 | PMON68623 | 1/4 | 0/1 |
| 155 | PHE0000582 | PMON75476 | 1/4 | 0/0 |
| 165 | PHE0000592 | PMON68639 | 1/4 | 0/4 |
| 166 | PHE0000593 | PMON68634 | 1/5 | 0/5 |
| 170 | PHE0000603 | PMON68626 | 1/6 | 0/0 |
| 177 | PHE0000610 | PMON75494 | 1/4 | 0/0 |
| 186 | PHE0000619 | PMON74435 | 2/3 | 0/3 |
| 188 | PHE0000621 | PMON75482 | 2/3 | 0/0 |
| 190 | PHE0000623 | PMON74438 | 2/7 | 0/0 |
| 212 | PHE0000645 | PMON68640 | 2/4 | 0/0 |
| 220 | PHE0000655 | PMON68607 | 4/13 | 0/6 |
| 221 | PHE0000656 | PMON80923 | 2/9 | 0/0 |
| 229 | PHE0000666 | PMON68398 | 2/10 | 0/0 |
| 234 | PHE0000704 | PMON76315 | 2/4 | 0/0 |
| 237 | PHE0000709 | PMON68643 | 4/6 | 1/6 |
| 240 | PHE0000712 | PMON73753 | 1/7 | 0/0 |
| 242 | PHE0000714 | PMON68642 | 1/6 | 0/0 |

TABLE 15-continued

| NUC SEQ ID | PHE ID | Construct | Positive events/Total events screened | Confirmed events/ Actual events with confirmation attempted |
|---|---|---|---|---|
| 243 | PHE0000715 | PMON68641 | 1/5 | 0/0 |
| 246 | PHE0000735 | PMON75481 | 1/3 | 0/0 |
| 252 | PHE0000741 | PMON80930 | 2/8 | 0/0 |
| 253 | PHE0000742 | PMON75478 | 2/2 | 0/2 |
| 254 | PHE0000743 | PMON81215 | 2/9 | 0/5 |
| 256 | PHE0000745 | PMON73776 | 2/4 | 0/0 |
| 259 | PHE0000748 | PMON75479 | 2/8 | 0/0 |
| 262 | PHE0000751 | PMON75321 | 1/4 | 0/0 |
| 268 | PHE0000762 | PMON75464 | 1/1 | 0/1 |
| 270 | PHE0000764 | PMON75465 | 3/4 | 0/0 |
| 278 | PHE0000772 | PMON75468 | 1/3 | 0/0 |
| 281 | PHE0000779 | PMON76307 | 1/4 | 0/0 |
| 285 | PHE0000799 | PMON75317 | 3/4 | 0/0 |
| 295 | PHE0000809 | PMON76311 | 1/7 | 0/0 |
| 313 | PHE0000828 | PMON75327 | 1/3 | 0/0 |
| 320 | PHE0000835 | PMON75344 | 2/7 | 0/0 |
| 330 | PHE0000845 | PMON76313 | 1/3 | 0/0 |
| 339 | PHE0000854 | PMON73795 | 1/4 | 0/2 |
| 340 | PHE0000855 | PMON75347 | 2/4 | 0/0 |
| 342 | PHE0000857 | PMON75348 | 2/6 | 0/4 |
| 348 | PHE0000863 | PMON75349 | 2/5 | 0/0 |
| 350 | PHE0000865 | PMON75336 | 1/5 | 0/0 |
| 352 | PHE0000867 | PMON75337 | 1/2 | 0/0 |
| 354 | PHE0000869 | PMON75339 | 1/2 | 0/0 |
| 356 | PHE0000871 | PMON75341 | 2/8 | 0/6 |
| 367 | PHE0000886 | PMON73804 | 1/2 | 1/1 |
| 369 | PHE0000888 | PMON73830 | 1/2 | 0/0 |
| 378 | PHE0000897 | PMON73833 | 2/5 | 0/0 |
| 394 | PHE0000913 | PMON78201 | 1/3 | 0/0 |
| 445 | PHE0000964 | PMON77867 | 2/3 | 0/0 |
| 454 | PHE0000973 | PMON73827 | 2/5 | 0/0 |
| 465 | PHE0000984 | PMON73809 | 1/2 | 0/1 |
| 476 | PHE0000995 | PMON77871 | 1/7 | 0/0 |
| 487 | PHE0001006 | PMON73814 | 1/2 | 0/0 |
| 499 | PHE0001019 | PMON73817 | 1/3 | 0/0 |
| 508 | PHE0001028 | PMON73823 | 2/5 | 0/0 |
| 524 | PHE0001044 | PMON77876 | 2/3 | 0/0 |
| 525 | PHE0001045 | PMON77872 | 1/7 | 0/0 |
| 527 | PHE0001047 | PMON75318 | 4/6 | 4/6 |
| 587 | PHE0001546 | PMON79717 | 1/6 | 0/0 |
| 589 | PHE0001548 | PMON75547 | 3/6 | 0/0 |
| 613 | PHE0002021 | PMON80309 | 1/5 | 0/0 |

D. Selection for Growth Under Cold Stress

Plants can be identified as having enhanced growth under cold stress by a cold germination assay using three sets of seeds. The first set consists of seeds that are F1 hybrids that are tested positive for the transgenic events and the recombinant DNA is expressed in the growing seed. The second set consists of control seeds, e.g. a nontransgenic, wild-type negative control made from the same genotype as the seeds in the first set. The third set consists of two cold tolerant and one cold sensitive commercial check lines of corn. All seeds are treated with a fungicide "Captan" (MAESTRO®80DF Fungicide, Arvesta Corporation, San Francisco, Calif., USA), e.g. 0.43 mL Captan is applied per 45 g of corn seeds by mixing it well and drying the fungicide prior to the assay.

Corn seeds are placed embryo side down in deionized water on blotter paper in a tray that is held at 9.7° C. for 24 days (no light) in a growth chamber. Germination counts are taken on days 10, 11, 12, 13, 14, 17, 19, 21, and 24. Seeds are considered germinated if the emerged radicle size is 1 cm. Tissue samples are collected at random on the last day of the experiment for confirmation of RNA expression. A germination index (GI) is calculated after the day 24 count using the formula:

$$GI = (\Sigma([T+1-n][P_i - P_{i-1}]))/T$$

where "T" is the number of days for the experiment, i.e. 24; "n" is the number of days after start on which a count is made; "P" is the percentage of seed germinated during a count; and "i" represents a particular count. Statistical differences are calculated between positive and wild type control.

Events of transgenic plants that showed a statistical significance at the p level of less than 0.05 relative to wild-type controls for improved seed growth under cold stress are reported in Table 16.

TABLE 16

| NUC SEQ ID | PHE ID | Construct | Positive events/Total events screened | Confirmed events/Actual events with confirmation attempted |
|---|---|---|---|---|
| 3 | PHE0000004 | PMON67819 | 1/5 | 1/1 |
| 4 | PHE0000005 | PMON67820 | 7/11 | 3/9 |
| 9 | PHE0000080 | PMON68366 | 1/3 | 0/2 |
| 10 | PHE0000081 | PMON67814 | 1/6 | 0/4 |
| 13 | PHE0000113 | PMON68365 | 2/5 | 0/4 |
| 22 | PHE0000372 | PMON72460 | 5/8 | 2/7 |
| 25 | PHE0000375 | PMON73153 | 1/2 | 0/1 |
| 27 | PHE0000377 | PMON73155 | 1/1 | 0/1 |
| 28 | PHE0000378 | PMON72461 | 1/2 | 1/1 |
| 29 | PHE0000379 | PMON72457 | 3/4 | 2/3 |
| 30 | PHE0000381 | PMON72469 | 3/4 | 2/3 |
| 43 | PHE0000459 | PMON68390 | 3/5 | 2/5 |
| 56 | PHE0000479 | PMON68402 | 6/9 | 4/8 |
| 58 | PHE0000481 | PMON75472 | 1/7 | 0/1 |
| 62 | PHE0000488 | PMON75473 | 4/6 | 3/4 |
| 65 | PHE0000491 | PMON72489 | 2/2 | 0/2 |
| 68 | PHE0000494 | PMON75459 | 1/6 | 0/0 |
| 76 | PHE0000502 | PMON75474 | 4/9 | 1/4 |
| 77 | PHE0000503 | PMON69493 | 3/5 | 1/5 |
| 81 | PHE0000507 | PMON69492 | 3/4 | 2/3 |
| 84 | PHE0000510 | PMON72491 | 1/2 | 0/2 |
| 86 | PHE0000512 | PMON74444 | 2/7 | 2/5 |
| 91 | PHE0000517 | PMON72493 | 1/3 | 0/3 |
| 97 | PHE0000524 | PMON69491 | 1/1 | 1/1 |
| 98 | PHE0000525 | PMON75497 | 1/2 | 0/0 |
| 102 | PHE0000529 | PMON69482 | 3/3 | 3/3 |
| 108 | PHE0000535 | PMON68615 | 2/5 | 0/2 |
| 109 | PHE0000536 | PMON74447 | 1/5 | 0/1 |
| 116 | PHE0000543 | PMON69499 | 1/5 | 1/4 |
| 120 | PHE0000547 | PMON76304 | 4/4 | 0/4 |
| 124 | PHE0000551 | PMON74450 | 1/2 | 0/1 |
| 125 | PHE0000552 | PMON75460 | 1/2 | 0/0 |
| 131 | PHE0000558 | PMON68637 | 2/3 | 0/3 |
| 134 | PHE0000561 | PMON68620 | 6/7 | 5/7 |
| 138 | PHE0000565 | PMON69483 | 6/10 | 3/10 |
| 139 | PHE0000566 | PMON75304 | 1/7 | 0/0 |
| 146 | PHE0000573 | PMON68624 | 2/3 | 2/2 |
| 151 | PHE0000578 | PMON69485 | 4/4 | 4/4 |
| 152 | PHE0000579 | PMON68623 | 3/4 | 3/3 |
| 153 | PHE0000580 | PMON68611 | 5/5 | 4/5 |
| 156 | PHE0000583 | PMON80926 | 1/4 | 0/4 |
| 157 | PHE0000584 | PMON68610 | 1/3 | 0/3 |
| 166 | PHE0000593 | PMON68634 | 4/5 | 3/4 |
| 170 | PHE0000603 | PMON68626 | 1/6 | 0/0 |
| 171 | PHE0000604 | PMON68625 | 3/3 | 0/0 |
| 176 | PHE0000609 | PMON74443 | 1/3 | 0/0 |
| 178 | PHE0000611 | PMON68405 | 1/4 | 0/0 |
| 188 | PHE0000621 | PMON73769 | 1/4 | 0/0 |
| 193 | PHE0000626 | PMON68406 | 1/2 | 0/2 |
| 196 | PHE0000629 | PMON68631 | 1/5 | 0/0 |
| 197 | PHE0000630 | PMON68648 | 3/5 | 3/3 |
| 202 | PHE0000635 | PMON68407 | 1/1 | 1/1 |
| 206 | PHE0000639 | PMON75457 | 1/4 | 0/2 |
| 219 | PHE0000654 | PMON68605 | 4/6 | 1/4 |
| 220 | PHE0000655 | PMON68607 | 2/12 | 1/10 |
| 221 | PHE0000656 | PMON82689 | 4/8 | 2/7 |
| 221 | PHE0000656 | PMON84137 | 1/6 | 0/6 |
| 222 | PHE0000658 | PMON68606 | 2/2 | 2/2 |
| 225 | PHE0000662 | PMON80944 | 2/5 | 1/5 |
| 229 | PHE0000666 | PMON68398 | 3/10 | 0/5 |
| 237 | PHE0000709 | PMON68643 | 1/6 | 0/0 |

TABLE 16-continued

| NUC SEQ ID | PHE ID | Construct | Positive events/Total events screened | Confirmed events/Actual events with confirmation attempted |
|---|---|---|---|---|
| 242 | PHE0000714 | PMON68642 | 3/6 | 0/0 |
| 243 | PHE0000715 | PMON68641 | 1/4 | 0/1 |
| 252 | PHE0000741 | PMON80930 | 3/7 | 0/7 |
| 256 | PHE0000745 | PMON73776 | 1/2 | 0/1 |
| 258 | PHE0000747 | PMON75480 | 1/2 | 0/0 |
| 259 | PHE0000748 | PMON75479 | 3/9 | 2/4 |
| 264 | PHE0000755 | PMON92853 | 3/7 | 2/7 |
| 265 | PHE0000756 | PMON77884 | 1/1 | 0/0 |
| 268 | PHE0000762 | PMON75464 | 1/1 | 1/1 |
| 270 | PHE0000764 | PMON75465 | 1/4 | 1/2 |
| 272 | PHE0000766 | PMON75466 | 1/1 | 0/0 |
| 277 | PHE0000771 | PMON84798 | 1/3 | 0/0 |
| 295 | PHE0000809 | PMON76311 | 4/8 | 2/6 |
| 299 | PHE0000813 | PMON75530 | 1/1 | 0/0 |
| 307 | PHE0000822 | PMON73799 | 1/2 | 0/0 |
| 320 | PHE0000835 | PMON75344 | 1/7 | 0/0 |
| 338 | PHE0000853 | PMON77893 | 1/2 | 0/0 |
| 340 | PHE0000855 | PMON75347 | 1/4 | 0/0 |
| 348 | PHE0000863 | PMON75349 | 1/5 | 0/0 |
| 350 | PHE0000865 | PMON75336 | 1/1 | 0/0 |
| 351 | PHE0000866 | PMON84970 | 1/7 | 0/0 |
| 354 | PHE0000869 | PMON75339 | 1/2 | 0/0 |
| 356 | PHE0000871 | PMON75341 | 1/1 | 0/0 |
| 358 | PHE0000873 | PMON79671 | 1/2 | 0/0 |
| 363 | PHE0000878 | PMON77852 | 1/1 | 0/0 |
| 366 | PHE0000885 | PMON77853 | 3/3 | 0/3 |
| 373 | PHE0000892 | PMON77864 | 1/1 | 0/0 |
| 387 | PHE0000906 | PMON73842 | 1/1 | 0/0 |
| 390 | PHE0000909 | PMON73845 | 1/3 | 0/0 |
| 425 | PHE0000944 | PMON76319 | 1/3 | 0/0 |
| 454 | PHE0000973 | PMON73827 | 1/5 | 0/0 |
| 455 | PHE0000974 | PMON77855 | 1/1 | 0/0 |
| 457 | PHE0000976 | PMON78912 | 1/2 | 0/0 |
| 459 | PHE0000978 | PMON77856 | 1/2 | 0/0 |
| 460 | PHE0000979 | PMON73849 | 1/1 | 0/0 |
| 461 | PHE0000980 | PMON77869 | 1/3 | 0/0 |
| 475 | PHE0000994 | PMON77870 | 1/1 | 0/0 |
| 485 | PHE0001004 | PMON77860 | 1/1 | 0/0 |
| 488 | PHE0001007 | PMON84742 | 4/5 | 2/4 |
| 518 | PHE0001038 | PMON75839 | 1/2 | 0/0 |
| 527 | PHE0001047 | PMON75318 | 2/13 | 2/12 |
| 540 | PHE0001173 | PMON80469 | 1/14 | 0/1 |
| 548 | PHE0001194 | PMON78918 | 4/5 | 1/5 |
| 561 | PHE0001423 | PMON79672 | 3/5 | 1/5 |
| 575 | PHE0001503 | PMON84706 | 5/7 | 5/7 |
| 577 | PHE0001505 | PMON75536 | 2/3 | 0/0 |
| 578 | PHE0001506 | PMON75537 | 1/1 | 0/0 |
| 587 | PHE0001546 | PMON79717 | 4/6 | 2/6 |
| 590 | PHE0001549 | PMON79185 | 1/1 | 0/0 |
| 598 | PHE0001580 | PMON79190 | 2/2 | 1/2 |
| 599 | PHE0001581 | PMON79191 | 1/4 | 0/1 |
| 600 | PHE0001583 | PMON84780 | 2/7 | 0/7 |
| 613 | PHE0002021 | PMON80309 | 3/5 | 0/4 |

Cold stress tolerance for corn plants of this invention is also determined by a field trial under early spring planting around two weeks prior to the time local farmers plant corn to identify recombinant DNA constructs that confer enhanced cold vigor at germination and early seedling growth under cold stress. The same seeds also are planted under local optimal planting conditions such that the crop has little or no exposure to cold condition (normal treatment). Early planting cold field trials were carried out at five locations, Glyndon Minn., Mason Mich., Monmouth Ill., Dayton Iowa and Mystic Conn. At each location seeds are planted under both early and local optimal planting times with 3 repetitions of 20 kernels in a single row in a plot. Seeds are planted 1.5 to 2 inch deep into soil to avoid muddy conditions. Two temperature monitors are set up at each location to monitor both air and soil temperature daily. Seed emergence is defined as the time when the growing shoot breaks the soil surface. The number of emerged seedling in each plot is counted daily from the day the earliest plot begins to emerge until no significant changes in emergence occur. Seedling vigor is also rated on a scale of 1 to 9 at the V3-V4 stage before the average of corn plant height reaches 10 inches, where 1 represents excellent early growth, 5 represents average growth and 9 represents poor growth. Days to 50% emergence, maximum percent emergence and seedling vigor are calculated. Corn plants having recombinant DNA constructs showing enhanced cold vigor at germination and early seedling growth under the early spring planting field conditions are reported in Table 17.

TABLE 17

| NUC SEQ ID | PHE ID | Construct | Positive events/Total events screened | Confirmed events/Actual events with confirmation attempted |
|---|---|---|---|---|
| 56 | PHE0000479 | PMON68402 | 2/6 | 0/0 |
| 62 | PHE0000488 | PMON75473 | 2/3 | 0/0 |
| 77 | PHE0000503 | PMON69493 | 2/3 | 0/0 |
| 102 | PHE0000529 | PMON69482 | 2/3 | 0/0 |
| 134 | PHE0000561 | PMON68620 | 1/5 | 0/0 |
| 138 | PHE0000565 | PMON69483 | 2/2 | 0/0 |
| 152 | PHE0000579 | PMON68623 | 3/4 | 0/0 |
| 153 | PHE0000580 | PMON68611 | 4/5 | 0/0 |
| 197 | PHE0000630 | PMON68648 | 2/4 | 0/0 |
| 222 | PHE0000658 | PMON68606 | 1/2 | 0/0 |
| 259 | PHE0000748 | PMON75479 | 2/2 | 0/0 |
| 295 | PHE0000809 | PMON76311 | 1/3 | 0/0 |

E. Screens for Transgenic Plant Seeds with Increased Protein and/or Oil Levels

Transgenic plants with recombinant DNA producing seed with increased protein and/or oil content are determined by analyzing harvested seed. For example, near-infrared transmittance spectrometry is used to determine the composition of a bulk seed samples by analyzing for multiple traits in a single scan. Typical analysis parameters are provided in Table 18.

TABLE 18

| | |
|---|---|
| Typical sample(s): | Whole grain corn and soybean seeds |
| Analytical time to run method: | Less than 0.75 min per sample |
| Total elapsed time per run: | 1.5 minute per sample |
| Typical and minimum sample size: | Corn typical: 50 cc; minimum 30 cc<br>Soybean typical: 50 cc; minimum 5 cc |
| Typical analytical range: | Determined in part by the specific calibration.<br>Corn - moisture 5-15%, oil 5-20%, protein 5-30%, starch 50-75%, and density 1.0-1.3%.<br>Soybean - moisture 5-15%, oil 15-25%, and protein 35-50%. |

Transgenic plants with recombinant DNA constructs which improve seed compositions in terms of protein content are reported in Table 19.

TABLE 19

| NUC SEQ ID | PHE ID | Construct | Positive events/Total events screened | Confirmed events/Actual events with confirmation attempted |
|---|---|---|---|---|
| 3 | PHE0000004 | PMON67819 | 1/7 | 0/0 |
| 4 | PHE0000005 | PMON67820 | 1/8 | 0/0 |

TABLE 19-continued

| NUC SEQ ID | PHE ID | Construct | Positive events/Total events screened | Confirmed events/Actual events with confirmation attempted |
|---|---|---|---|---|
| 8 | PHE0000078 | PMON77877 | 1/4 | 0/1 |
| 10 | PHE0000081 | PMON67814 | 2/5 | 0/0 |
| 13 | PHE0000113 | PMON68365 | 3/5 | 3/4 |
| 18 | PHE0000364 | PMON77882 | 1/2 | 0/0 |
| 22 | PHE0000372 | PMON72460 | 1/2 | 2/4 |
| 23 | PHE0000373 | PMON73151 | 1/3 | 0/0 |
| 25 | PHE0000375 | PMON73153 | 1/2 | 0/0 |
| 26 | PHE0000376 | PMON73154 | 2/3 | 0/1 |
| 29 | PHE0000379 | PMON72457 | 2/4 | 0/1 |
| 30 | PHE0000381 | PMON72469 | 2/4 | 0/0 |
| 32 | PHE0000384 | PMON68621 | 3/3 | 0/0 |
| 37 | PHE0000409 | PMON72496 | 1/2 | 0/0 |
| 43 | PHE0000459 | PMON68390 | 1/5 | 0/1 |
| 44 | PHE0000460 | PMON73751 | 1/5 | 0/0 |
| 56 | PHE0000479 | PMON68402 | 2/8 | 1/3 |
| 58 | PHE0000481 | PMON75472 | 1/7 | 1/1 |
| 61 | PHE0000487 | PMON80267 | 1/4 | 0/1 |
| 62 | PHE0000488 | PMON75473 | 1/6 | 0/0 |
| 63 | PHE0000489 | PMON74432 | 3/5 | 2/3 |
| 67 | PHE0000493 | PMON68403 | 1/6 | 0/1 |
| 68 | PHE0000494 | PMON75459 | 4/6 | 0/0 |
| 69 | PHE0000495 | PMON73763 | 1/3 | 0/1 |
| 73 | PHE0000499 | PMON72490 | 3/12 | 0/1 |
| 74 | PHE0000500 | PMON69495 | 1/2 | 1/1 |
| 76 | PHE0000502 | PMON75474 | 1/9 | 0/1 |
| 81 | PHE0000507 | PMON69492 | 1/4 | 0/0 |
| 86 | PHE0000512 | PMON74444 | 2/9 | 0/0 |
| 90 | PHE0000516 | PMON72492 | 1/3 | 0/0 |
| 91 | PHE0000517 | PMON72493 | 1/4 | 0/0 |
| 96 | PHE0000523 | PMON69487 | 1/1 | 0/0 |
| 97 | PHE0000524 | PMON69491 | 1/1 | 1/1 |
| 100 | PHE0000527 | PMON74446 | 1/1 | 0/0 |
| 102 | PHE0000529 | PMON69482 | 2/4 | 0/2 |
| 106 | PHE0000533 | PMON81274 | 1/2 | 0/0 |
| 108 | PHE0000535 | PMON68615 | 2/5 | 0/1 |
| 109 | PHE0000536 | PMON74447 | 1/7 | 0/1 |
| 112 | PHE0000539 | PMON74448 | 1/1 | 1/1 |
| 113 | PHE0000540 | PMON75451 | 2/4 | 0/0 |
| 115 | PHE0000542 | PMON68613 | 2/4 | 0/1 |
| 116 | PHE0000543 | PMON69499 | 2/5 | 0/0 |
| 120 | PHE0000547 | PMON76304 | 3/7 | 0/2 |
| 125 | PHE0000552 | PMON75460 | 1/2 | 0/0 |
| 131 | PHE0000558 | PMON68637 | 1/3 | 0/0 |
| 132 | PHE0000559 | PMON74431 | 2/3 | 1/4 |
| 134 | PHE0000561 | PMON68620 | 2/4 | 0/0 |
| 135 | PHE0000562 | PMON75303 | 1/5 | 0/0 |
| 137 | PHE0000564 | PMON68619 | 1/3 | 0/0 |
| 138 | PHE0000565 | PMON69483 | 1/3 | 0/2 |
| 139 | PHE0000566 | PMON75304 | 4/5 | 0/0 |
| 144 | PHE0000571 | PMON69484 | 2/4 | 0/0 |
| 146 | PHE0000573 | PMON68624 | 3/3 | 2/3 |
| 147 | PHE0000574 | PMON74442 | 1/2 | 0/0 |
| 151 | PHE0000578 | PMON69485 | 2/5 | 0/0 |
| 153 | PHE0000580 | PMON68611 | 3/5 | 0/4 |
| 157 | PHE0000584 | PMON68610 | 2/4 | 1/1 |
| 159 | PHE0000586 | PMON68618 | 1/1 | 1/1 |
| 165 | PHE0000592 | PMON68639 | 2/4 | 0/0 |
| 171 | PHE0000604 | PMON68625 | 1/6 | 0/0 |
| 176 | PHE0000609 | PMON74443 | 1/3 | 0/0 |
| 177 | PHE0000610 | PMON75494 | 2/4 | 1/1 |
| 178 | PHE0000611 | PMON68405 | 1/4 | 0/1 |
| 181 | PHE0000614 | PMON68632 | 3/8 | 0/2 |
| 186 | PHE0000619 | PMON74435 | 1/3 | 0/1 |
| 196 | PHE0000629 | PMON68631 | 1/5 | 0/0 |
| 198 | PHE0000631 | PMON75454 | 1/4 | 0/0 |
| 206 | PHE0000639 | PMON75457 | 3/5 | 0/0 |
| 212 | PHE0000645 | PMON68640 | 1/4 | 0/0 |
| 214 | PHE0000647 | PMON74437 | 1/2 | 0/2 |
| 216 | PHE0000649 | PMON78901 | 1/3 | 0/0 |
| 217 | PHE0000650 | PMON76303 | 1/2 | 1/2 |
| 219 | PHE0000654 | PMON68605 | 2/6 | 0/2 |
| 220 | PHE0000655 | PMON68607 | 7/12 | 0/23 |
| 221 | PHE0000656 | PMON80923 | 3/19 | 0/0 |
| 222 | PHE0000658 | PMON68606 | 1/2 | 0/1 |

TABLE 19-continued

| NUC SEQ ID | PHE ID | Construct | Positive events/Total events screened | Confirmed events/Actual events with confirmation attempted |
|---|---|---|---|---|
| 227 | PHE0000664 | PMON69471 | 1/8 | 1/1 |
| 229 | PHE0000666 | PMON68398 | 1/8 | 0/0 |
| 232 | PHE0000702 | PMON77883 | 3/4 | 1/2 |
| 234 | PHE0000704 | PMON76315 | 1/4 | 1/1 |
| 235 | PHE0000705 | PMON75516 | 1/1 | 0/0 |
| 237 | PHE0000709 | PMON68643 | 1/6 | 0/0 |
| 240 | PHE0000712 | PMON73753 | 3/7 | 2/4 |
| 242 | PHE0000714 | PMON68642 | 1/6 | 0/0 |
| 243 | PHE0000715 | PMON68641 | 2/5 | 1/1 |
| 244 | PHE0000716 | PMON68644 | 1/4 | 0/0 |
| 246 | PHE0000735 | PMON75481 | 1/3 | 0/0 |
| 252 | PHE0000741 | PMON80930 | 1/1 | 0/0 |
| 254 | PHE0000743 | PMON71005 | 1/12 | 0/0 |
| 257 | PHE0000746 | PMON73777 | 1/4 | 0/0 |
| 259 | PHE0000748 | PMON75479 | 4/9 | 0/0 |
| 262 | PHE0000751 | PMON75321 | 1/4 | 0/1 |
| 268 | PHE0000762 | PMON75464 | 1/1 | 0/0 |
| 269 | PHE0000763 | PMON75956 | 1/2 | 0/1 |
| 270 | PHE0000764 | PMON75465 | 2/4 | 0/3 |
| 280 | PHE0000774 | PMON75461 | 1/2 | 0/0 |
| 281 | PHE0000779 | PMON74489 | 1/19 | 0/0 |
| 288 | PHE0000802 | PMON76337 | 1/2 | 0/1 |
| 292 | PHE0000806 | PMON76308 | 2/4 | 1/1 |
| 295 | PHE0000809 | PMON76311 | 2/8 | 0/0 |
| 305 | PHE0000819 | PMON75324 | 1/3 | 0/0 |
| 307 | PHE0000822 | PMON73799 | 1/2 | 0/0 |
| 320 | PHE0000835 | PMON75344 | 2/5 | 0/0 |
| 321 | PHE0000836 | PMON75328 | 2/2 | 0/0 |
| 327 | PHE0000842 | PMON75329 | 1/2 | 0/0 |
| 342 | PHE0000857 | PMON75348 | 5/6 | 0/2 |
| 343 | PHE0000858 | PMON73797 | 1/6 | 0/0 |
| 344 | PHE0000859 | PMON73798 | 5/8 | 5/5 |
| 348 | PHE0000863 | PMON75349 | 2/5 | 0/0 |
| 350 | PHE0000865 | PMON75336 | 2/5 | 1/1 |
| 353 | PHE0000868 | PMON75338 | 1/4 | 0/0 |
| 355 | PHE0000870 | PMON75340 | 1/1 | 0/2 |
| 356 | PHE0000871 | PMON75341 | 1/4 | 0/3 |
| 366 | PHE0000885 | PMON77853 | 3/3 | 2/2 |
| 367 | PHE0000886 | PMON73804 | 1/2 | 0/0 |
| 369 | PHE0000888 | PMON73830 | 2/2 | 0/0 |
| 373 | PHE0000892 | PMON77864 | 1/1 | 0/1 |
| 374 | PHE0000893 | PMON73831 | 2/3 | 1/1 |
| 378 | PHE0000897 | PMON73833 | 1/5 | 0/0 |
| 386 | PHE0000905 | PMON77866 | 2/2 | 0/0 |
| 394 | PHE0000913 | PMON78201 | 2/3 | 1/1 |
| 421 | PHE0000940 | PMON76317 | 1/1 | 0/0 |
| 425 | PHE0000944 | PMON76319 | 1/3 | 0/0 |
| 436 | PHE0000955 | PMON76324 | 1/2 | 0/0 |
| 445 | PHE0000964 | PMON77867 | 1/3 | 0/0 |
| 452 | PHE0000971 | PMON73806 | 1/2 | 0/0 |
| 454 | PHE0000973 | PMON73827 | 1/5 | 0/0 |
| 457 | PHE0000976 | PMON78912 | 1/4 | 0/1 |
| 470 | PHE0000989 | PMON80515 | 1/7 | 0/1 |
| 471 | PHE0000990 | PMON77858 | 2/9 | 0/1 |
| 476 | PHE0000995 | PMON77871 | 1/8 | 0/1 |
| 482 | PHE0001001 | PMON77859 | 1/4 | 0/0 |
| 485 | PHE0001004 | PMON77860 | 1/1 | 0/0 |
| 487 | PHE0001006 | PMON73814 | 1/2 | 0/0 |
| 497 | PHE0001016 | PMON73815 | 1/2 | 0/0 |
| 499 | PHE0001019 | PMON73817 | 2/3 | 0/0 |
| 500 | PHE0001020 | PMON73818 | 1/1 | 0/0 |
| 524 | PHE0001044 | PMON77876 | 1/3 | 0/0 |
| 525 | PHE0001045 | PMON77872 | 5/7 | 1/1 |
| 527 | PHE0001047 | PMON75318 | 1/2 | 0/0 |
| 538 | PHE0001165 | PMON75513 | 1/2 | 0/0 |
| 540 | PHE0001173 | PMON80469 | 4/11 | 0/3 |
| 548 | PHE0001194 | PMON78918 | 3/5 | 1/1 |
| 550 | PHE0001234 | PMON82646 | 1/3 | 0/0 |
| 554 | PHE0001276 | PMON79652 | 1/2 | 0/0 |
| 561 | PHE0001423 | PMON79672 | 2/6 | 2/2 |
| 575 | PHE0001503 | PMON84706 | 2/8 | 0/1 |
| 577 | PHE0001505 | PMON75536 | 1/3 | 0/0 |
| 581 | PHE0001509 | PMON75540 | 1/3 | 2/2 |
| 589 | PHE0001548 | PMON75547 | 1/6 | 0/0 |
| 598 | PHE0001580 | PMON79190 | 1/3 | 0/1 |
| 599 | PHE0001581 | PMON79191 | 1/4 | 0/0 |
| 610 | PHE0002018 | PMON79677 | 1/3 | 0/0 |

Transgenic plants with recombinant DNA constructs which improve seed compositions in terms of oil content are reported in Table 20.

TABLE 20

| NUC SEQ ID | PHE ID | Construct | Positive events/Total events screened | Confirmed events/Actual events with confirmation attempted |
|---|---|---|---|---|
| 3 | PHE0000004 | PMON67819 | 1/3 | 0/0 |
| 4 | PHE0000005 | PMON67820 | 1/6 | 0/0 |
| 9 | PHE0000080 | PMON68366 | 1/2 | 0/0 |
| 13 | PHE0000113 | PMON68365 | 2/3 | 0/4 |
| 22 | PHE0000372 | PMON72460 | 2/4 | 1/4 |
| 29 | PHE0000379 | PMON72457 | 1/3 | 0/0 |
| 74 | PHE0000500 | PMON69495 | 1/1 | 0/0 |
| 120 | PHE0000547 | PMON76304 | 1/2 | 0/0 |
| 122 | PHE0000549 | PMON75974 | 1/1 | 0/0 |
| 132 | PHE0000559 | PMON74431 | 1/1 | 0/0 |
| 138 | PHE0000565 | PMON69483 | 1/2 | 0/0 |
| 155 | PHE0000582 | PMON75476 | 1/2 | 0/0 |
| 190 | PHE0000623 | PMON74438 | 1/2 | 0/0 |
| 220 | PHE0000655 | PMON68607 | 2/12 | 0/4 |
| 234 | PHE0000704 | PMON76315 | 1/1 | 0/0 |
| 240 | PHE0000712 | PMON73753 | 1/2 | 0/0 |
| 254 | PHE0000743 | PMON81215 | 1/2 | 0/0 |
| 296 | PHE0000810 | PMON75319 | 1/1 | 0/0 |
| 344 | PHE0000859 | PMON73798 | 1/6 | 0/0 |
| 366 | PHE0000885 | PMON77853 | 1/2 | 0/0 |
| 394 | PHE0000913 | PMON78201 | 1/1 | 0/0 |
| 457 | PHE0000976 | PMON78912 | 1/2 | 0/0 |
| 471 | PHE0000990 | PMON77858 | 1/3 | 0/0 |
| 540 | PHE0001173 | PMON80469 | 2/7 | 0/0 |
| 587 | PHE0001546 | PMON79717 | 2/3 | 0/0 |
| 589 | PHE0001548 | PMON75547 | 1/2 | 0/0 |

Example 8

Consensus Amino Acid Sequence

This example illustrates the identification of consensus amino acid sequences for the proteins encoded by recombinant DNA in transgenic seeds and plants disclosed herein and homologs.

ClustalW program was selected for multiple sequence alignments of the amino acid sequence of SEQ ID NO: 684, 704, 705, 706, 710, 719, 734, 735, 738, 743, 744, 745, 746, 761, 777, 779, 793, 804, 824, 891, 896, 900, 918, 924, 932, 957, 961, 1001, 1015, 1016, 1026, 1027, 1032, 1033, 1036, 1043, 1044, 1045, 1051, 1054, 1059, 1087, 1119, 1123, 1135, 1136, 1137, 1138, 1139, 1165, and their homologs. Three major factors affecting the sequence alignments dramatically are (1) protein weight matrices; (2) gap open penalty; (3) gap extension penalty. Protein weight matrices available for ClustalW program include Blosum, Pam and Gonnet series. Those parameters with gap open penalty and gap extension penalty were extensively tested. On the basis of the test results, Blosum weight matrix, gap open penalty of 10 and gap extension penalty of were chosen for multiple sequence alignment. FIG. 1 shows the consensus sequence of SEQ ID NO: 684 and its homologs. The symbols for consensus sequence are (1) uppercase letters for 100% identity in all positions of multiple sequence alignment output; (2) lowercase letters for >=70% identity; symbol; (3) "X" indicated <70% identity; (4) dashes "-" meaning that gaps were in ≥70% of the sequences.

The consensus amino acid sequence can be used to identify DNA corresponding to the full scope of this invention that is useful in providing transgenic plants, for example corn and soybean plants with enhanced agronomic traits, for example improved nitrogen use efficiency, improved yield, improved water use efficiency and/or improved growth under cold stress, due to the expression in the plants of DNA encoding a protein with amino acid sequence identical to the consensus amino acid sequence.

Example 9

Pfam Domain Module Annotation

This example illustrates the identification by Pfam analysis of domain and domain module in proteins encoded by recombinant DNA in the transgenic plants and seeds disclosed herein. The amino acid sequence of the expressed proteins that were shown to be associated with an enhanced trait were analyzed for Pfam protein family against the current Pfam collection of multiple sequence alignments and hidden Markov models using the HMMER software in the appended computer listing. The Pfam domain modules and individual protein domain for the proteins of SEQ ID NO: 615 through 1228 are shown in Table 21 and Table 22 respectively. The Hidden Markov model databases for the identified protein families are also in the appended computer listing allowing identification of other homologous proteins and their cognate encoding DNA to enable the full breadth of the invention for a person of ordinary skill in the art. Certain proteins are identified by a single Pfam domain and others by multiple Pfam domains. For instance, the protein with amino acids of SEQ ID NO: 668 is characterized by three Pfam domains, i.e., AdoHcyase, 2-Hacid_dh_C and AdoHcyase_NAD. See also the protein with amino acids of SEQ ID NO: 659 which is characterized by five copies of the Pfam domain "Arm". In Table 22 "score" is the gathering score for the Hidden Markov Model of the domain which exceeds the gathering cutoff reported in Table 23.

TABLE 21

| PEP SEQ ID | Pfam module | Position |
|---|---|---|
| 615 | CBFD_NFYB_HMF | 24-89 |
| 616 | CBFD_NFYB_HMF | 26-91 |
| 617 | CBFD_NFYB_HMF | 34-106 |
| 618 | CBFD_NFYB_HMF | 22-87 |
| 619 | Myb_DNA-binding | 24-69 |
| 620 | Globin | 7-147 |
| 621 | HEAT::HEAT::HEAT::FAT::Rapamycin_bind::PI3_PI4_kinase::FATC | 204-240::303-338::748-785::1463-1829::1934-2046::2113-2363::2472-2504 |
| 622 | P-II | 4-105 |
| 623 | AP2 | 143-208 |
| 624 | zf-C3HC4 | 196-237 |
| 625 | AUX_IAA | 21-196 |
| 626 | SET | 772-900 |
| 627 | SET | 739-867 |
| 628 | Pkinase | 34-319 |
| 629 | AdoHcyase | 12-484 |
| 630 | GAF::HisKA::HATPase_c | 159-308::344-409::456-587 |
| 631 | RRM_1 | 10-81 |
| 632 | DUF231 | 283-433 |
| 633 | DUF231 | 210-384 |
| 634 | DUF231 | 254-427 |
| 635 | DUF231 | 232-404 |
| 636 | AP2 | 88-152 |
| 637 | AUX_IAA | 4-155 |
| 638 | Myb_DNA-binding | 55-100 |
| 639 | WRKY | 164-224 |
| 640 | AP2 | 77-141 |
| 641 | bZIP_1 | 201-263 |
| 642 | AP2 | 36-100 |
| 643 | Myb_DNA-binding | 24-69 |
| 644 | Ribosomal_L18p | 27-173 |
| 645 | Cyclin_N | 4-144 |
| 646 | PB1 | 54-147 |
| 647 | PB1 | 46-136 |
| 648 | PB1 | 55-146 |
| 649 | PB1 | 58-148 |
| 650 | Pescadillo_N::BRCT | 8-286::352-429 |
| 651 | Pescadillo_N::BRCT | 4-285::355-436 |
| 652 | 2OG-FeII_Oxy | 176-281 |
| 653 | PI-PLC-X::PI-PLC-Y::C2 | 109-253::320-438::459-551 |
| 654 | C1_1::DAGK_cat::DAGK_acc | 139-200::347-476::493-650 |
| 655 | Exo_endo_phos | 109-538 |
| 656 | S6PP | 2-247 |
| 657 | S6PP::S6PP_C | 8-261::262-393 |

TABLE 21-continued

| PEP SEQ ID | Pfam module | Position |
|---|---|---|
| 658 | UDPGP | 29-441 |
| 659 | U-box::Arm::Arm::Arm::Arm | 256-329::383-423::424-464::465-505::506-546::547-587 |
| 660 | U-box | 29-102 |
| 661 | U-box::Arm::Arm::Arm | 270-342::398-441::442-483::526-567 |
| 662 | Prp19::WD40::WD40::WD40 | 64-133::253-291::298-336::384-421 |
| 663 | U-box | 5-78 |
| 664 | PfkB | 21-336 |
| 665 | PfkB | 24-340 |
| 666 | PfkB | 23-339 |
| 667 | PfkB | 23-323 |
| 668 | AdoHcyase | 12-484 |
| 669 | AdoHcyase | 6-448 |
| 670 | AdoHcyase_NAD | 192-353 |
| 671 | BRAP2::zf-C3HC4::zf-UBP | 51-161::168-207::219-290 |
| 672 | Cu-oxidase_3::Cu-oxidase::Cu-oxidase_2 | 28-145::169-374::469-606 |
| 673 | Glycos_transf_1::S6PP | 241-428::466-713 |
| 674 | Flavoprotein | 264-428 |
| 676 | Flavoprotein | 18-138 |
| 677 | Flavoprotein | 18-163 |
| 678 | IPP-2 | 7-148 |
| 679 | IPP-2 | 2-137 |
| 680 | Lactamase_B | 27-240 |
| 681 | Lactamase_B | 45-264 |
| 682 | Lactamase_B | 50-244 |
| 683 | Histone | 25-94 |
| 685 | zf-C3HC4 | 251-291 |
| 686 | Pkinase | 40-327 |
| 687 | Pkinase | 71-351 |
| 688 | Pkinase | 32-319 |
| 689 | Pkinase | 33-324 |
| 690 | Pkinase | 13-304 |
| 691 | Pkinase | 4-287 |
| 692 | Pkinase | 39-325 |
| 693 | Pkinase | 32-319 |
| 694 | WRKY | 199-259 |
| 695 | WRKY | 158-218 |
| 696 | PPDK_N::PEP-utilizers::PEP-utilizers_C | 100-460::511-601::613-971 |
| 697 | DUF580 | 187-539 |
| 698 | AA_permease | 59-525 |
| 699 | adh_short | 11-180 |
| 700 | adh_short | 15-187 |
| 701 | adh_short | 19-188 |
| 702 | adh_short | 18-186 |
| 703 | adh_short | 17-184 |
| 707 | VDE | 163-360 |
| 708 | SATase_N::Hexapep::Hexapep::Hexapep | 73-177::231-248::257-274::275-292 |
| 709 | SATase_N::Hexapep::Hexapep::Hexapep | 80-184::238-255::264-281::282-299 |
| 711 | NAS | 3-285 |
| 712 | NAS | 39-319 |
| 713 | OPT | 43-656 |
| 714 | Pyridoxal_deC | 33-381 |
| 715 | 2OG-FeII_Oxy | 190-321 |
| 716 | Mlo | 4-501 |
| 717 | G-alpha | 22-366 |
| 718 | WD40::WD40::WD40::WD40::WD40::WD40 | 8-47::65-103::107-145::155-195::199-237::288-326 |
| 720 | F-box::Tub | 53-108::119-406 |
| 721 | F-box::Tub | 34-90::101-358 |
| 722 | F-box::Tub | 51-106::117-448 |
| 723 | F-box::Tub | 45-100::111-367 |
| 724 | F-box::Tub | 73-128::139-436 |
| 725 | F-box::Tub | 48-103::114-401 |
| 726 | F-box::Tub | 58-113::124-456 |
| 727 | LRR_2 | 297-321 |
| 728 | F-box::LRR_1 | 15-63::168-190 |
| 729 | WD40::WD40 | 168-205::257-296 |
| 730 | Asp | 127-460 |
| 731 | Asp | 130-466 |
| 732 | AUX_IAA | 2-182 |
| 733 | LEA_4 | 5-48 |
| 736 | LEA_4 | 57-100 |
| 737 | TLC | 65-563 |
| 739 | Mito_carr::Mito_carr::Mito_carr | 22-119::126-222::226-316 |

TABLE 21-continued

| PEP SEQ ID | Pfam module | Position |
|---|---|---|
| 740 | PBP | 28-218 |
| 741 | PBP | 22-191 |
| 742 | Glycos_transf_1::S6PP | 452-635::676-930 |
| 747 | SRF-TF::K-box | 9-59::74-172 |
| 748 | SRF-TF::K-box | 9-59::73-173 |
| 749 | SBP56 | 24-493 |
| 750 | GST_N::GST_C | 4-79::108-203 |
| 751 | Pkinase::efhand::efhand::efhand::efhand | 93-351::398-426::434-462::470-498::504-532 |
| 752 | CK_II_beta | 87-260 |
| 753 | Zein | 1-234 |
| 754 | AP2 | 113-177 |
| 755 | MFMR::bZIP_1 | 1-156::244-308 |
| 756 | HMG_box | 41-110 |
| 757 | RRM_1 | 10-81 |
| 758 | Enolase_N::Enolase_C | 4-140::148-443 |
| 759 | zf-C3HC4 | 118-160 |
| 760 | Ribosomal_L10::Ribosomal_60s | 6-110::227-317 |
| 762 | SRF-TF::K-box | 9-59::75-166 |
| 763 | SRF-TF::K-box | 9-59::75-172 |
| 764 | SBP | 53-131 |
| 765 | adh_short | 18-218 |
| 766 | adh_short | 16-184 |
| 767 | PBP | 18-163 |
| 768 | PBP | 20-165 |
| 769 | PBP | 17-162 |
| 770 | FLO_LFY | 1-379 |
| 771 | zf-B_box::CCT | 14-60::193-231 |
| 772 | TLC | 91-587 |
| 773 | Ribosomal_L18p | 27-173 |
| 774 | Ribosomal_L18p | 27-173 |
| 775 | Ribosomal_L18p | 26-172 |
| 776 | Orn_Arg_deC_N::Orn_DAP_Arg_deC | 158-396::399-512 |
| 778 | UPF0005 | 28-237 |
| 780 | UPF0005 | 37-249 |
| 781 | zf-LSD1::Peptidase_C14 | 7-31::64-347 |
| 782 | Peptidase_C14 | 65-310 |
| 783 | Peptidase_C14 | 73-352 |
| 784 | Peptidase_C14 | 157-450 |
| 785 | Rieske::PaO | 116-225::325-432 |
| 786 | Rieske::PaO | 33-139::244-336 |
| 787 | SRF-TF::K-box | 9-59::69-169 |
| 788 | DAD | 11-133 |
| 789 | DAD | 3-114 |
| 790 | Pirin::Pirin_C | 91-188::244-356 |
| 791 | Aldedh | 18-487 |
| 792 | Aldedh | 18-488 |
| 794 | PEMT | 10-205 |
| 795 | Methyltransf_11::Methyltransf_11 | 69-167::298-394 |
| 796 | BCCT | 17-503 |
| 797 | BCCT | 19-505 |
| 798 | Na_H_Exchanger | 22-444 |
| 799 | Na_H_Exchanger | 24-443 |
| 800 | H_PPase | 6-748 |
| 801 | H_PPase | 9-752 |
| 802 | H_PPase | 6-751 |
| 803 | HD-ZIP_N::Homeobox::HALZ | 1-96::123-177::178-222 |
| 805 | bZIP_1 | 244-308 |
| 806 | zf-B_box::zf-B_box | 1-47::51-96 |
| 807 | AP2 | 62-126 |
| 808 | Response_reg::CCT | 26-142::628-666 |
| 809 | zf-B_box::zf-B_box::CCT | 17-64::65-107::308-346 |
| 810 | BTB::NPH3 | 20-119::181-443 |
| 811 | Myb_DNA-binding::Myb_DNA-binding | 14-61::67-112 |
| 812 | zf-B_box::zf-B_box | 1-47::52-99 |
| 813 | AP2::AP2 | 159-222::251-315 |
| 814 | Myb_DNA-binding | 24-69 |
| 815 | zf-CCCH::zf-CCCH::zf-CCCH::zf-CCCH::zf-CCCH | 39-65::84-110::130-156::287-313::333-359 |
| 816 | Pkinase | 7-262 |
| 817 | GH3 | 15-570 |
| 818 | PMEI | 33-207 |
| 819 | DPBB_1::Pollen_allerg_1 | 117-199::211-292 |
| 820 | DUF1313 | 23-112 |
| 821 | Cu_bind_like | 35-120 |

TABLE 21-continued

| PEP SEQ ID | Pfam module | Position |
|---|---|---|
| 822 | UPF0041 | 1-109 |
| 823 | MatE::MatE | 15-172::233-396 |
| 825 | DUF221 | 303-726 |
| 826 | Rieske::PaO | 219-316::407-501 |
| 827 | zf-LSD1::Peptidase_C14 | 18-42::80-363 |
| 828 | Myb_DNA-binding | 143-193 |
| 829 | Myb_DNA-binding | 138-188 |
| 830 | HLH | 192-242 |
| 831 | Glycos_transf_1::S6PP | 481-664::773-1047 |
| 832 | Glycos_transf_1::S6PP | 460-643::683-937 |
| 833 | U-box | 29-103 |
| 834 | U-box | 29-102 |
| 835 | Globin::FAD_binding_6::NAD_binding_1 | 6-131::154-253::263-373 |
| 836 | P-II | 4-105 |
| 837 | P-II | 78-180 |
| 838 | DUF231 | 310-483 |
| 839 | DXP_reductoisom::DXP_redisom_C | 81-209::223-306 |
| 840 | DXP_reductoisom::DXP_redisom_C | 5-134::148-231 |
| 841 | DXP_reductoisom::DXP_redisom_C | 11-138::152-235 |
| 842 | Transket_pyr::Transketolase_C | 392-559::573-696 |
| 843 | Transket_pyr::Transketolase_C | 318-485::497-620 |
| 844 | Transket_pyr::Transketolase_C | 354-520::532-648 |
| 845 | S-methyl_trans | 14-319 |
| 846 | S-methyl_trans | 24-328 |
| 847 | S-methyl_trans | 16-310 |
| 848 | S-methyl_trans | 17-322 |
| 849 | Histone | 33-107 |
| 850 | Histone | 19-92 |
| 851 | Histone | 29-102 |
| 852 | Histone | 28-101 |
| 853 | DUF231 | 364-540 |
| 854 | Flavodoxin_2 | 5-218 |
| 855 | MIF4G::MIF4G_like::MIF4G_like_2 | 9-228::304-467::483-770 |
| 856 | MIF4G::MIF4G_like::MIF4G_like_2 | 33-261::343-539::580-820 |
| 857 | RRM_1 | 36-107 |
| 858 | RRM_1 | 48-119 |
| 859 | Pyridoxal_deC | 87-361 |
| 860 | Pyridoxal_deC | 80-381 |
| 861 | Pyridoxal_deC | 110-412 |
| 862 | Pkinase::Pkinase_C | 177-477::495-549 |
| 863 | Pkinase::Pkinase_C | 169-469::487-541 |
| 864 | SRF-TF::K-box | 9-59::75-174 |
| 865 | SRF-TF::K-box | 9-59::76-173 |
| 866 | Myb_DNA-binding | 233-284 |
| 867 | Myb_DNA-binding | 244-294 |
| 868 | FBPase | 5-334 |
| 869 | RPE65 | 131-630 |
| 870 | RPE65 | 68-569 |
| 871 | AP2::AP2 | 289-362::391-456 |
| 872 | FBPase_glpX | 2-334 |
| 873 | FBPase_glpX | 2-334 |
| 874 | Glycos_transf_1 | 211-388 |
| 875 | Glycos_transf_1 | 211-388 |
| 876 | bZIP_1 | 87-151 |
| 877 | WRKY | 239-299 |
| 878 | zf-Dof | 53-115 |
| 879 | Myb_DNA-binding::Myb_DNA-binding | 15-62::68-113 |
| 880 | Myb_DNA-binding::Myb_DNA-binding | 15-62::68-113 |
| 881 | AP2 | 140-204 |
| 882 | HLH | 121-168 |
| 883 | AP2 | 12-77 |
| 884 | AP2 | May-69 |
| 885 | bZIP_2 | 213-267 |
| 886 | Myb_DNA-binding | 36-81 |
| 887 | bZIP_1 | 368-432 |
| 888 | G-alpha | 103-447 |
| 889 | PSK | 13-83 |
| 890 | PSK | 20-118 |
| 892 | PSK | 20-101 |
| 893 | Sugar_tr | 33-473 |
| 894 | MFS_1 | 63-548 |
| 895 | MFS_1 | 46-466 |
| 898 | Phytochrome::HisKA::HATPase_c | 48-227::237-302::349-486 |
| 899 | Hpt | 44-129 |

TABLE 21-continued

| PEP SEQ ID | Pfam module | Position |
|---|---|---|
| 901 | Hpt | 44-122 |
| 902 | Hpt | 30-112 |
| 903 | GAF::HisKA::HATPase_c | 158-307::343-408::455-586 |
| 904 | GAF::HisKA::HATPase_c | 159-308::344-409::456-586 |
| 905 | p450 | 45-523 |
| 906 | Sugar_tr | 32-472 |
| 907 | AP2 | 131-196 |
| 908 | AP2 | 17-81 |
| 909 | AP2 | 17-82 |
| 910 | DUF6::DUF6 | 115-233::253-394 |
| 911 | TPT | 183-335 |
| 912 | TPT | 231-379 |
| 913 | DUF6::DUF6 | 24-157::204-333 |
| 914 | DUF6::DUF6 | 19-146::198-326 |
| 915 | DUF6::DUF6 | 21-154::198-328 |
| 916 | DUF6::DUF6 | 26-160::202-333 |
| 917 | DUF6::DUF6 | 28-161::202-331 |
| 919 | TPT | 156-298 |
| 920 | DUF6::DUF6 | 22-155::201-330 |
| 921 | DUF6::DUF6 | 26-159::205-334 |
| 922 | DUF914 | 1-328 |
| 923 | HEAT::HEAT::HEAT::HEAT::HEAT::HEAT::HEAT | 22-57::97-133::181-217::218-253::259-295::341-376::381-416 |
| 925 | DUF6 | 22-154 |
| 926 | TPT | 167-307 |
| 927 | DUF6 | 15-148 |
| 928 | DUF6::DUF6 | 27-160::201-330 |
| 929 | DUF6::DUF6 | 128-252::277-407 |
| 930 | TPT | 156-299 |
| 931 | DUF914 | 2-327 |
| 933 | DUF6::DUF6 | 31-164::215-344 |
| 934 | TPT | 156-300 |
| 935 | DUF6::DUF6 | 16-149::193-322 |
| 936 | TPT | 163-303 |
| 937 | TPT | 200-344 |
| 938 | Pkinase | 504-777 |
| 939 | B_lectin::PAN_2::Pkinase | 81-189::322-387::470-736 |
| 940 | B_lectin::PAN_2::Pkinase | 80-187::326-391::473-742 |
| 941 | B_lectin::PAN_2::Pkinase | 110-225::360-425::507-776 |
| 942 | B_lectin::PAN_2::Pkinase | 67-176::311-373::450-718 |
| 943 | B_lectin::S_locus_glycop::PAN_2::PAN_1::Pkinase | 74-188::202-333::350-415::362-433::499-784 |
| 944 | B_lectin::S_locus_glycop::PAN_2::Pkinase | 75-199::212-340::357-425::506-790 |
| 945 | PAN_1::Pkinase | 336-417::500-770 |
| 946 | 14-3-3 | 6-243 |
| 947 | 14-3-3 | 6-117 |
| 948 | 14-3-3 | 8-120 |
| 949 | 14-3-3 | 3-240 |
| 950 | 14-3-3 | 3-115 |
| 951 | 14-3-3 | 9-246 |
| 952 | 14-3-3 | 9-120 |
| 953 | 14-3-3 | 5-240 |
| 954 | 14-3-3 | 5-116 |
| 955 | 14-3-3 | 7-116 |
| 956 | 14-3-3 | 4-239 |
| 958 | 14-3-3 | 8-245 |
| 959 | 14-3-3 | 8-120 |
| 960 | 14-3-3 | 8-245 |
| 962 | 14-3-3 | 8-249 |
| 963 | 14-3-3 | 8-125 |
| 964 | G-alpha | 431-841 |
| 965 | Pkinase | 40-363 |
| 966 | Pkinase | 117-402 |
| 967 | Pkinase | 34-319 |
| 968 | CK_II_beta | 93-267 |
| 969 | CK_II_beta | 26-233 |
| 970 | CK_II_beta | 89-263 |
| 971 | CK_II_beta | 87-260 |
| 972 | RRM_1 | 10-81 |
| 973 | RRM_1::zf-CCHC | 9-80::128-145 |
| 974 | RRM_1 | 39-110 |
| 975 | RRM_1 | 33-104 |
| 976 | Methyltransf_11 | 63-162 |
| 977 | Methyltransf_11 | 85-184 |
| 978 | Methyltransf_11 | 70-169 |
| 979 | RRM_1 | 10-81 |

TABLE 21-continued

| PEP SEQ ID | Pfam module | Position |
|---|---|---|
| 980 | zf-C3HC4 | 253-293 |
| 981 | zf-C3HC4 | 190-230 |
| 982 | zf-C3HC4 | 234-274 |
| 983 | zf-C3HC4 | 221-261 |
| 984 | zf-C3HC4 | 156-196 |
| 985 | zf-C3HC4 | 218-258 |
| 986 | zf-C3HC4 | 94-135 |
| 987 | zf-C3HC4 | 204-245 |
| 988 | zf-C3HC4 | 126-169 |
| 989 | PA::zf-C3HC4 | 51-149::237-278 |
| 990 | zf-C3HC4 | 87-128 |
| 991 | zf-C3HC4 | 607-647 |
| 992 | zf-C3HC4 | 467-507 |
| 993 | zf-C3HC4 | 155-195 |
| 994 | zf-C3HC4 | 127-167 |
| 995 | zf-C3HC4 | 33-73 |
| 996 | Skp1_POZ::Skp1 | 5-65::91-168 |
| 997 | Skp1 | 90-164 |
| 998 | Skp1_POZ::Skp1 | 8-68::99-176 |
| 999 | LRR_2::LRR_2 | 174-201::301-325 |
| 1000 | F-box::LRR_1 | 15-63::168-190 |
| 1001 | F-box::LRR_2 | 17-64::299-323 |
| 1003 | Response_reg | 42-177 |
| 1004 | zf-CHY::zf-C3HC4 | 35-113::166-208 |
| 1005 | zf-CHY::zf-C3HC4 | 59-142::195-237 |
| 1006 | MtN3_slv::MtN3_slv | 9-98::132-218 |
| 1007 | zf-C3HC4 | 215-256 |
| 1008 | PHD | 198-248 |
| 1009 | F-box | 17-64 |
| 1010 | F-box | 22-69 |
| 1011 | F-box::Kelch_1::Kelch_1::Kelch_1 | 9-56::97-153::155-201::285-339 |
| 1012 | F-box::Kelch_1::Kelch_1 | 76-123::167-213::215-262 |
| 1013 | F-box::Kelch_1::Kelch_1 | 26-73::116-162::164-210 |
| 1014 | zf-C3HC4 | 49-91 |
| 1017 | Prp19::WD40::WD40::WD40 | 64-133::253-291::298-336::384-421 |
| 1018 | zf-C3HC4 | 36-81 |
| 1019 | zf-C3HC4 | 58-103 |
| 1020 | TPR_1::TPR_1::TPR_2::U-box | 14-47::48-81::82-115::195-269 |
| 1021 | zf-C3HC4 | 24-64 |
| 1022 | F-box::Kelch_1::Kelch_2::Kelch_1::Kelch_2::Kelch_2 | 195-243::292-340::345-392::397-445::449-501::516-564 |
| 1023 | F-box::Kelch_1::Kelch_2::Kelch_1::Kelch_2::Kelch_2 | 205-253::300-348::353-400::405-453::458-509::518-566 |
| 1024 | Cellulose_synt | 167-977 |
| 1025 | Cellulose_synt | 254-1069 |
| 1028 | zf-C3HC4 | 22-64 |
| 1029 | F-box::LysM | 32-79::109-152 |
| 1030 | Sina | 121-320 |
| 1031 | F-box | 18-65 |
| 1034 | F-box | 18-66 |
| 1035 | SPX::zf-C3HC4 | 1-167::238-286 |
| 1037 | Cullin | 15-237 |
| 1038 | zf-C3HC4 | 227-270 |
| 1039 | zf-C3HC4 | 361-398 |
| 1040 | Melibiase | 34-362 |
| 1041 | Copine | 80-227 |
| 1042 | F-box | 36-83 |
| 1046 | F-box::LRR_2 | 1-47::150-174 |
| 1047 | F-box | 11-59 |
| 1048 | U-box | 5-78 |
| 1049 | Glycos_transf_1::S6PP | 465-648::701-942 |
| 1050 | Pkinase::Ribonuc_2-5A | 491-759::764-890 |
| 1052 | Pkinase::Ribonuc_2-5A | 77-345::350-476 |
| 1053 | Pkinase::Ribonuc_2-5A | 674-980::985-1115 |
| 1055 | Pkinase::Ribonuc_2-5A | 101-407::412-542 |
| 1056 | dCMP_cyt_deam_1 | 218-319 |
| 1057 | Aldo_ket_red | 7-285 |
| 1058 | Aldo_ket_red | 5-292 |
| 1060 | SOH1 | 18-112 |
| 1061 | dCMP_cyt_deam_1 | 1-107 |
| 1062 | Put_Phosphatase | 4-229 |
| 1063 | NAF1 | 104-273 |
| 1064 | Aldo_ket_red | 10-289 |
| 1065 | Glutaredoxin | 19-85 |

TABLE 21-continued

| PEP SEQ ID | Pfam module | Position |
|---|---|---|
| 1066 | TPT | 156-299 |
| 1067 | DUF850 | 2-230 |
| 1068 | LEA_2 | 17-166 |
| 1069 | ABA_WDS | 43-96 |
| 1070 | ABA_WDS | 51-104 |
| 1071 | LEA_2 | 30-179 |
| 1072 | LEA_2 | 30-179 |
| 1073 | ABA_WDS | 54-107 |
| 1074 | Sigma70_r2::Sigma70_r3::Sigma70_r4 | 260-330::334-414::433-485 |
| 1075 | Sigma70_r2::Sigma70_r3::Sigma70_r4 | 314-384::388-469::482-535 |
| 1076 | Sigma70_r2::Sigma70_r3::Sigma70_r4 | 302-372::376-457::469-522 |
| 1077 | Bromodomain | 61-150 |
| 1078 | Homeobox::HALZ | 70-124::125-169 |
| 1079 | bZIP_1 | 118-179 |
| 1080 | MFMR::bZIP_1 | 1-156::244-308 |
| 1081 | Remorin_C | 402-512 |
| 1082 | Remorin_N::Remorin_C | 23-83::85-194 |
| 1083 | Myb_DNA-binding | 39-90 |
| 1084 | Homeobox::HALZ | 77-131::132-176 |
| 1085 | Homeobox::HALZ | 77-131::132-176 |
| 1086 | HSF_DNA-bind | 11-170 |
| 1088 | HSF_DNA-bind | 13-167 |
| 1089 | HSF_DNA-bind | 15-219 |
| 1090 | AUX_IAA | 18-218 |
| 1091 | AUX_IAA | 19-219 |
| 1092 | SRF-TF::K-box | 9-59::48-144 |
| 1093 | SRF-TF::K-box | 9-59::75-174 |
| 1094 | SRF-TF::K-box | 9-59::73-173 |
| 1095 | SRF-TF::K-box | 9-59::71-170 |
| 1096 | SRF-TF::K-box | 9-59::76-173 |
| 1097 | SRF-TF::K-box | 9-59::71-170 |
| 1098 | SRF-TF::K-box | 9-59::75-174 |
| 1099 | zf-C2H2 | 35-58 |
| 1100 | LIM::LIM | 10-67::105-162 |
| 1101 | Myb_DNA-binding::Linker_histone | 5-57::122-190 |
| 1102 | Myb_DNA-binding::Myb_DNA-binding | 14-61::67-112 |
| 1103 | Myb_DNA-binding::Myb_DNA-binding | 11-57::63-108 |
| 1104 | Myb_DNA-binding::Myb_DNA-binding | 14-61::67-112 |
| 1105 | NAM | 23-158 |
| 1106 | MED7 | 4-169 |
| 1107 | zf-LSD1::zf-LSD1::zf-LSD1 | 27-51::66-90::104-128 |
| 1108 | Hydrolase | 18-209 |
| 1109 | zf-C3HC4 | 349-389 |
| 1110 | zf-C3HC4 | 244-284 |
| 1111 | zf-CHY::zf-C3HC4 | 35-113::166-208 |
| 1112 | Ank::Ank::Ank::Ank::Ank::zf-C3HC4 | 50-82::83-115::117-148::180-212::223-255::321-370 |
| 1113 | zf-B_box::zf-B_box::CCT | 1-47::48-90::356-394 |
| 1114 | GRAS | 154-464 |
| 1115 | TFIIS::TFIIS_M::TFIIS_C | 1-93::189-317::328-366 |
| 1116 | zf-B_box::zf-B_box | 1-47::55-102 |
| 1117 | Copine | 111-259 |
| 1118 | Copine | 111-259 |
| 1120 | zf-CCCH::zf-CCCH::KH_1::zf-CCCH | 35-61::95-121::246-310::324-349 |
| 1121 | AUX_IAA | 7-222 |
| 1122 | zf-B_box::zf-B_box | 1-47::51-96 |
| 1123 | SRF-TF::K-box | 9-59::75-174 |
| 1124 | SRF-TF::K-box | 9-59::75-174 |
| 1125 | SRF-TF::K-box | 9-59::75-174 |
| 1126 | SRF-TF::K-box | 9-59::75-174 |
| 1127 | SRF-TF::K-box | 9-59::75-174 |
| 1128 | SRF-TF::K-box | 9-59::75-174 |
| 1129 | FLO_LFY | 1-395 |
| 1130 | Hydrolase | 114-295 |
| 1131 | Hydrolase | 130-317 |
| 1132 | Hydrolase | 110-298 |
| 1133 | AP2 | 15-80 |
| 1140 | Pkinase::NAF | 20-275::314-374 |
| 1141 | WD40::WD40 | 560-599::646-683 |
| 1142 | Pkinase | 139-401 |
| 1143 | EMP24_GP25L | 76-137 |
| 1144 | RRM_1::zf-CCHC | 4-70::86-103 |
| 1145 | Frigida | 112-414 |
| 1146 | DUF810 | 175-1046 |

TABLE 21-continued

| PEP SEQ ID | Pfam module | Position |
|---|---|---|
| 1147 | Dor1 | 21-369 |
| 1148 | Alpha-amylase::Alpha-amyl_C2 | 26-356::357-415 |
| 1149 | AT_hook::DUF296 | 99-111::126-246 |
| 1150 | IMPDH | 23-491 |
| 1151 | IMPDH | 35-512 |
| 1152 | IMPDH | 7-473 |
| 1153 | IMPDH | 12-486 |
| 1154 | zf-CCCH::zf-CCCH::KH_1::zf-CCCH | 38-64::105-131::174-236::274-299 |
| 1155 | Response_reg::Myb_DNA-binding | 21-134::214-264 |
| 1156 | zf-C3HC4 | 251-291 |
| 1157 | MFS_1 | 129-549 |
| 1158 | Sugar_tr | 34-472 |
| 1159 | AP2 | 15-80 |
| 1160 | AP2 | 7-72 |
| 1161 | Pyridoxal_deC | 35-383 |
| 1162 | AUX_IAA | 7-263 |
| 1163 | Cyclin_N::Cyclin_C | 92-207::209-336 |
| 1164 | Cyclin_N | 183-321 |
| 1166 | zf-Dof | 105-167 |
| 1167 | NAM | 52-179 |
| 1168 | NAM | 18-145 |
| 1169 | p450 | 41-477 |
| 1170 | LRRNT_2::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::Pkinase | 23-63::90-112::114-136::162-184::186-208::234-256::258-280::282-304::306-328::354-376::402-425::448-470::472-494::519-541::543-565::567-589::591-613::615-638::748-771::772-791::824-846::848-870::1002-1275 |
| 1171 | LRRNT_2::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::Pkinase | 21-60::139-158::185-207::209-231::233-255::259-281::283-306::308-330::332-354::357-379::381-403::429-451::453-475::477-499::501-520::593-615::617-639::641-663::824-1098 |
| 1172 | LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::Pkinase | 199-219::221-244::246-268::270-293::295-317::319-342::345-367::369-391::393-415::417-439::441-463::465-487::489-511::582-604::630-652::653-674::807-1080 |
| 1173 | FAD_binding_4 | 55-200 |
| 1174 | FAD_binding_4 | 55-200 |
| 1175 | Sterol_desat | 35-210 |
| 1176 | Sterol_desat | 35-246 |
| 1177 | Sterol_desat | 37-248 |
| 1178 | Sterol_desat | 43-254 |
| 1179 | Peptidase_S10 | 41-465 |
| 1180 | Peptidase_S10 | 56-474 |
| 1181 | F-box::Kelch_2::Kelch_2::Kelch_1::Kelch_2 | 205-253::300-348::353-400::405-453::524-572 |
| 1182 | F-box::Kelch_1::Kelch_2::Kelch_1::Kelch_2::Kelch_2 | 272-320::367-415::420-467::472-520::525-576::586-634 |
| 1183 | ADH_N::ADH_zinc_N | 36-165::196-342 |
| 1184 | ADH_N::ADH_zinc_N | 27-155::186-332 |
| 1185 | ADH_N::ADH_zinc_N | 27-155::186-328 |
| 1186 | ADH_N::ADH_zinc_N | 36-165::196-338 |
| 1187 | ADH_N::ADH_zinc_N | 36-165::196-338 |
| 1188 | ADH_N::ADH_zinc_N | 35-163::197-343 |
| 1189 | ADH_N::ADH_zinc_N | 34-163::194-336 |
| 1190 | ADH_N::ADH_zinc_N | 34-163::194-336 |
| 1191 | TPT | 156-298 |
| 1192 | TPT | 154-296 |
| 1193 | TPT | 151-293 |
| 1194 | Sugar_tr | 91-552 |
| 1195 | Cyclin_N::Cyclin_C | 61-193::195-326 |
| 1196 | SAC3_GANP | 24-209 |
| 1197 | SAC3_GANP | 20-211 |
| 1198 | SAC3_GANP | 24-209 |
| 1199 | SAC3_GANP | 24-209 |
| 1200 | WD40::WD40 | 183-220::289-328 |
| 1201 | WD40::WD40 | 204-241::311-350 |
| 1202 | CHASE::HisKA::HATPase_c::Response_reg | 86-298::359-424::471-654::829-963 |
| 1203 | CHASE::HisKA::HATPase_c::Response_reg | 198-411::472-537::584-759::945-1068 |

TABLE 21-continued

| PEP SEQ ID | Pfam module | Position |
|---|---|---|
| 1204 | CHASE::HisKA::HATPase_c::Response_reg | 302-526::587-652::699-866::1035-1170 |
| 1205 | CHASE::HisKA::HATPase_c::Response_reg | 163-389::450-515::562-722::890-1025 |
| 1206 | MFS_1 | 66-429 |
| 1207 | MFS_1 | 69-432 |
| 1208 | MFS_1 | 51-415 |
| 1209 | CHASE::HisKA::HATPase_c::Response_reg | 110-321::382-447::494-682::869-1004 |
| 1210 | PTR2 | 113-517 |
| 1211 | PTR2 | 118-521 |
| 1212 | PTR2 | 97-499 |
| 1213 | PTR2 | 122-526 |
| 1214 | PTR2 | 98-500 |
| 1215 | AT_hook::DUF296 | 34-46::61-180 |
| 1220 | BIR::BIR | 20-117::153-241 |
| 1221 | AT_hook::DUF296 | 34-46::61-180 |
| 1224 | Bap31 | 1-188 |

TABLE 22

| PEP SEQ ID | Pfam domain | Start | End | score | E-value |
|---|---|---|---|---|---|
| 615 | CBFD_NFYB_HMF | 24 | 89 | 126.8 | 5.90E-35 |
| 616 | CBFD_NFYB_HMF | 26 | 91 | 130.9 | 3.50E-36 |
| 617 | CBFD_NFYB_HMF | 34 | 106 | 117.8 | 3.10E-32 |
| 618 | CBFD_NFYB_HMF | 22 | 87 | 131 | 3.40E-36 |
| 619 | Myb_DNA-binding | 24 | 69 | 54.5 | 3.50E-13 |
| 620 | Globin | 7 | 147 | 127.6 | 3.50E-35 |
| 621 | HEAT | 204 | 240 | 23.5 | 7.80E-04 |
| 621 | HEAT | 303 | 338 | 11.6 | 1.60E+00 |
| 621 | HEAT | 748 | 785 | 17.7 | 4.20E-02 |
| 621 | FAT | 1463 | 1829 | 498.6 | 7.00E-147 |
| 621 | Rapamycin_bind | 1934 | 2046 | 187.1 | 4.40E-53 |
| 621 | PI3_PI4_kinase | 2113 | 2363 | 365.6 | 7.80E-107 |
| 621 | FATC | 2472 | 2504 | 44.7 | 3.10E-10 |
| 622 | P-II | 4 | 105 | 244 | 3.10E-70 |
| 623 | AP2 | 143 | 208 | 145.4 | 1.50E-40 |
| 624 | zf-C3HC4 | 196 | 237 | 19.6 | 1.50E-03 |
| 625 | AUX_IAA | 21 | 196 | 2.8 | 1.20E-09 |
| 626 | SET | 772 | 900 | 157.6 | 3.20E-44 |
| 627 | SET | 739 | 867 | 157.6 | 3.20E-44 |
| 628 | Pkinase | 34 | 319 | 302.5 | 7.70E-88 |
| 629 | AdoHcyase | 12 | 484 | 826.2 | 1.70E-245 |
| 629 | 2-Hacid_dh_C | 219 | 399 | -77 | 1.30E-03 |
| 629 | AdoHcyase_NAD | 240 | 403 | 393.3 | 3.60E-115 |
| 630 | GAF | 159 | 308 | 98.7 | 1.70E-26 |
| 630 | HisKA | 344 | 409 | 87.6 | 3.80E-23 |
| 630 | HATPase_c | 456 | 587 | 131.8 | 2.00E-36 |
| 631 | RRM_1 | 10 | 81 | 108.2 | 4.20E-29 |
| 632 | DUF231 | 283 | 433 | 139.3 | 1.10E-38 |
| 633 | DUF231 | 210 | 384 | 210.9 | 2.90E-60 |
| 634 | DUF231 | 254 | 427 | 265.7 | 9.50E-77 |
| 635 | DUF231 | 232 | 404 | 99.1 | 1.30E-26 |
| 636 | AP2 | 88 | 152 | 147.9 | 2.70E-41 |
| 637 | AUX_IAA | 4 | 155 | 28.5 | 1.80E-11 |
| 638 | Myb_DNA-binding | 55 | 100 | 58 | 3.20E-14 |
| 639 | WRKY | 164 | 224 | 139.9 | 7.00E-39 |
| 640 | AP2 | 77 | 141 | 142.7 | 1.00E-39 |
| 641 | bZIP_2 | 199 | 253 | 29.9 | 8.90E-06 |
| 641 | bZIP_1 | 201 | 263 | 31.2 | 3.70E-06 |
| 642 | AP2 | 36 | 100 | 148 | 2.50E-41 |
| 643 | Myb_DNA-binding | 24 | 69 | 54.2 | 4.20E-13 |
| 644 | Ribosomal_L18p | 27 | 173 | 263.6 | 3.90E-76 |
| 645 | Cyclin_N | 4 | 144 | 47.9 | 3.50E-11 |
| 646 | PB1 | 54 | 147 | 103 | 9.00E-28 |
| 647 | PB1 | 46 | 136 | 91.6 | 2.50E-24 |
| 648 | PB1 | 55 | 146 | 90.6 | 4.90E-24 |
| 649 | PB1 | 58 | 148 | 92.7 | 1.10E-24 |
| 650 | Pescadillo_N | 8 | 286 | 523.1 | 3.10E-154 |
| 650 | BRCT | 352 | 429 | 47.9 | 3.50E-11 |
| 651 | Pescadillo_N | 4 | 285 | 667.1 | 1.40E-197 |
| 651 | BRCT | 355 | 436 | 48.4 | 2.50E-11 |
| 652 | 2OG-FeII_Oxy | 176 | 281 | 135 | 2.00E-37 |
| 653 | PI-PLC-X | 109 | 253 | 146.2 | 8.90E-41 |
| 653 | PI-PLC-Y | 320 | 438 | 84.2 | 4.10E-22 |
| 653 | C2 | 459 | 551 | 81.4 | 2.90E-21 |
| 654 | C1_1 | 139 | 200 | 38.3 | 2.60E-08 |
| 654 | DAGK_cat | 347 | 476 | 130.6 | 4.50E-36 |
| 654 | DAGK_acc | 493 | 650 | 144.9 | 2.20E-40 |
| 655 | Exo_endo_phos | 109 | 538 | 148 | 2.50E-40 |
| 656 | S6PP | 2 | 247 | 493.5 | 2.60E-145 |
| 656 | Hydrolase_3 | 6 | 242 | -20.7 | 5.50E-06 |
| 657 | S6PP | 8 | 261 | 556.5 | 2.60E-164 |
| 657 | Hydrolase_3 | 12 | 242 | -15.4 | 2.70E-06 |
| 657 | S6PP_C | 262 | 393 | 322.8 | 6.00E-94 |
| 658 | UDPGP | 29 | 441 | 981.2 | 3.70E-292 |
| 659 | U-box | 256 | 329 | 93 | 9.30E-25 |
| 659 | Arm | 383 | 423 | 48.9 | 1.80E-11 |
| 659 | Arm | 424 | 464 | 21.9 | 2.20E-03 |
| 659 | Arm | 465 | 505 | 40.9 | 4.30E-09 |
| 659 | Arm | 506 | 546 | 18.5 | 2.40E-02 |
| 659 | Arm | 547 | 587 | 34.2 | 4.50E-07 |
| 660 | U-box | 29 | 102 | 84.8 | 2.70E-22 |
| 661 | U-box | 270 | 342 | 81.2 | 3.30E-21 |
| 661 | Arm | 398 | 441 | 19.1 | 1.60E-02 |
| 661 | Arm | 442 | 483 | 17.5 | 4.90E-02 |
| 661 | Arm | 526 | 567 | 21.2 | 3.80E-03 |
| 662 | Prp19 | 64 | 133 | 161.6 | 2.10E-45 |
| 662 | WD40 | 253 | 291 | 47.2 | 5.40E-11 |
| 662 | WD40 | 298 | 336 | 33.4 | 8.10E-07 |
| 662 | WD40 | 384 | 421 | 32.2 | 1.80E-06 |
| 663 | U-box | 5 | 78 | 69.7 | 9.30E-18 |
| 664 | PfkB | 21 | 336 | 284.2 | 2.50E-82 |
| 665 | PfkB | 24 | 340 | 279.5 | 6.70E-81 |
| 666 | PfkB | 23 | 339 | 282.4 | 8.70E-82 |
| 667 | PfkB | 23 | 323 | 269 | 9.80E-78 |
| 668 | AdoHcyase | 12 | 484 | 828 | 4.90E-246 |
| 668 | 2-Hacid_dh_C | 219 | 399 | -77 | 1.30E-03 |
| 668 | AdoHcyase_NAD | 240 | 403 | 393.3 | 3.60E-115 |
| 669 | AdoHcyase | 6 | 448 | 744.6 | 6.30E-221 |
| 669 | AdoHcyase_NAD | 194 | 355 | 393.2 | 3.90E-115 |
| 670 | AdoHcyase | 8 | 424 | 133.5 | 5.90E-37 |
| 670 | 2-Hacid_dh_C | 171 | 341 | -56.8 | 4.40E-05 |
| 670 | AdoHcyase_NAD | 192 | 353 | 252.7 | 7.60E-73 |
| 670 | IlvN | 211 | 360 | -67.8 | 1.40E-03 |
| 671 | BRAP2 | 51 | 161 | 136.6 | 7.00E-38 |
| 671 | zf-C3HC4 | 168 | 207 | 40.1 | 7.40E-09 |
| 671 | zf-UBP | 219 | 290 | 119.4 | 1.00E-32 |
| 672 | Cu-oxidase_3 | 28 | 145 | 200.1 | 5.30E-57 |
| 672 | Cu-oxidase | 169 | 374 | 59.4 | 1.20E-14 |
| 672 | Cu-oxidase_2 | 469 | 606 | 39.1 | 1.50E-08 |
| 673 | Glycos_transf_1 | 241 | 428 | 78.2 | 2.60E-20 |
| 673 | S6PP | 466 | 713 | 451.8 | 9.10E-133 |
| 673 | Hydrolase_3 | 470 | 708 | -13.7 | 2.10E-06 |

TABLE 22-continued

| PEP SEQ ID | Pfam domain | Start | End | score | E-value |
|---|---|---|---|---|---|
| 674 | Flavoprotein | 264 | 428 | 204.8 | 2.00E−58 |
| 676 | Flavoprotein | 18 | 138 | 141.2 | 2.90E−39 |
| 677 | Flavoprotein | 18 | 163 | 105.7 | 1.30E−28 |
| 678 | IPP-2 | 7 | 148 | −29.9 | 1.50E−03 |
| 679 | IPP-2 | 2 | 137 | −23.9 | 4.70E−04 |
| 680 | Lactamase_B | 27 | 240 | 61.3 | 3.20E−15 |
| 681 | Lactamase_B | 45 | 264 | 78.5 | 2.10E−20 |
| 682 | Lactamase_B | 50 | 244 | 82.1 | 1.80E−21 |
| 683 | Histone | 25 | 94 | 67.1 | 5.70E−17 |
| 685 | zf-C3HC4 | 251 | 291 | 37.3 | 5.10E−08 |
| 686 | Pkinase | 40 | 327 | 322.6 | 6.90E−94 |
| 687 | Pkinase | 71 | 351 | 313.1 | 4.90E−91 |
| 688 | Pkinase | 32 | 319 | 321.7 | 1.30E−93 |
| 689 | Pkinase | 33 | 324 | 308.5 | 1.20E−89 |
| 690 | Pkinase | 13 | 304 | 296.9 | 3.80E−86 |
| 691 | Pkinase | 4 | 287 | 395.1 | 1.10E−115 |
| 692 | Pkinase | 39 | 325 | 314.1 | 2.40E−91 |
| 693 | Pkinase | 32 | 319 | 342.5 | 7.10E−100 |
| 694 | WRKY | 199 | 259 | 135.3 | 1.70E−37 |
| 695 | WRKY | 158 | 218 | 132.3 | 1.40E−36 |
| 696 | PPDK_N | 100 | 460 | 599 | 4.20E−177 |
| 696 | PEP-utilizers | 511 | 601 | 167.6 | 3.20E−47 |
| 696 | PEP-utilizers_C | 613 | 971 | 732.1 | 3.60E−217 |
| 697 | DUF580 | 187 | 539 | 516.7 | 2.50E−152 |
| 698 | AA_permease | 59 | 525 | −44.7 | 1.50E−04 |
| 699 | adh_short | 11 | 180 | 113.5 | 5.90E−31 |
| 699 | Epimerase | 13 | 244 | −42.3 | 2.10E−03 |
| 700 | adh_short | 15 | 187 | 111.5 | 2.50E−30 |
| 700 | KR | 15 | 204 | −29.4 | 1.20E−05 |
| 700 | NAD_binding_4 | 19 | 236 | −73.6 | 7.20E−04 |
| 701 | adh_short | 19 | 188 | 81.3 | 3.10E−21 |
| 701 | KR | 19 | 205 | −66.7 | 1.70E−03 |
| 702 | adh_short | 18 | 186 | 110.5 | 5.00E−30 |
| 702 | KR | 18 | 201 | −57.3 | 5.00E−04 |
| 703 | adh_short | 17 | 184 | 90.2 | 6.20E−24 |
| 707 | VDE | 163 | 360 | 553.4 | 2.40E−163 |
| 708 | SATase_N | 73 | 177 | 210 | 5.30E−60 |
| 708 | Hexapep | 231 | 248 | 18.5 | 2.40E−02 |
| 708 | Hexapep | 257 | 274 | 14.9 | 3.00E−01 |
| 708 | Hexapep | 275 | 292 | 9.7 | 9.60E+00 |
| 709 | SATase_N | 80 | 184 | 220 | 5.40E−63 |
| 709 | Hexapep | 238 | 255 | 12 | 2.20E+00 |
| 709 | Hexapep | 264 | 281 | 8.3 | 1.40E+01 |
| 709 | Hexapep | 282 | 299 | 2.9 | 6.40E+01 |
| 711 | NAS | 3 | 285 | 688 | 7.20E−204 |
| 712 | NAS | 39 | 319 | 615.6 | 4.30E−182 |
| 713 | OPT | 43 | 656 | 560.7 | 1.40E−165 |
| 714 | Pyridoxal_deC | 33 | 381 | 538.4 | 7.80E−159 |
| 715 | 2OG-FeII_Oxy | 190 | 321 | 91.1 | 3.40E−24 |
| 716 | Mlo | 4 | 501 | 735 | 4.80E−218 |
| 717 | G-alpha | 22 | 366 | 473.3 | 3.00E−139 |
| 718 | WD40 | 8 | 47 | 34.2 | 4.60E−07 |
| 718 | WD40 | 65 | 103 | 39.8 | 9.50E−09 |
| 718 | WD40 | 107 | 145 | 47.8 | 3.50E−11 |
| 718 | WD40 | 155 | 195 | 47.6 | 4.20E−11 |
| 718 | WD40 | 199 | 237 | 42.4 | 1.60E−09 |
| 718 | WD40 | 288 | 326 | 25.1 | 2.50E−04 |
| 720 | F-box | 53 | 108 | 29.4 | 1.30E−05 |
| 720 | Tub | 119 | 406 | 566.3 | 3.00E−167 |
| 721 | F-box | 34 | 90 | 17.8 | 3.80E−02 |
| 721 | Tub | 101 | 358 | 418.7 | 8.10E−123 |
| 722 | F-box | 51 | 106 | 31.6 | 2.70E−06 |
| 722 | Tub | 117 | 448 | 571.9 | 6.10E−169 |
| 723 | F-box | 45 | 100 | 28 | 3.40E−05 |
| 723 | Tub | 111 | 367 | 414.3 | 1.70E−121 |
| 724 | F-box | 73 | 128 | 23.1 | 9.90E−04 |
| 724 | Tub | 139 | 436 | 500.5 | 2.00E−147 |
| 725 | F-box | 48 | 103 | 15.6 | 1.80E−01 |
| 725 | Tub | 114 | 401 | 594.1 | 1.30E−175 |
| 726 | F-box | 58 | 113 | 26.9 | 7.20E−05 |
| 726 | Tub | 124 | 456 | 614.6 | 8.90E−182 |
| 727 | LRR_1 | 297 | 323 | 8 | 9.00E+00 |
| 727 | LRR_2 | 297 | 321 | 10.3 | 6.10E−01 |
| 728 | F-box | 15 | 63 | 21.2 | 3.70E−03 |
| 728 | LRR_1 | 168 | 190 | 12.6 | 1.30E+00 |
| 729 | WD40 | 168 | 205 | 26.6 | 8.80E−05 |
| 729 | WD40 | 257 | 296 | 35.5 | 1.90E−07 |
| 730 | Asp | 127 | 460 | −46.6 | 7.40E−11 |
| 731 | Asp | 130 | 466 | −79.2 | 6.20E−09 |
| 732 | AUX_IAA | 2 | 182 | 25.2 | 3.10E−11 |
| 733 | LEA_4 | 5 | 48 | 26.7 | 8.20E−05 |
| 736 | LEA_4 | 57 | 100 | 22.9 | 1.10E−03 |
| 737 | TLC | 65 | 563 | 994.5 | 3.70E−296 |
| 739 | Mito_carr | 22 | 119 | 127.2 | 4.60E−35 |
| 739 | Mito_carr | 126 | 222 | 112.8 | 1.00E−30 |
| 739 | Mito_carr | 226 | 316 | 102.5 | 1.30E−27 |
| 740 | PBP | 28 | 218 | 293.1 | 5.40E−85 |
| 741 | PBP | 22 | 191 | 121 | 3.40E−33 |
| 742 | Glycos_transf_1 | 452 | 635 | 61.5 | 2.80E−15 |
| 742 | S6PP | 676 | 930 | −86.2 | 1.10E−04 |
| 747 | SRF-TF | 9 | 59 | 114.1 | 4.10E−31 |
| 747 | K-box | 74 | 172 | 79.3 | 1.20E−20 |
| 748 | SRF-TF | 9 | 59 | 111.5 | 2.40E−30 |
| 748 | K-box | 73 | 173 | 58.3 | 2.60E−14 |
| 749 | SBP56 | 24 | 493 | 1290.6 | 0.00E+00 |
| 750 | GST_N | 4 | 79 | 91.5 | 2.60E−24 |
| 750 | GST_C | 108 | 203 | 80.1 | 6.80E−21 |
| 751 | Pkinase | 93 | 351 | 334 | 2.50E−97 |
| 751 | efhand | 398 | 426 | 37.3 | 5.20E−08 |
| 751 | efhand | 434 | 462 | 25.5 | 1.90E−04 |
| 751 | efhand | 470 | 498 | 34.2 | 4.50E−07 |
| 751 | efhand | 504 | 532 | 35.1 | 2.40E−07 |
| 752 | CK_II_beta | 87 | 260 | 445.5 | 7.10E−131 |
| 753 | Zein | 1 | 234 | 121.6 | 2.30E−33 |
| 754 | AP2 | 113 | 177 | 134.8 | 2.40E−37 |
| 755 | MFMR | 1 | 156 | 268.4 | 1.40E−77 |
| 755 | bZIP_2 | 244 | 298 | 37 | 6.30E−08 |
| 755 | bZIP_1 | 244 | 308 | 89.4 | 1.10E−23 |
| 756 | HMG_box | 41 | 110 | 115.2 | 1.80E−31 |
| 757 | RRM_1 | 10 | 81 | 108.2 | 2.40E−29 |
| 758 | Enolase_N | 4 | 140 | 244 | 3.20E−70 |
| 758 | Enolase_C | 148 | 443 | 729.3 | 2.50E−216 |
| 759 | zf-C3HC4 | 118 | 160 | 35.8 | 1.50E−07 |
| 760 | Ribosomal_L10 | 6 | 110 | 168.2 | 2.00E−47 |
| 760 | Ribosomal_60s | 227 | 317 | 70.2 | 6.60E−18 |
| 762 | SRF-TF | 9 | 59 | 78.3 | 2.40E−20 |
| 762 | K-box | 75 | 166 | 8.4 | 8.50E−05 |
| 763 | SRF-TF | 9 | 59 | 99.2 | 1.30E−26 |
| 763 | K-box | 75 | 172 | 92.4 | 1.30E−24 |
| 764 | SBP | 53 | 131 | 190.3 | 4.80E−54 |
| 765 | adh_short | 18 | 218 | 72.6 | 1.30E−18 |
| 766 | adh_short | 16 | 184 | 116.4 | 7.90E−32 |
| 766 | KR | 16 | 201 | −11 | 1.00E−06 |
| 767 | PBP | 18 | 163 | 220.5 | 3.70E−63 |
| 768 | PBP | 20 | 165 | 193.4 | 5.30E−55 |
| 769 | PBP | 17 | 162 | 162.2 | 1.30E−45 |
| 770 | FLO_LFY | 1 | 379 | 1005.9 | 1.40E−299 |
| 771 | zf-B_box | 14 | 60 | 47 | 6.30E−11 |
| 771 | CCT | 193 | 231 | 70.4 | 5.80E−18 |
| 772 | TLC | 91 | 587 | 1002.7 | 1.30E−298 |
| 773 | Ribosomal_L18p | 27 | 173 | 265.2 | 1.30E−76 |
| 774 | Ribosomal_L18p | 27 | 173 | 263.6 | 3.90E−76 |
| 775 | Ribosomal_L18p | 26 | 172 | 246.3 | 6.30E−71 |
| 776 | Orn_Arg_deC_N | 158 | 396 | 211.9 | 1.40E−60 |
| 776 | Orn_DAP_Arg_deC | 399 | 512 | 108.5 | 2.00E−29 |
| 778 | UPF0005 | 28 | 237 | 70.1 | 7.20E−18 |
| 780 | UPF0005 | 37 | 249 | 37.9 | 3.50E−08 |
| 781 | zf-LSD1 | 7 | 31 | 49.4 | 1.20E−11 |
| 781 | Peptidase_C14 | 64 | 347 | 225.1 | 1.50E−64 |
| 782 | Peptidase_C14 | 65 | 310 | 90 | 7.20E−24 |
| 783 | Peptidase_C14 | 73 | 352 | 132.8 | 9.70E−37 |
| 784 | Peptidase_C14 | 157 | 450 | 268.6 | 1.20E−77 |
| 785 | Rieske | 116 | 225 | 88.5 | 2.10E−23 |
| 785 | PaO | 325 | 432 | 171.8 | 1.80E−48 |
| 786 | Rieske | 33 | 139 | 109 | 1.40E−29 |
| 786 | PaO | 244 | 336 | 155.9 | 1.10E−43 |
| 787 | SRF-TF | 9 | 59 | 108.3 | 2.30E−29 |
| 787 | K-box | 69 | 169 | 112.1 | 1.60E−30 |
| 788 | DAD | 11 | 133 | 309.1 | 8.10E−90 |
| 789 | DAD | 3 | 114 | 219.5 | 7.70E−63 |
| 790 | Pirin | 91 | 188 | 131.1 | 3.00E−36 |
| 790 | Pirin_C | 244 | 356 | 113.3 | 6.90E−31 |
| 791 | Aldedh | 18 | 487 | 820.1 | 1.20E−243 |
| 792 | Aldedh | 18 | 488 | 829.6 | 1.70E−246 |

TABLE 22-continued

| PEP SEQ ID | Pfam domain | Start | End | score | E-value |
|---|---|---|---|---|---|
| 794 | PEMT | 10 | 205 | 548.9 | 5.10E−162 |
| 795 | Methyltransf_11 | 69 | 167 | 74 | 4.90E−19 |
| 795 | Methyltransf_12 | 69 | 165 | 51.3 | 3.20E−12 |
| 795 | CMAS | 240 | 501 | −149.9 | 5.50E−05 |
| 795 | Ubie_methyltran | 275 | 445 | −111.2 | 2.70E−04 |
| 795 | Methyltransf_12 | 298 | 392 | 70.4 | 5.90E−18 |
| 795 | Methyltransf_11 | 298 | 394 | 100.9 | 3.80E−27 |
| 796 | BCCT | 17 | 503 | 1106.5 | 0.00E+00 |
| 797 | BCCT | 19 | 505 | 970.6 | 6.00E−289 |
| 798 | Na_H_Exchanger | 22 | 444 | 185.2 | 1.60E−52 |
| 799 | Na_H_Exchanger | 24 | 443 | 183.2 | 6.30E−52 |
| 800 | H_PPase | 6 | 748 | 1649.7 | 0.00E+00 |
| 801 | H_PPase | 9 | 752 | 1606.8 | 0.00E+00 |
| 802 | H_PPase | 6 | 751 | 1479.9 | 0.00E+00 |
| 803 | HD-ZIP_N | 1 | 96 | 151.2 | 2.80E−42 |
| 803 | Homeobox | 123 | 177 | 65.2 | 2.10E−16 |
| 803 | HALZ | 178 | 222 | 86.1 | 1.10E−22 |
| 805 | bZIP_1 | 244 | 308 | 58.5 | 2.30E−14 |
| 805 | bZIP_2 | 244 | 298 | 51.7 | 2.50E−12 |
| 806 | zf-B_box | 1 | 47 | 39 | 1.70E−08 |
| 806 | zf-B_box | 51 | 96 | 47.1 | 5.90E−11 |
| 807 | AP2 | 62 | 126 | 129.6 | 8.70E−36 |
| 808 | Response_reg | 26 | 142 | 96.2 | 9.90E−26 |
| 808 | CCT | 628 | 666 | 73.6 | 6.40E−19 |
| 809 | zf-B_box | 17 | 64 | 42.1 | 1.80E−09 |
| 809 | zf-B_box | 65 | 107 | 48.3 | 2.60E−11 |
| 809 | CCT | 308 | 346 | 78.8 | 1.70E−20 |
| 810 | BTB | 20 | 119 | 11 | 4.10E−04 |
| 810 | NPH3 | 181 | 443 | 372 | 9.20E−109 |
| 811 | Myb_DNA-binding | 14 | 61 | 51.9 | 2.20E−12 |
| 811 | Myb_DNA-binding | 67 | 112 | 50.8 | 4.50E−12 |
| 812 | zf-B_box | 1 | 47 | 36.8 | 7.50E−08 |
| 812 | zf-B_box | 52 | 99 | 46.1 | 1.20E−10 |
| 813 | AP2 | 159 | 222 | 102.9 | 9.80E−28 |
| 813 | AP2 | 251 | 315 | 80.9 | 4.10E−21 |
| 814 | Myb_DNA-binding | 24 | 69 | 57.9 | 3.40E−14 |
| 815 | zf-CCCH | 39 | 65 | 44.1 | 4.70E−10 |
| 815 | zf-CCCH | 84 | 110 | 43.8 | 6.00E−10 |
| 815 | zf-CCCH | 130 | 156 | 44.5 | 3.70E−10 |
| 815 | zf-CCCH | 287 | 313 | 43.6 | 6.60E−10 |
| 815 | zf-CCCH | 333 | 359 | 46.2 | 1.10E−10 |
| 816 | Pkinase | 7 | 262 | 206.1 | 8.10E−59 |
| 817 | GH3 | 15 | 570 | 1262.5 | 0.00E+00 |
| 818 | PMEI | 33 | 207 | 144.5 | 2.90E−40 |
| 819 | DPBB_1 | 117 | 199 | 120.1 | 6.30E−33 |
| 819 | Pollen_allerg_1 | 211 | 292 | 120 | 6.90E−33 |
| 820 | DUF1313 | 23 | 112 | 213.3 | 5.50E−61 |
| 821 | Cu_bind_like | 35 | 120 | 100.2 | 6.10E−27 |
| 822 | UPF0041 | 1 | 109 | 135.3 | 1.70E−37 |
| 823 | MatE | 15 | 172 | 121.1 | 3.10E−33 |
| 823 | MatE | 233 | 396 | 164.2 | 3.40E−46 |
| 825 | DUF221 | 303 | 726 | 617.9 | 9.10E−183 |
| 826 | Rieske | 219 | 316 | 98.7 | 1.80E−26 |
| 826 | PaO | 407 | 501 | 170.6 | 3.80E−48 |
| 827 | zf-LSD1 | 18 | 42 | 53.5 | 7.00E−13 |
| 827 | Peptidase_C14 | 80 | 363 | 234.7 | 2.00E−67 |
| 828 | Myb_DNA-binding | 143 | 193 | 43.7 | 6.10E−10 |
| 829 | Myb_DNA-binding | 138 | 188 | 45.8 | 1.50E−10 |
| 830 | HLH | 192 | 242 | 27.9 | 3.60E−05 |
| 831 | Glycos_transf_1 | 481 | 664 | 67.9 | 3.30E−17 |
| 831 | S6PP | 773 | 1047 | −77.2 | 2.90E−05 |
| 832 | Glycos_transf_1 | 460 | 643 | 58.7 | 2.00E−14 |
| 832 | S6PP | 683 | 937 | −90.5 | 1.90E−04 |
| 833 | U-box | 29 | 103 | 97.9 | 3.10E−26 |
| 834 | U-box | 29 | 102 | 84.8 | 2.70E−22 |
| 835 | Globin | 6 | 131 | 103.1 | 8.10E−28 |
| 835 | FAD_binding_6 | 154 | 253 | 42.5 | 1.40E−09 |
| 835 | NAD_binding_1 | 263 | 373 | 87.5 | 4.20E−23 |
| 836 | P-II | 4 | 105 | 232.8 | 7.50E−67 |
| 837 | P-II | 78 | 180 | 180 | 6.00E−51 |
| 838 | DUF231 | 310 | 483 | 233.6 | 4.40E−67 |
| 839 | DXP_reductoisom | 81 | 209 | 238.7 | 1.20E−68 |
| 839 | DXP_redisom_C | 223 | 306 | 210.4 | 4.10E−60 |
| 840 | DXP_reductoisom | 5 | 134 | 247.6 | 2.60E−71 |
| 840 | DXP_redisom_C | 148 | 231 | 216.8 | 5.00E−62 |
| 841 | DXP_reductoisom | 11 | 138 | 212.2 | 1.20E−60 |
| 841 | DXP_redisom_C | 152 | 235 | 206.2 | 7.60E−59 |
| 842 | Transket_pyr | 392 | 559 | 233.7 | 4.00E−67 |
| 842 | Transketolase_C | 573 | 696 | 154.1 | 3.60E−43 |
| 843 | Transket_pyr | 318 | 485 | 187.1 | 4.20E−53 |
| 843 | Transketolase_C | 497 | 620 | 135.5 | 1.40E−37 |
| 844 | Transket_pyr | 354 | 520 | 185 | 1.90E−52 |
| 844 | Transketolase_C | 532 | 648 | 111.7 | 2.10E−30 |
| 845 | S-methyl_trans | 14 | 319 | 324.6 | 1.70E−94 |
| 846 | S-methyl_trans | 24 | 328 | 373.5 | 3.40E−109 |
| 847 | S-methyl_trans | 16 | 310 | 485.1 | 8.60E−143 |
| 848 | S-methyl_trans | 17 | 322 | 485.3 | 7.50E−143 |
| 849 | Histone | 33 | 107 | 93.5 | 6.40E−25 |
| 850 | Histone | 19 | 92 | 111.6 | 2.30E−30 |
| 850 | CBFD_NFYB_HMF | 25 | 89 | 20.5 | 2.00E−03 |
| 851 | Histone | 29 | 102 | 100.4 | 5.30E−27 |
| 852 | Histone | 28 | 101 | 98.7 | 1.80E−26 |
| 853 | DUF231 | 364 | 540 | 212.6 | 8.70E−61 |
| 854 | Flavodoxin_2 | 5 | 218 | 190.1 | 5.50E−54 |
| 855 | MIF4G | 9 | 228 | 74.8 | 2.80E−19 |
| 855 | MIF4G_like | 304 | 467 | 158 | 2.50E−44 |
| 855 | MIF4G_like_2 | 483 | 770 | 349.5 | 5.70E−102 |
| 856 | MIF4G | 33 | 261 | 120.5 | 4.80E−33 |
| 856 | MIF4G_like | 343 | 539 | 246.8 | 4.50E−71 |
| 856 | MIF4G_like_2 | 580 | 820 | 322.9 | 5.80E−94 |
| 857 | RRM_1 | 36 | 107 | 59.5 | 1.10E−14 |
| 858 | RRM_1 | 48 | 119 | 59.7 | 9.90E−15 |
| 859 | Pyridoxal_deC | 87 | 361 | 26.2 | 5.40E−16 |
| 860 | Pyridoxal_deC | 80 | 381 | 66.1 | 1.30E−18 |
| 861 | Pyridoxal_deC | 110 | 412 | 58.5 | 4.20E−18 |
| 862 | Pkinase | 177 | 477 | 204.5 | 2.50E−58 |
| 862 | Pkinase_C | 495 | 549 | 33.7 | 6.20E−07 |
| 863 | Pkinase | 169 | 469 | 206.1 | 8.00E−59 |
| 863 | Pkinase_C | 487 | 541 | 32.8 | 1.20E−06 |
| 864 | SRF-TF | 9 | 59 | 119.2 | 1.20E−32 |
| 864 | K-box | 75 | 174 | 158.4 | 1.80E−44 |
| 865 | SRF-TF | 9 | 59 | 120.7 | 4.20E−33 |
| 865 | K-box | 76 | 173 | 128.5 | 1.80E−35 |
| 866 | Myb_DNA-binding | 233 | 284 | 47.9 | 3.30E−11 |
| 867 | Myb_DNA-binding | 244 | 294 | 41.1 | 3.70E−09 |
| 868 | FBPase | 5 | 334 | 567 | 1.90E−167 |
| 869 | RPE65 | 131 | 630 | 696.9 | 1.50E−206 |
| 870 | RPE65 | 68 | 569 | 598.4 | 6.70E−177 |
| 871 | AP2 | 289 | 362 | 138.7 | 1.60E−38 |
| 871 | AP2 | 391 | 456 | 126 | 1.00E−34 |
| 872 | FBPase_glpX | 2 | 334 | 754.2 | 8.00E−224 |
| 873 | FBPase_glpX | 2 | 334 | 730.6 | 1.00E−216 |
| 874 | Glycos_transf_1 | 211 | 388 | 177.1 | 4.50E−50 |
| 875 | Glyco_transf_20 | 7 | 407 | −235.8 | 3.80E−03 |
| 875 | Glycos_transf_1 | 211 | 388 | 175.7 | 1.20E−49 |
| 876 | bZIP_1 | 87 | 151 | 55.7 | 1.60E−13 |
| 876 | bZIP_2 | 87 | 141 | 44.4 | 3.80E−10 |
| 877 | WRKY | 239 | 299 | 143.1 | 7.20E−40 |
| 878 | zf-Dof | 53 | 115 | 135.9 | 1.10E−37 |
| 879 | Myb_DNA-binding | 15 | 62 | 49 | 1.60E−11 |
| 879 | Myb_DNA-binding | 68 | 113 | 49.7 | 9.60E−12 |
| 880 | Myb_DNA-binding | 15 | 62 | 51.3 | 3.20E−12 |
| 880 | Myb_DNA-binding | 68 | 113 | 57.7 | 3.90E−14 |
| 881 | AP2 | 140 | 204 | 153.6 | 5.00E−43 |
| 882 | HLH | 121 | 168 | 24.3 | 3.70E−04 |
| 883 | AP2 | 12 | 77 | 155 | 1.90E−43 |
| 884 | AP2 | 5 | 69 | 119.2 | 1.20E−32 |
| 885 | bZIP_1 | 213 | 276 | 52.3 | 1.60E−12 |
| 885 | bZIP_2 | 213 | 267 | 53.6 | 6.40E−13 |
| 886 | Myb_DNA-binding | 36 | 81 | 56.5 | 8.60E−14 |
| 887 | bZIP_1 | 368 | 432 | 38 | 3.20E−08 |
| 887 | bZIP_2 | 368 | 422 | 33.4 | 8.10E−07 |
| 888 | G-alpha | 103 | 447 | 509.4 | 4.00E−150 |
| 889 | PSK | 13 | 83 | 94.2 | 3.90E−25 |
| 890 | PSK | 20 | 118 | 149.2 | 1.10E−41 |
| 892 | PSK | 20 | 101 | 143.5 | 5.60E−40 |
| 893 | Sugar_tr | 33 | 473 | −38.5 | 1.10E−05 |
| 894 | MFS_1 | 63 | 548 | 57.3 | 5.00E−14 |
| 895 | MFS_1 | 46 | 466 | 28.6 | 1.60E−05 |
| 898 | Phytochrome | 48 | 227 | 27.2 | 3.20E−06 |
| 898 | HisKA | 237 | 302 | 59.6 | 1.00E−14 |
| 898 | HATPase_c | 349 | 486 | 79.2 | 1.30E−20 |
| 899 | Hpt | 44 | 129 | 42.6 | 1.40E−09 |
| 901 | Hpt | 44 | 122 | 55.1 | 2.30E−13 |

TABLE 22-continued

| PEP SEQ ID | Pfam domain | Start | End | score | E-value |
|---|---|---|---|---|---|
| 902 | Hpt | 30 | 112 | 55 | 2.60E-13 |
| 903 | GAF | 158 | 307 | 88.1 | 2.70E-23 |
| 903 | HisKA | 343 | 408 | 87.5 | 4.10E-23 |
| 903 | HATPase_c | 455 | 586 | 134.1 | 3.90E-37 |
| 904 | GAF | 159 | 308 | 75.9 | 1.20E-19 |
| 904 | HisKA | 344 | 409 | 77.9 | 3.20E-20 |
| 904 | HATPase_c | 456 | 586 | 109 | 1.40E-29 |
| 905 | p450 | 45 | 523 | 187.4 | 3.50E-53 |
| 906 | Sugar_tr | 32 | 472 | -71.7 | 1.30E-04 |
| 907 | AP2 | 131 | 196 | 139.5 | 9.10E-39 |
| 908 | AP2 | 17 | 81 | 121.1 | 3.10E-33 |
| 909 | AP2 | 17 | 82 | 142.5 | 1.10E-39 |
| 910 | DUF6 | 115 | 233 | 36.3 | 1.10E-07 |
| 910 | DUF6 | 253 | 394 | 33.4 | 7.90E-07 |
| 911 | TPT | 183 | 335 | 126.5 | 7.30E-35 |
| 912 | UAA | 81 | 385 | -117.9 | 1.60E-04 |
| 912 | TPT | 231 | 379 | 169 | 1.20E-47 |
| 913 | DUF6 | 24 | 157 | 53.3 | 8.30E-13 |
| 913 | DUF6 | 204 | 333 | 26.2 | 1.10E-04 |
| 914 | UAA | 9 | 330 | -142.8 | 2.80E-03 |
| 914 | DUF6 | 19 | 146 | 35.2 | 2.30E-07 |
| 914 | TPT | 189 | 326 | -10.4 | 2.30E-03 |
| 914 | DUF6 | 198 | 326 | 57 | 6.40E-14 |
| 915 | DUF6 | 21 | 154 | 55.4 | 1.80E-13 |
| 915 | DUF6 | 198 | 328 | 30.4 | 6.20E-06 |
| 916 | DUF6 | 26 | 160 | 21.9 | 2.30E-03 |
| 916 | TPT | 193 | 333 | -5.8 | 1.20E-03 |
| 916 | DUF6 | 202 | 333 | 26.8 | 7.50E-05 |
| 917 | DUF6 | 28 | 161 | 39.1 | 1.50E-08 |
| 917 | DUF6 | 202 | 331 | 64.4 | 3.80E-16 |
| 919 | TPT | 156 | 298 | 142.9 | 8.40E-40 |
| 920 | DUF6 | 22 | 155 | 61.9 | 2.00E-15 |
| 920 | DUF6 | 201 | 330 | 45.7 | 1.60E-10 |
| 921 | DUF6 | 26 | 159 | 62.5 | 1.30E-15 |
| 921 | DUF6 | 205 | 334 | 51.9 | 2.20E-12 |
| 922 | DUF914 | 1 | 328 | 373.7 | 2.80E-109 |
| 922 | UAA | 18 | 304 | -142.8 | 2.80E-03 |
| 922 | DUF6 | 22 | 144 | 21.3 | 3.40E-03 |
| 923 | HEAT | 22 | 57 | 12.7 | 1.20E+00 |
| 923 | HEAT | 97 | 133 | 19.8 | 9.90E-03 |
| 923 | HEAT | 181 | 217 | 27.9 | 3.60E-05 |
| 923 | HEAT | 218 | 253 | 13.5 | 8.00E-01 |
| 923 | HEAT | 259 | 295 | 11.7 | 1.60E+00 |
| 923 | HEAT | 341 | 376 | 11.5 | 1.70E+00 |
| 923 | HEAT | 381 | 416 | 18.9 | 1.80E-02 |
| 925 | DUF6 | 22 | 154 | 39.4 | 1.20E-08 |
| 926 | UAA | 27 | 313 | -136.4 | 1.30E-03 |
| 926 | TPT | 167 | 307 | 171.9 | 1.60E-48 |
| 927 | DUF6 | 15 | 148 | 39 | 1.70E-08 |
| 928 | DUF6 | 27 | 160 | 54.3 | 4.10E-13 |
| 928 | DUF6 | 201 | 330 | 29.8 | 9.80E-06 |
| 929 | DUF6 | 128 | 252 | 84.7 | 2.80E-22 |
| 929 | DUF6 | 277 | 407 | 104.4 | 3.40E-28 |
| 930 | TPT | 156 | 299 | 163.8 | 4.30E-46 |
| 931 | DUF914 | 2 | 327 | 672 | 4.60E-199 |
| 933 | DUF6 | 31 | 164 | 53.1 | 9.30E-13 |
| 933 | DUF6 | 215 | 344 | 58.8 | 1.80E-14 |
| 934 | UAA | 6 | 306 | -56.5 | 1.40E-07 |
| 934 | TPT | 156 | 300 | 171.2 | 2.60E-48 |
| 935 | DUF6 | 16 | 149 | 73.5 | 6.70E-19 |
| 935 | DUF6 | 193 | 322 | 76 | 1.20E-19 |
| 936 | TPT | 163 | 303 | 167.7 | 2.90E-47 |
| 937 | UAA | 50 | 350 | -68.7 | 5.60E-07 |
| 937 | TPT | 200 | 344 | 162 | 1.50E-45 |
| 938 | Pkinase | 504 | 777 | 139.8 | 7.20E-39 |
| 938 | Pkinase_Tyr | 504 | 777 | 122.7 | 1.00E-33 |
| 939 | B_lectin | 81 | 189 | 44.9 | 2.70E-10 |
| 939 | PAN_2 | 322 | 387 | 49.4 | 1.20E-11 |
| 939 | PAN_1 | 322 | 404 | 4.4 | 5.80E-02 |
| 939 | Pkinase_Tyr | 470 | 736 | 115.7 | 1.30E-31 |
| 939 | Pkinase | 470 | 736 | 172.3 | 1.20E-48 |
| 940 | B_lectin | 80 | 187 | 49.4 | 1.20E-11 |
| 940 | PAN_2 | 326 | 391 | 74.4 | 3.70E-19 |
| 940 | Pkinase | 473 | 742 | 194.7 | 2.10E-55 |
| 940 | Pkinase_Tyr | 474 | 742 | 106.2 | 9.80E-29 |
| 941 | B_lectin | 110 | 225 | 48.7 | 2.00E-11 |
| 941 | PAN_2 | 360 | 425 | 70.8 | 4.30E-18 |
| 941 | Pkinase | 507 | 776 | 188.2 | 2.00E-53 |
| 941 | Pkinase_Tyr | 508 | 776 | 100.9 | 3.80E-27 |
| 942 | B_lectin | 67 | 176 | 77.3 | 4.90E-20 |
| 942 | PAN_2 | 311 | 373 | 67.5 | 4.30E-17 |
| 942 | Pkinase | 450 | 718 | 195.6 | 1.20E-55 |
| 942 | Pkinase_Tyr | 451 | 718 | 121.9 | 1.80E-33 |
| 943 | B_lectin | 74 | 188 | 122.8 | 9.50E-34 |
| 943 | S_locus_glycop | 202 | 333 | 111.6 | 2.20E-30 |
| 943 | PAN_2 | 350 | 415 | 113.1 | 8.10E-31 |
| 943 | PAN_1 | 362 | 433 | 14.4 | 5.90E-03 |
| 943 | Pkinase | 499 | 784 | 161.9 | 1.70E-45 |
| 943 | Pkinase_Tyr | 500 | 784 | 113.8 | 5.10E-31 |
| 944 | B_lectin | 75 | 199 | 126.2 | 9.10E-35 |
| 944 | S_locus_glycop | 212 | 340 | 129.9 | 7.00E-36 |
| 944 | PAN_2 | 357 | 425 | 108.7 | 1.70E-29 |
| 944 | PAN_1 | 362 | 443 | 13.2 | 7.70E-03 |
| 944 | Pkinase | 506 | 790 | 191.2 | 2.50E-54 |
| 944 | Pkinase_Tyr | 507 | 790 | 106.2 | 9.30E-29 |
| 945 | PAN_1 | 336 | 417 | 3.4 | 7.30E-02 |
| 945 | Pkinase | 500 | 770 | 188 | 2.20E-53 |
| 945 | Pkinase_Tyr | 500 | 770 | 111.2 | 3.00E-30 |
| 946 | 14-3-3 | 6 | 243 | 509.5 | 3.80E-150 |
| 947 | 14-3-3 | 6 | 117 | 28.5 | 1.00E-05 |
| 948 | 14-3-3 | 8 | 120 | 34.7 | 3.20E-07 |
| 949 | 14-3-3 | 3 | 240 | 507.1 | 2.00E-149 |
| 950 | 14-3-3 | 3 | 115 | 27.9 | 1.10E-05 |
| 951 | 14-3-3 | 9 | 246 | 512.4 | 5.10E-151 |
| 952 | 14-3-3 | 9 | 120 | 30.8 | 4.70E-06 |
| 953 | 14-3-3 | 5 | 240 | 492.1 | 6.50E-145 |
| 954 | 14-3-3 | 5 | 116 | 31.7 | 2.50E-06 |
| 955 | 14-3-3 | 7 | 116 | 30.8 | 4.70E-06 |
| 956 | 14-3-3 | 4 | 239 | 430.4 | 2.40E-126 |
| 958 | 14-3-3 | 8 | 245 | 517.1 | 2.00E-152 |
| 959 | 14-3-3 | 8 | 120 | 32 | 2.10E-06 |
| 960 | 14-3-3 | 8 | 245 | 485.1 | 8.30E-143 |
| 962 | 14-3-3 | 8 | 249 | 505.4 | 6.60E-149 |
| 963 | 14-3-3 | 8 | 125 | 31.3 | 3.50E-06 |
| 964 | G-alpha | 431 | 841 | 14.7 | 2.20E-18 |
| 965 | Pkinase | 40 | 363 | 240.5 | 3.60E-69 |
| 966 | Pkinase | 117 | 402 | 287.2 | 3.00E-83 |
| 967 | Pkinase | 34 | 319 | 298.5 | 1.30E-86 |
| 968 | CK_II_beta | 93 | 267 | 451.2 | 1.30E-132 |
| 969 | CK_II_beta | 26 | 233 | 575.7 | 4.40E-170 |
| 970 | CK_II_beta | 89 | 263 | 440.5 | 2.20E-129 |
| 971 | CK_II_beta | 87 | 260 | 445.5 | 7.10E-131 |
| 972 | RRM_1 | 10 | 81 | 104.5 | 3.10E-28 |
| 973 | RRM_1 | 9 | 80 | 108.7 | 1.70E-29 |
| 973 | zf-CCHC | 128 | 145 | 37.8 | 3.90E-08 |
| 974 | RRM_1 | 39 | 110 | 112.7 | 1.00E-30 |
| 975 | RRM_1 | 33 | 104 | 111.1 | 3.10E-30 |
| 976 | Methyltransf_11 | 63 | 162 | 21.8 | 3.90E-04 |
| 976 | Methyltransf_12 | 63 | 161 | 23.9 | 5.80E-06 |
| 977 | Methyltransf_11 | 85 | 184 | 32 | 2.10E-06 |
| 977 | Methyltransf_12 | 85 | 182 | 29.8 | 9.60E-06 |
| 978 | Methyltransf_11 | 70 | 169 | 31.3 | 3.40E-06 |
| 979 | RRM_1 | 10 | 81 | 108.2 | 2.40E-29 |
| 980 | zf-C3HC4 | 253 | 293 | 40.2 | 6.90E-09 |
| 981 | zf-C3HC4 | 190 | 230 | 41.3 | 3.20E-09 |
| 982 | zf-C3HC4 | 234 | 274 | 35.4 | 1.90E-07 |
| 983 | zf-C3HC4 | 221 | 261 | 48.4 | 2.30E-11 |
| 984 | zf-C3HC4 | 156 | 196 | 28.6 | 2.10E-05 |
| 985 | zf-C3HC4 | 218 | 258 | 37.9 | 3.60E-08 |
| 986 | zf-C3HC4 | 94 | 135 | 41.9 | 2.10E-09 |
| 987 | zf-C3HC4 | 204 | 245 | 17.9 | 2.20E-03 |
| 988 | zf-C3HC4 | 126 | 169 | 40.1 | 7.50E-09 |
| 989 | PA | 51 | 149 | 62.7 | 1.20E-15 |
| 989 | zf-C3HC4 | 237 | 278 | 41.3 | 3.30E-09 |
| 990 | zf-C3HC4 | 87 | 128 | 46.1 | 1.20E-10 |
| 991 | zf-C3HC4 | 607 | 647 | 39.8 | 9.50E-09 |
| 992 | zf-C3HC4 | 467 | 507 | 27.5 | 4.70E-05 |
| 993 | zf-C3HC4 | 155 | 195 | 38.7 | 2.00E-08 |
| 994 | zf-C3HC4 | 127 | 167 | 27.6 | 4.60E-05 |
| 995 | zf-C3HC4 | 33 | 73 | 34.2 | 4.60E-07 |
| 996 | Skp1_POZ | 5 | 65 | 99.6 | 9.60E-27 |
| 996 | Skp1 | 91 | 168 | 186.3 | 7.40E-53 |
| 997 | Skp1 | 90 | 164 | 53.7 | 6.00E-13 |
| 998 | Skp1_POZ | 8 | 68 | 123.8 | 4.80E-34 |

TABLE 22-continued

| PEP SEQ ID | Pfam domain | Start | End | score | E-value |
|---|---|---|---|---|---|
| 998 | Skp1 | 99 | 176 | 192.8 | 8.40E−55 |
| 999 | LRR_2 | 174 | 201 | 6.7 | 1.90E+00 |
| 999 | LRR_2 | 301 | 325 | 7.2 | 1.60E+00 |
| 1000 | F-box | 15 | 63 | 21.2 | 3.70E−03 |
| 1000 | LRR_1 | 168 | 190 | 12.6 | 1.30E+00 |
| 1002 | F-box | 17 | 64 | 17.6 | 4.70E−02 |
| 1002 | LRR_1 | 299 | 325 | 8.6 | 7.10E+00 |
| 1002 | LRR_2 | 299 | 323 | 14.3 | 1.80E−01 |
| 1003 | Response_reg | 42 | 177 | 69.4 | 1.20E−17 |
| 1004 | zf-CHY | 35 | 113 | 119.1 | 1.30E−32 |
| 1004 | zf-C3HC4 | 166 | 208 | 33.3 | 8.40E−07 |
| 1005 | zf-CHY | 59 | 142 | 141.2 | 2.80E−39 |
| 1005 | zf-C3HC4 | 195 | 237 | 32.4 | 1.60E−06 |
| 1006 | MtN3_slv | 9 | 98 | 86.2 | 1.00E−22 |
| 1006 | MtN3_slv | 132 | 218 | 124.5 | 2.90E−34 |
| 1007 | zf-C3HC4 | 215 | 256 | 16.1 | 3.40E−03 |
| 1008 | PHD | 198 | 248 | 56.1 | 1.10E−13 |
| 1009 | F-box | 17 | 64 | 35.9 | 1.40E−07 |
| 1010 | F-box | 22 | 69 | 26.7 | 8.20E−05 |
| 1011 | F-box | 9 | 56 | 34.8 | 3.00E−07 |
| 1011 | Kelch_1 | 97 | 153 | 36.7 | 8.30E−08 |
| 1011 | Kelch_2 | 97 | 153 | 21.8 | 2.50E−03 |
| 1011 | Kelch_2 | 155 | 201 | 30.3 | 6.70E−06 |
| 1011 | Kelch_1 | 155 | 201 | 54.1 | 4.50E−13 |
| 1011 | Kelch_1 | 285 | 339 | 30.1 | 8.00E−06 |
| 1012 | F-box | 76 | 123 | 33.2 | 9.30E−07 |
| 1012 | Kelch_1 | 167 | 213 | 33.5 | 7.40E−07 |
| 1012 | Kelch_1 | 215 | 262 | 52.1 | 1.80E−12 |
| 1012 | Kelch_2 | 215 | 262 | 15.7 | 1.70E−01 |
| 1013 | F-box | 26 | 73 | 33.6 | 6.90E−07 |
| 1013 | Kelch_2 | 116 | 162 | 19.9 | 8.90E−03 |
| 1013 | Kelch_1 | 116 | 162 | 42.2 | 1.70E−09 |
| 1013 | Kelch_2 | 164 | 210 | 18.4 | 2.70E−02 |
| 1013 | Kelch_1 | 164 | 210 | 21.6 | 2.90E−03 |
| 1014 | zf-C3HC4 | 49 | 91 | 40.7 | 5.00E−09 |
| 1017 | Prp19 | 64 | 133 | 161.6 | 2.10E−45 |
| 1017 | WD40 | 253 | 291 | 47.2 | 5.40E−11 |
| 1017 | WD40 | 298 | 336 | 33.4 | 8.10E−07 |
| 1017 | WD40 | 384 | 421 | 32.2 | 1.80E−06 |
| 1018 | zf-C3HC4 | 36 | 81 | 26.6 | 8.90E−05 |
| 1019 | zf-C3HC4 | 58 | 103 | 34.3 | 4.30E−07 |
| 1020 | TPR_1 | 14 | 47 | 22.2 | 1.80E−03 |
| 1020 | TPR_2 | 14 | 47 | 20.6 | 5.70E−03 |
| 1020 | TPR_2 | 48 | 81 | 23.5 | 7.80E−04 |
| 1020 | TPR_1 | 48 | 81 | 33.1 | 9.60E−07 |
| 1020 | TPR_1 | 82 | 115 | 12.8 | 1.60E−01 |
| 1020 | TPR_2 | 82 | 115 | 21.1 | 4.10E−03 |
| 1020 | U-box | 195 | 269 | 132.5 | 1.20E−36 |
| 1021 | zf-C3HC4 | 24 | 64 | 27.8 | 3.90E−05 |
| 1022 | F-box | 195 | 243 | 23.8 | 5.90E−04 |
| 1022 | Kelch_1 | 292 | 340 | 17.6 | 3.90E−02 |
| 1022 | Kelch_2 | 292 | 340 | 15.9 | 1.50E−01 |
| 1022 | Kelch_2 | 345 | 392 | 33.6 | 7.10E−07 |
| 1022 | Kelch_1 | 345 | 392 | 17.2 | 4.40E−02 |
| 1022 | Kelch_1 | 397 | 445 | 13.4 | 1.20E−01 |
| 1022 | Kelch_2 | 449 | 501 | 27.6 | 4.40E−05 |
| 1022 | Kelch_2 | 516 | 564 | 26.4 | 9.90E−05 |
| 1023 | F-box | 205 | 253 | 28.5 | 2.40E−05 |
| 1023 | Kelch_1 | 300 | 348 | 17.8 | 3.70E−02 |
| 1023 | Kelch_2 | 300 | 348 | 17.8 | 3.90E−02 |
| 1023 | Kelch_2 | 353 | 400 | 24.4 | 4.10E−04 |
| 1023 | Kelch_1 | 405 | 453 | 12.7 | 1.40E−01 |
| 1023 | Kelch_2 | 458 | 509 | 18.3 | 2.80E−02 |
| 1023 | Kelch_2 | 518 | 566 | 32.8 | 1.20E−06 |
| 1024 | Cellulose_synt | 167 | 977 | 2072.7 | 0.00E+00 |
| 1025 | Cellulose_synt | 254 | 1069 | 2130.3 | 0.00E+00 |
| 1028 | zf-C3HC4 | 22 | 64 | 22 | 8.20E−04 |
| 1029 | F-box | 32 | 79 | 35.9 | 1.40E−07 |
| 1029 | LysM | 109 | 152 | 29.7 | 1.00E−05 |
| 1030 | Sina | 121 | 320 | 442.6 | 5.20E−130 |
| 1031 | F-box | 18 | 65 | 37.6 | 4.20E−08 |
| 1034 | F-box | 18 | 66 | 31 | 4.10E−06 |
| 1035 | SPX | 1 | 167 | 88.9 | 1.50E−23 |
| 1035 | zf-C3HC4 | 238 | 286 | 16.9 | 2.80E−03 |
| 1037 | Cullin | 15 | 237 | 52.9 | 4.60E−14 |
| 1038 | zf-C3HC4 | 227 | 270 | 35.6 | 1.70E−07 |
| 1039 | zf-C3HC4 | 361 | 398 | 39.6 | 1.10E−08 |
| 1040 | Melibiase | 34 | 362 | −25.7 | 2.30E−14 |
| 1041 | Copine | 80 | 227 | 281 | 2.30E−81 |
| 1042 | F-box | 36 | 83 | 31.8 | 2.40E−06 |
| 1046 | F-box | 1 | 47 | 20.9 | 4.70E−03 |
| 1046 | LRR_2 | 150 | 174 | 14.4 | 1.70E−01 |
| 1047 | F-box | 11 | 59 | 25.9 | 1.40E−04 |
| 1048 | U-box | 5 | 78 | 69.7 | 9.30E−18 |
| 1049 | Glycos_transf_1 | 465 | 648 | 59.4 | 1.20E−14 |
| 1049 | S6PP | 701 | 942 | −88.5 | 1.40E−04 |
| 1050 | Pkinase | 491 | 759 | 187.9 | 2.50E−53 |
| 1050 | Ribonuc_2-5A | 764 | 890 | 261.8 | 1.40E−75 |
| 1052 | Pkinase | 77 | 345 | 187.9 | 2.50E−53 |
| 1052 | Ribonuc_2-5A | 350 | 476 | 261.8 | 1.40E−75 |
| 1053 | Pkinase | 674 | 980 | 198.2 | 1.90E−56 |
| 1053 | Ribonuc_2-5A | 985 | 1115 | 256.7 | 4.80E−74 |
| 1055 | Pkinase | 101 | 407 | 198.2 | 1.90E−56 |
| 1055 | Ribonuc_2-5A | 412 | 542 | 256.7 | 4.80E−74 |
| 1056 | dCMP_cyt_deam_1 | 218 | 319 | 145.6 | 1.30E−40 |
| 1057 | Aldo_ket_red | 7 | 285 | 442 | 8.10E−130 |
| 1058 | Aldo_ket_red | 5 | 292 | 465.6 | 6.20E−137 |
| 1060 | SOH1 | 18 | 112 | 205.8 | 9.90E−59 |
| 1061 | dCMP_cyt_deam_1 | 1 | 107 | 117.9 | 2.80E−32 |
| 1062 | Put_Phosphatase | 4 | 229 | −87.8 | 7.10E−04 |
| 1063 | NAF1 | 104 | 273 | 372.4 | 7.00E−109 |
| 1064 | Aldo_ket_red | 10 | 289 | 204.4 | 2.70E−58 |
| 1065 | Glutaredoxin | 19 | 85 | 72.9 | 1.10E−18 |
| 1066 | TPT | 156 | 299 | 163.8 | 4.30E−46 |
| 1067 | DUF850 | 2 | 230 | 517.4 | 1.60E−152 |
| 1068 | LEA_2 | 17 | 166 | 309.5 | 6.20E−90 |
| 1069 | ABA_WDS | 43 | 96 | 102.9 | 9.40E−28 |
| 1070 | ABA_WDS | 51 | 104 | 105.7 | 1.40E−28 |
| 1071 | LEA_2 | 30 | 179 | 280.9 | 2.40E−81 |
| 1072 | LEA_2 | 30 | 179 | 300.6 | 2.90E−87 |
| 1073 | ABA_WDS | 54 | 107 | 105.1 | 2.10E−28 |
| 1074 | Sigma70_r2 | 260 | 330 | 69.1 | 1.50E−17 |
| 1074 | Sigma70_r3 | 334 | 414 | 67.5 | 4.20E−17 |
| 1074 | Sigma70_r4 | 433 | 485 | 38.5 | 2.30E−08 |
| 1075 | Sigma70_r2 | 314 | 384 | 83.9 | 4.80E−22 |
| 1075 | Sigma70_r3 | 388 | 469 | 76.3 | 9.60E−20 |
| 1075 | Sigma70_r4 | 482 | 535 | 73.1 | 8.80E−19 |
| 1076 | Sigma70_r2 | 302 | 372 | 70.7 | 4.80E−18 |
| 1076 | Sigma70_r3 | 376 | 457 | 95.4 | 1.70E−25 |
| 1076 | Sigma70_r4 | 469 | 522 | 98.3 | 2.30E−26 |
| 1077 | Bromodomain | 61 | 150 | 114.6 | 2.80E−31 |
| 1078 | Homeobox | 70 | 124 | 73.7 | 5.70E−19 |
| 1078 | HALZ | 125 | 169 | 43.9 | 5.50E−10 |
| 1079 | bZIP_1 | 118 | 179 | 60.2 | 6.60E−15 |
| 1079 | bZIP_2 | 118 | 172 | 40.5 | 5.90E−09 |
| 1080 | MFMR | 1 | 156 | 268.9 | 1.00E−77 |
| 1080 | bZIP_2 | 244 | 298 | 40 | 8.10E−09 |
| 1080 | bZIP_1 | 244 | 308 | 89.8 | 8.30E−24 |
| 1081 | Remorin_C | 402 | 512 | 145 | 2.00E−40 |
| 1082 | Remorin_N | 23 | 83 | 48 | 3.20E−11 |
| 1082 | Remorin_C | 85 | 194 | 165.5 | 1.40E−46 |
| 1083 | Myb_DNA-binding | 39 | 90 | 48.5 | 2.30E−11 |
| 1084 | Homeobox | 77 | 131 | 77.3 | 4.70E−20 |
| 1084 | HALZ | 132 | 176 | 65.4 | 1.80E−16 |
| 1085 | Homeobox | 77 | 131 | 77.3 | 4.70E−20 |
| 1085 | HALZ | 132 | 176 | 70.2 | 6.40E−18 |
| 1086 | HSF_DNA-bind | 11 | 170 | 148.9 | 1.30E−41 |
| 1088 | HSF_DNA-bind | 13 | 167 | 170.8 | 3.60E−48 |
| 1089 | HSF_DNA-bind | 15 | 219 | 144 | 4.10E−40 |
| 1090 | AUX_IAA | 18 | 218 | 231.9 | 1.40E−66 |
| 1091 | AUX_IAA | 19 | 219 | 97.9 | 3.00E−26 |
| 1092 | SRF-TF | 9 | 59 | 111.1 | 3.30E−30 |
| 1092 | K-box | 48 | 144 | 138 | 2.60E−38 |
| 1093 | SRF-TF | 9 | 59 | 120.8 | 3.90E−33 |
| 1093 | K-box | 75 | 174 | 154.8 | 2.20E−43 |
| 1094 | SRF-TF | 9 | 59 | 111.5 | 2.40E−30 |
| 1094 | K-box | 73 | 173 | 55.8 | 1.50E−13 |
| 1095 | SRF-TF | 9 | 59 | 109.7 | 8.30E−30 |
| 1095 | K-box | 71 | 170 | 112.4 | 1.30E−30 |
| 1096 | SRF-TF | 9 | 59 | 120.7 | 4.20E−33 |
| 1096 | K-box | 76 | 173 | 128.5 | 1.80E−35 |
| 1097 | SRF-TF | 9 | 59 | 113.1 | 8.30E−31 |
| 1097 | K-box | 71 | 170 | 105.8 | 1.30E−28 |
| 1098 | SRF-TF | 9 | 59 | 120.8 | 3.90E−33 |

TABLE 22-continued

| PEP SEQ ID | Pfam domain | Start | End | score | E-value |
|---|---|---|---|---|---|
| 1098 | K-box | 75 | 174 | 154.8 | 2.20E−43 |
| 1099 | zf-C2H2 | 35 | 58 | 19.5 | 1.20E−02 |
| 1100 | LIM | 10 | 67 | 55.9 | 1.30E−13 |
| 1100 | LIM | 105 | 162 | 67.2 | 5.10E−17 |
| 1101 | Myb_DNA-binding | 5 | 57 | 34.1 | 5.00E−07 |
| 1101 | Linker_histone | 122 | 190 | 14.4 | 2.80E−04 |
| 1102 | Myb_DNA-binding | 14 | 61 | 44.9 | 2.70E−10 |
| 1102 | Myb_DNA-binding | 67 | 112 | 46 | 1.30E−10 |
| 1103 | Myb_DNA-binding | 11 | 57 | 59.3 | 1.30E−14 |
| 1103 | Myb_DNA-binding | 63 | 108 | 48.9 | 1.70E−11 |
| 1104 | Myb_DNA-binding | 14 | 61 | 51.9 | 2.20E−12 |
| 1104 | Myb_DNA-binding | 67 | 112 | 50.8 | 4.50E−12 |
| 1105 | NAM | 23 | 158 | 278.5 | 1.30E−80 |
| 1106 | MED7 | 4 | 169 | 270.1 | 4.40E−78 |
| 1107 | zf-LSD1 | 27 | 51 | 43.6 | 6.70E−10 |
| 1107 | zf-LSD1 | 66 | 90 | 54.8 | 2.80E−13 |
| 1107 | zf-LSD1 | 104 | 128 | 55.2 | 2.20E−13 |
| 1108 | Hydrolase | 18 | 209 | 95.4 | 1.70E−25 |
| 1109 | zf-C3HC4 | 349 | 389 | 38.5 | 2.30E−08 |
| 1110 | zf-C3HC4 | 244 | 284 | 41.2 | 3.40E−09 |
| 1111 | zf-CHY | 35 | 113 | 119.1 | 1.30E−32 |
| 1111 | zf-C3HC4 | 166 | 208 | 33.3 | 8.40E−07 |
| 1112 | Ank | 50 | 82 | 34.2 | 4.60E−07 |
| 1112 | Ank | 83 | 115 | 32.9 | 1.20E−06 |
| 1112 | Ank | 117 | 148 | 12.8 | 4.40E−01 |
| 1112 | Ank | 180 | 212 | 40.8 | 4.80E−09 |
| 1112 | Ank | 223 | 255 | 37.4 | 5.00E−08 |
| 1112 | zf-C3HC4 | 321 | 370 | 23.9 | 5.30E−04 |
| 1113 | zf-B_box | 1 | 47 | 42.6 | 1.30E−09 |
| 1113 | zf-B_box | 48 | 90 | 24.8 | 3.00E−04 |
| 1113 | CCT | 356 | 394 | 69.7 | 9.50E−18 |
| 1114 | GRAS | 154 | 464 | 462.7 | 4.60E−136 |
| 1115 | TFIIS | 1 | 93 | 31.9 | 2.20E−06 |
| 1115 | TFIIS_M | 189 | 317 | 173.9 | 4.10E−49 |
| 1115 | TFIIS_C | 328 | 366 | 86.5 | 8.20E−23 |
| 1116 | zf-B_box | 1 | 47 | 38.8 | 1.80E−08 |
| 1116 | zf-B_box | 55 | 102 | 38.5 | 2.30E−08 |
| 1117 | Copine | 111 | 259 | 298.9 | 9.70E−87 |
| 1118 | Copine | 111 | 259 | 298.3 | 1.40E−86 |
| 1120 | zf-CCCH | 35 | 61 | 16.6 | 8.40E−03 |
| 1120 | zf-CCCH | 95 | 121 | 30.7 | 5.20E−06 |
| 1120 | KH_1 | 246 | 310 | 63.8 | 5.70E−16 |
| 1120 | zf-CCCH | 324 | 349 | 38.8 | 1.90E−08 |
| 1121 | AUX_IAA | 7 | 222 | 240.4 | 3.90E−69 |
| 1122 | zf-B_box | 1 | 47 | 39 | 1.70E−08 |
| 1122 | zf-B_box | 51 | 96 | 46.8 | 7.50E−11 |
| 1124 | SRF-TF | 9 | 59 | 118.2 | 2.30E−32 |
| 1124 | K-box | 75 | 174 | 158.7 | 1.50E−44 |
| 1125 | SRF-TF | 9 | 59 | 110.5 | 4.80E−30 |
| 1125 | K-box | 75 | 174 | 141.1 | 2.90E−39 |
| 1126 | SRF-TF | 9 | 59 | 120.8 | 3.90E−33 |
| 1126 | K-box | 75 | 174 | 162.3 | 1.20E−45 |
| 1127 | SRF-TF | 9 | 59 | 124.4 | 3.10E−34 |
| 1127 | K-box | 75 | 174 | 167.9 | 2.60E−47 |
| 1128 | SRF-TF | 9 | 59 | 124.4 | 3.10E−34 |
| 1128 | K-box | 75 | 174 | 167.9 | 2.60E−47 |
| 1129 | FLO_LFY | 1 | 395 | 1029.1 | 0.00E+00 |
| 1130 | Hydrolase | 114 | 295 | 47.5 | 4.50E−11 |
| 1131 | Hydrolase | 130 | 317 | 50 | 8.20E−12 |
| 1132 | Hydrolase | 110 | 298 | 45.1 | 2.30E−10 |
| 1133 | AP2 | 15 | 80 | 145.7 | 1.20E−40 |
| 1140 | Pkinase | 20 | 275 | 350.4 | 3.00E−102 |
| 1140 | NAF | 314 | 374 | 120 | 6.50E−33 |
| 1141 | WD40 | 560 | 599 | 34.5 | 3.70E−07 |
| 1141 | WD40 | 646 | 683 | 30.4 | 6.10E−06 |
| 1142 | Pkinase | 139 | 401 | 317.6 | 2.30E−92 |
| 1143 | EMP24_GP25L | 76 | 137 | 56.3 | 1.00E−13 |
| 1144 | RRM_1 | 4 | 70 | 55.9 | 1.40E−13 |
| 1144 | zf-CCHC | 86 | 103 | 32.5 | 1.40E−06 |
| 1145 | Frigida | 112 | 414 | 431.3 | 1.30E−126 |
| 1146 | DUF810 | 175 | 1046 | 1901.1 | 0.00E+00 |
| 1147 | Dor1 | 21 | 369 | 478.8 | 6.60E−141 |
| 1148 | Alpha-amylase | 26 | 356 | 188.4 | 1.70E−53 |
| 1148 | Alpha-amyl_C2 | 357 | 415 | 103.2 | 7.90E−28 |
| 1149 | AT_hook | 99 | 111 | 7.4 | 1.20E+00 |
| 1149 | DUF296 | 126 | 246 | 177.4 | 3.60E−50 |
| 1150 | IMPDH | 23 | 491 | 672.5 | 3.20E−199 |
| 1150 | CBS | 53 | 218 | 21.4 | 8.00E−04 |
| 1151 | IMPDH | 35 | 512 | 774.3 | 7.60E−230 |
| 1151 | CBS | 119 | 235 | 89.6 | 9.60E−24 |
| 1152 | IMPDH | 7 | 473 | 831.3 | 5.20E−247 |
| 1152 | CBS | 91 | 206 | 91.4 | 2.80E−24 |
| 1153 | IMPDH | 12 | 486 | 777.4 | 8.30E−231 |
| 1153 | CBS | 96 | 218 | 104.2 | 3.70E−28 |
| 1154 | zf-CCCH | 38 | 64 | 22.1 | 1.60E−03 |
| 1154 | zf-CCCH | 105 | 131 | 33.5 | 7.60E−07 |
| 1154 | KH_1 | 174 | 236 | 56.7 | 7.50E−14 |
| 1154 | zf-CCCH | 274 | 299 | 46.2 | 1.10E−10 |
| 1155 | Response_reg | 21 | 134 | 102.7 | 1.10E−27 |
| 1155 | Myb_DNA-binding | 214 | 264 | 50.1 | 7.50E−12 |
| 1156 | zf-C3HC4 | 251 | 291 | 37.3 | 5.10E−08 |
| 1157 | MFS_1 | 129 | 549 | 28.1 | 1.60E−05 |
| 1158 | Sugar_tr | 34 | 472 | −51.8 | 3.00E−05 |
| 1159 | AP2 | 15 | 80 | 145.2 | 1.70E−40 |
| 1160 | AP2 | 7 | 72 | 145.6 | 1.30E−40 |
| 1161 | Pyridoxal_deC | 35 | 383 | 513.3 | 2.70E−151 |
| 1162 | AUX_IAA | 7 | 263 | 378.3 | 1.20E−110 |
| 1163 | Cyclin_N | 92 | 207 | 148.4 | 1.90E−41 |
| 1163 | Cyclin_C | 209 | 336 | 128.3 | 2.20E−35 |
| 1164 | Cyclin_N | 183 | 321 | 109.6 | 9.10E−30 |
| 1166 | zf-Dof | 105 | 167 | 142.4 | 1.20E−39 |
| 1167 | NAM | 52 | 179 | 232 | 1.30E−66 |
| 1168 | NAM | 18 | 145 | 252.2 | 1.10E−72 |
| 1169 | p450 | 41 | 477 | 129.4 | 9.70E−36 |
| 1170 | LRRNT_2 | 23 | 63 | 40.6 | 5.40E−09 |
| 1170 | LRR_1 | 90 | 112 | 14 | 5.60E−01 |
| 1170 | LRR_1 | 114 | 136 | 22.7 | 1.30E−03 |
| 1170 | LRR_1 | 162 | 184 | 13.2 | 9.40E−01 |
| 1170 | LRR_1 | 186 | 208 | 9.7 | 4.40E+00 |
| 1170 | LRR_1 | 234 | 256 | 16 | 1.30E−01 |
| 1170 | LRR_1 | 258 | 280 | 12.4 | 1.40E+00 |
| 1170 | LRR_1 | 282 | 304 | 12.3 | 1.40E+00 |
| 1170 | LRR_1 | 306 | 328 | 13.3 | 8.70E−01 |
| 1170 | LRR_1 | 354 | 376 | 13.9 | 5.90E−01 |
| 1170 | LRR_1 | 402 | 425 | 11.7 | 1.80E+00 |
| 1170 | LRR_1 | 448 | 470 | 13.8 | 6.10E−01 |
| 1170 | LRR_1 | 472 | 494 | 9.8 | 4.20E+00 |
| 1170 | LRR_1 | 519 | 541 | 14.8 | 3.10E−01 |
| 1170 | LRR_1 | 543 | 565 | 9.6 | 4.50E+00 |
| 1170 | LRR_1 | 567 | 589 | 16.1 | 1.20E−01 |
| 1170 | LRR_1 | 591 | 613 | 18.7 | 2.20E−02 |
| 1170 | LRR_1 | 615 | 638 | 10.8 | 2.70E+00 |
| 1170 | LRR_1 | 748 | 771 | 13.4 | 8.20E−01 |
| 1170 | LRR_1 | 772 | 795 | 9.7 | 4.50E+00 |
| 1170 | LRR_1 | 824 | 846 | 16.4 | 1.00E−01 |
| 1170 | LRR_1 | 848 | 870 | 11.8 | 1.80E+00 |
| 1170 | Pkinase_Tyr | 1002 | 1275 | 118.5 | 1.80E−32 |
| 1170 | Pkinase | 1002 | 1275 | 145.9 | 1.10E−40 |
| 1171 | LRRNT_2 | 21 | 60 | 65.1 | 2.30E−16 |
| 1171 | LRR_1 | 139 | 158 | 8.6 | 7.00E+00 |
| 1171 | LRR_1 | 185 | 207 | 18.2 | 3.00E−02 |
| 1171 | LRR_1 | 209 | 231 | 12.5 | 1.30E+00 |
| 1171 | LRR_1 | 233 | 255 | 16.3 | 1.10E−01 |
| 1171 | LRR_1 | 259 | 281 | 17.6 | 4.40E−02 |
| 1171 | LRR_1 | 283 | 306 | 13.9 | 5.70E−01 |
| 1171 | LRR_1 | 308 | 330 | 11.5 | 2.00E+00 |
| 1171 | LRR_1 | 332 | 354 | 11.8 | 3.20E+00 |
| 1171 | LRR_1 | 357 | 379 | 12.1 | 1.50E+00 |
| 1171 | LRR_1 | 381 | 403 | 10 | 3.90E+00 |
| 1171 | LRR_1 | 429 | 451 | 14.3 | 4.30E−01 |
| 1171 | LRR_1 | 453 | 475 | 12.3 | 1.40E+00 |
| 1171 | LRR_1 | 477 | 499 | 12.9 | 1.10E+00 |
| 1171 | LRR_1 | 501 | 520 | 11.1 | 2.40E+00 |
| 1171 | LRR_1 | 593 | 615 | 15.6 | 1.80E−01 |
| 1171 | LRR_1 | 617 | 639 | 15.7 | 1.70E−01 |
| 1171 | LRR_1 | 641 | 663 | 12.1 | 1.50E+00 |
| 1171 | Pkinase | 824 | 1098 | 139.3 | 1.10E−38 |
| 1171 | Pkinase_Tyr | 824 | 1098 | 124 | 4.20E−34 |
| 1172 | LRR_1 | 199 | 219 | 8.6 | 7.20E+00 |
| 1172 | LRR_1 | 221 | 244 | 16.5 | 9.50E−02 |
| 1172 | LRR_1 | 246 | 268 | 14.3 | 4.40E−01 |
| 1172 | LRR_1 | 270 | 293 | 17.5 | 4.70E−02 |
| 1172 | LRR_1 | 295 | 317 | 11.9 | 1.70E+00 |
| 1172 | LRR_1 | 319 | 342 | 13.5 | 8.00E−01 |

TABLE 22-continued

| PEP SEQ ID | Pfam domain | Start | End | score | E-value |
|---|---|---|---|---|---|
| 1172 | LRR_1 | 345 | 367 | 13.3 | 9.00E-01 |
| 1172 | LRR_1 | 369 | 391 | 15.1 | 2.50E-01 |
| 1172 | LRR_1 | 393 | 415 | 10.3 | 3.40E+00 |
| 1172 | LRR_1 | 417 | 439 | 16.4 | 1.00E-01 |
| 1172 | LRR_1 | 441 | 463 | 13.5 | 7.80E-01 |
| 1172 | LRR_1 | 465 | 487 | 14.3 | 4.50E-01 |
| 1172 | LRR_1 | 489 | 511 | 13.8 | 6.20E-01 |
| 1172 | LRR_1 | 582 | 604 | 10.8 | 2.70E+00 |
| 1172 | LRR_1 | 630 | 652 | 19.3 | 1.40E-02 |
| 1172 | LRR_1 | 653 | 674 | 16.4 | 1.10E-01 |
| 1172 | Pkinase_Tyr | 807 | 1080 | 114.8 | 2.50E-31 |
| 1172 | Pkinase | 807 | 1080 | 161.6 | 2.00E-45 |
| 1173 | FAD_binding_4 | 55 | 200 | 30 | 8.20E-06 |
| 1174 | FAD_binding_4 | 55 | 200 | 29.3 | 1.40E-05 |
| 1175 | Sterol_desat | 35 | 210 | 87 | 5.70E-23 |
| 1176 | Sterol_desat | 35 | 246 | 180.6 | 3.90E-51 |
| 1177 | Sterol_desat | 37 | 248 | 184.2 | 3.20E-52 |
| 1178 | Sterol_desat | 43 | 254 | 215.6 | 1.10E-61 |
| 1179 | Peptidase_S10 | 41 | 465 | 669.2 | 3.10E-198 |
| 1180 | Peptidase_S10 | 56 | 474 | 711.4 | 6.30E-211 |
| 1181 | F-box | 205 | 253 | 30.2 | 7.10E-06 |
| 1181 | Kelch_1 | 300 | 348 | 18.6 | 2.20E-02 |
| 1181 | Kelch_2 | 300 | 348 | 23.7 | 6.70E-04 |
| 1181 | Kelch_1 | 352 | 400 | 8.4 | 4.30E-01 |
| 1181 | Kelch_2 | 353 | 400 | 26.4 | 1.00E-04 |
| 1181 | Kelch_1 | 405 | 453 | 15.4 | 7.00E-02 |
| 1181 | Kelch_2 | 524 | 572 | 34.3 | 4.20E-07 |
| 1182 | F-box | 272 | 320 | 28.5 | 2.40E-05 |
| 1182 | Kelch_1 | 367 | 415 | 21 | 4.10E-03 |
| 1182 | Kelch_2 | 367 | 415 | 20.6 | 5.50E-03 |
| 1182 | Kelch_2 | 420 | 467 | 24.4 | 4.10E-04 |
| 1182 | Kelch_2 | 471 | 520 | 15.1 | 2.50E-01 |
| 1182 | Kelch_1 | 472 | 520 | 12 | 1.70E-01 |
| 1182 | Kelch_1 | 525 | 576 | 8.7 | 4.00E-01 |
| 1182 | Kelch_2 | 525 | 576 | 20 | 8.40E-03 |
| 1182 | Kelch_2 | 586 | 634 | 29.8 | 9.70E-06 |
| 1183 | ADH_N | 36 | 165 | 116.7 | 6.40E-32 |
| 1183 | ADH_zinc_N | 196 | 342 | 117 | 5.40E-32 |
| 1184 | ADH_N | 27 | 155 | 135.6 | 1.30E-37 |
| 1184 | ADH_zinc_N | 186 | 332 | 115.4 | 1.70E-31 |
| 1185 | ADH_N | 27 | 155 | 118.3 | 2.10E-32 |
| 1185 | ADH_zinc_N | 186 | 328 | 139.2 | 1.10E-38 |
| 1186 | ADH_N | 36 | 165 | 130.6 | 4.50E-36 |
| 1186 | ADH_zinc_N | 196 | 338 | 129.9 | 6.80E-36 |
| 1187 | ADH_N | 36 | 165 | 135 | 2.00E-37 |
| 1187 | ADH_zinc_N | 196 | 338 | 124.6 | 2.70E-34 |
| 1188 | ADH_N | 35 | 163 | 116.1 | 1.00E-31 |
| 1188 | ADH_zinc_N | 197 | 343 | 119.6 | 9.10E-33 |
| 1189 | ADH_N | 34 | 163 | 119.4 | 1.00E-32 |
| 1189 | ADH_zinc_N | 194 | 336 | 145.3 | 1.60E-40 |
| 1190 | ADH_N | 34 | 163 | 121.3 | 2.70E-33 |
| 1190 | ADH_zinc_N | 194 | 336 | 126.3 | 8.30E-35 |
| 1191 | TPT | 156 | 298 | 165.2 | 1.70E-46 |
| 1192 | TPT | 154 | 296 | 177.3 | 3.90E-50 |
| 1193 | TPT | 151 | 293 | 150.6 | 4.10E-42 |
| 1194 | Sugar_tr | 91 | 552 | 421.2 | 1.50E-123 |
| 1194 | MFS_1 | 95 | 511 | 85.3 | 1.80E-22 |
| 1195 | Cyclin_N | 61 | 193 | 117.1 | 5.00E-32 |
| 1195 | Cyclin_C | 195 | 326 | 36.6 | 8.70E-08 |
| 1196 | SAC3_GANP | 24 | 209 | 90.8 | 4.10E-24 |
| 1197 | SAC3_GANP | 20 | 211 | 214.5 | 2.30E-61 |
| 1198 | SAC3_GANP | 24 | 209 | 106.9 | 5.90E-29 |
| 1199 | SAC3_GANP | 24 | 209 | 122.2 | 1.40E-33 |
| 1200 | WD40 | 183 | 220 | 26.2 | 1.20E-04 |
| 1200 | WD40 | 289 | 328 | 33.8 | 5.90E-07 |
| 1201 | WD40 | 204 | 241 | 26.2 | 1.20E-04 |
| 1201 | WD40 | 311 | 350 | 33.8 | 5.90E-07 |
| 1202 | CHASE | 86 | 298 | 339 | 8.00E-99 |
| 1202 | HisKA | 359 | 424 | 83.1 | 8.50E-22 |
| 1202 | HATPase_c | 471 | 654 | 130.1 | 6.30E-36 |
| 1202 | Response_reg | 829 | 963 | 111.6 | 2.20E-30 |
| 1203 | CHASE | 198 | 411 | 356.8 | 3.40E-104 |
| 1203 | HisKA | 472 | 537 | 93.4 | 6.90E-25 |
| 1203 | HATPase_c | 584 | 759 | 124.3 | 3.50E-34 |
| 1203 | Response_reg | 945 | 1068 | 106.2 | 9.70E-29 |
| 1204 | CHASE | 302 | 526 | 342.6 | 6.40E-100 |
| 1204 | HisKA | 587 | 652 | 90.2 | 6.20E-24 |
| 1204 | HATPase_c | 699 | 866 | 132.7 | 9.90E-37 |
| 1204 | Response_reg | 1035 | 1170 | 106.9 | 6.00E-29 |
| 1205 | CHASE | 163 | 389 | 347.6 | 2.10E-101 |
| 1205 | HisKA | 450 | 515 | 89.7 | 9.00E-24 |
| 1205 | HATPase_c | 562 | 722 | 128.9 | 1.40E-35 |
| 1205 | Response_reg | 890 | 1025 | 92.6 | 1.20E-24 |
| 1206 | MFS_1 | 66 | 429 | 63.7 | 5.90E-16 |
| 1207 | MFS_1 | 69 | 432 | 56.4 | 9.20E-14 |
| 1208 | MFS_1 | 51 | 415 | 50.8 | 4.50E-12 |
| 1209 | CHASE | 110 | 321 | 288.1 | 1.70E-83 |
| 1209 | HisKA | 382 | 447 | 88.4 | 2.20E-23 |
| 1209 | HATPase_c | 494 | 682 | 112.8 | 9.90E-31 |
| 1209 | Response_reg | 869 | 1004 | 105.6 | 1.50E-28 |
| 1210 | PTR2 | 113 | 517 | 661.3 | 7.40E-196 |
| 1211 | PTR2 | 118 | 521 | 399.1 | 6.60E-117 |
| 1212 | PTR2 | 97 | 499 | 482.9 | 3.80E-142 |
| 1213 | PTR2 | 122 | 526 | 531.9 | 6.60E-157 |
| 1214 | PTR2 | 98 | 500 | 500.5 | 1.90E-147 |
| 1215 | AT_hook | 34 | 46 | 7.5 | 1.20E+00 |
| 1215 | DUF296 | 61 | 180 | 198.4 | 1.70E-56 |
| 1220 | BIR | 20 | 117 | 62.6 | 1.30E-15 |
| 1220 | BIR | 153 | 241 | 96.5 | 7.70E-26 |
| 1221 | AT_hook | 34 | 46 | 7.5 | 1.20E+00 |
| 1221 | DUF296 | 61 | 180 | 198.4 | 1.70E-56 |
| 1224 | Bap31 | 1 | 188 | 39.2 | 4.60E-11 |

TABLE 23

| Pfam domain name | Accession # | Gathering cutoff | Domain description |
|---|---|---|---|
| 14-3-3 | PF00244.10 | 25.0 | 14-3-3 protein |
| 2-Hacid_dh_C | PF02826.9 | -82.2 | D-isomer specific 2-hydroxyacid dehydrogenase, NAD binding domain |
| 2OG-FeII_Oxy | PF03171.10 | 11.5 | 2OG-Fe(II) oxygenase superfamily |
| AA_permease | PF00324.11 | -120.8 | Amino acid permease |
| ABA_WDS | PF02496.6 | 25.0 | ABA/WDS induced protein |
| ADH_N | PF08240.2 | -14.5 | Alcohol dehydrogenase GroES-like domain |
| ADH_zinc_N | PF00107.16 | 23.8 | Zinc-binding dehydrogenase |
| AP2 | PF00847.10 | 0.0 | AP2 domain |
| AT_hook | PF02178.9 | 3.6 | AT hook motif |
| AUX_IAA | PF02309.7 | -83.0 | AUX/IAA family |
| AdoHcyase | PF05221.7 | -205.2 | S-adenosyl-L-homocysteine hydrolase |
| AdoHcyase_NAD | PF00670.12 | -23.6 | S-adenosyl-L-homocysteine hydrolase, NAD binding domain |
| Aldedh | PF00171.12 | -209.3 | Aldehyde dehydrogenase family |
| Aldo_ket_red | PF00248.11 | -97.0 | Aldo/keto reductase family |
| Alpha-amyl_C2 | PF07821.3 | 25.0 | Alpha-amylase C-terminal beta-sheet domain |
| Alpha-amylase | PF00128.14 | -92.6 | Alpha amylase, catalytic domain |

TABLE 23-continued

| Pfam domain name | Accession # | Gathering cutoff | Domain description |
|---|---|---|---|
| Ank | PF00023.20 | 0.0 | Ankyrin repeat |
| Arm | PF00514.13 | 17.0 | Armadillo/beta-catenin-like repeat |
| Asp | PF00026.14 | −153.8 | Eukaryotic aspartyl protease |
| BCCT | PF02028.8 | −17.0 | BCCT family transporter |
| BIR | PF00653.12 | 0.0 | Inhibitor of Apoptosis domain |
| BRAP2 | PF07576.2 | 0.7 | BRCA1-associated protein 2 |
| BRCT | PF00533.16 | 27.8 | BRCA1 C Terminus (BRCT) domain |
| BTB | PF00651.21 | 6.2 | BTB/POZ domain |
| B_lectin | PF01453.15 | 28.2 | D-mannose binding lectin |
| Bap31 | PF05529.2 | −39.4 | B-cell receptor-associated protein 31-like |
| Bromodomain | PF00439.15 | 8.9 | Bromodomain |
| C1_1 | PF00130.12 | 10.5 | Phorbol esters/diacylglycerol binding domain (C1 domain) |
| C2 | PF00168.20 | 3.7 | C2 domain |
| CBFD_NFYB_HMF | PF00808.13 | 18.4 | Histone-like transcription factor (CBF/NF-Y) and archaeal histone |
| CBS | PF00571.18 | 17.5 | CBS domain pair |
| CCT | PF06203.4 | 25.0 | CCT motif |
| CHASE | PF03924.4 | 25.0 | CHASE domain |
| CK_II_beta | PF01214.9 | −106.0 | Casein kinase II regulatory subunit |
| CMAS | PF02353.10 | −177.9 | Cyclopropane-fatty-acyl-phospholipid synthase |
| Cellulose_synt | PF03552.5 | −257.9 | Cellulose synthase |
| Copine | PF07002.6 | −36.5 | Copine |
| Cu-oxidase | PF00394.12 | −18.9 | Multicopper oxidase |
| Cu-oxidase_2 | PF07731.4 | −5.8 | Multicopper oxidase |
| Cu-oxidase_3 | PF07732.5 | 10.0 | Multicopper oxidase |
| Cu_bind_like | PF02298.8 | −16.4 | Plastocyanin-like domain |
| Cullin | PF00888.12 | −33.3 | Cullin family |
| Cyclin_C | PF02984.9 | −13.0 | Cyclin, C-terminal domain |
| Cyclin_N | PF00134.13 | −14.7 | Cyclin, N-terminal domain |
| DAD | PF02109.6 | 25.0 | DAD family |
| DAGK_acc | PF00609.10 | −50.0 | Diacylglycerol kinase accessory domain |
| DAGK_cat | PF00781.14 | −5.7 | Diacylglycerol kinase catalytic domain (presumed) |
| DPBB_1 | PF03330.8 | 5.3 | Rare lipoprotein A (RlpA)-like double-psi beta-barrel |
| DUF1313 | PF07011.2 | 25.0 | Protein of unknown function (DUF1313) |
| DUF221 | PF02714.6 | 25.0 | Domain of unknown function DUF221 |
| DUF231 | PF03005.6 | −58.0 | Arabidopsis proteins of unknown function |
| DUF296 | PF03479.5 | −11.0 | Domain of unknown function (DUF296) |
| DUF580 | PF04515.3 | 25.0 | Protein of unknown function, DUF580 |
| DUF6 | PF00892.11 | 20.8 | Integral membrane protein DUF6 |
| DUF810 | PF05664.2 | 25.0 | Protein of unknown function (DUF810) |
| DUF850 | PF05863.3 | 25.0 | Eukaryotic protein of unknown function (DUF850) |
| DUF914 | PF06027.3 | −193.0 | Eukaryotic protein of unknown function (DUF914) |
| DXP_redisom_C | PF08436.3 | 25.0 | 1-deoxy-D-xylulose 5-phosphate reductoisomerase C-terminal |
| DXP_reductoisom | PF02670.7 | −49.7 | 1-deoxy-D-xylulose 5-phosphate reductoisomerase |
| Dor1 | PF04124.3 | 25.0 | Dor1-like family |
| EMP24_GP25L | PF01105.14 | 10.0 | emp24/gp25L/p24 family/GOLD |
| Enolase_C | PF00113.12 | −71.2 | Enolase, C-terminal TIM barrel domain |
| Enolase_N | PF03952.6 | 11.3 | Enolase, N-terminal domain |
| Epimerase | PF01370.11 | −46.3 | NAD dependent epimerase/dehydratase family |
| Exo_endo_phos | PF03372.13 | 11.0 | Endonuclease/Exonuclease/phosphatase family |
| F-box | PF00646.23 | 13.9 | F-box domain |
| FAD_binding_4 | PF01565.13 | −8.1 | FAD binding domain |
| FAD_binding_6 | PF00970.14 | −11.4 | Oxidoreductase FAD-binding domain |
| FAT | PF02259.13 | 275.0 | FAT domain |
| FATC | PF02260.10 | 20.0 | FATC domain |
| FBPase | PF00316.10 | −170.3 | Fructose-1-6-bisphosphatase |
| FBPase_glpX | PF03320.4 | −198.1 | Bacterial fructose-1,6-bisphosphatase, glpX-encoded |
| FLO_LFY | PF01698.7 | −225.0 | Floricaula/Leafy protein |
| Flavodoxin_2 | PF02525.7 | −46.4 | Flavodoxin-like fold |
| Flavoprotein | PF02441.9 | 11.0 | Flavoprotein |
| Frigida | PF07899.2 | −62.5 | Frigida-like protein |
| G-alpha | PF00503.10 | −230.0 | G-protein alpha subunit |
| GAF | PF01590.16 | 23.0 | GAF domain |
| GH3 | PF03321.4 | −336.0 | GH3 auxin-responsive promoter |
| GRAS | PF03514.5 | −78.0 | GRAS family transcription factor |
| GST_C | PF00043.15 | 22.3 | Glutathione S-transferase, C-terminal domain |
| GST_N | PF02798.10 | 14.6 | Glutathione S-transferase, N-terminal domain |

TABLE 23-continued

| Pfam domain name | Accession # | Gathering cutoff | Domain description |
|---|---|---|---|
| Globin | PF00042.12 | −8.8 | Globin |
| Glutaredoxin | PF00462.14 | 17.2 | Glutaredoxin |
| Glyco_transf_20 | PF00982.11 | −243.6 | Glycosyltransferase family 20 |
| Glycos_transf_1 | PF00534.10 | −7.3 | Glycosyl transferases group 1 |
| HALZ | PF02183.8 | 17.0 | Homeobox associated leucine zipper |
| HATPase_c | PF02518.16 | 22.4 | Histidine kinase-, DNA gyrase B-, and HSP90-like ATPase |
| HD-ZIP_N | PF04618.3 | 25.0 | HD-ZIP protein N terminus |
| HEAT | PF02985.12 | 11.5 | HEAT repeat |
| HLH | PF00010.16 | 8.3 | Helix-loop-helix DNA-binding domain |
| HMG_box | PF00505.9 | 4.1 | HMG (high mobility group) box |
| HSF_DNA-bind | PF00447.8 | −70.0 | HSF-type DNA-binding |
| H_PPase | PF03030.7 | −377.0 | Inorganic H+ pyrophosphatase |
| Hexapep | PF00132.14 | 0.3 | Bacterial transferase hexapeptide (three repeats) |
| HisKA | PF00512.15 | 10.3 | His Kinase A (phosphoacceptor) domain |
| Histone | PF00125.14 | 17.4 | Core histone H2A/H2B/H3/H4 |
| Homeobox | PF00046.19 | −4.1 | Homeobox domain |
| Hpt | PF01627.13 | 25.0 | Hpt domain |
| Hydrolase | PF00702.16 | 13.6 | haloacid dehalogenase-like hydrolase |
| Hydrolase_3 | PF08282.2 | −64.8 | haloacid dehalogenase-like hydrolase |
| IMPDH | PF00478.15 | −190.6 | IMP dehydrogenase/GMP reductase domain |
| IPP-2 | PF04979.4 | −30.0 | Protein phosphatase inhibitor 2 (IPP-2) |
| IlvN | PF07991.2 | −75.8 | Acetohydroxy acid isomeroreductase, catalytic domain |
| K-box | PF01486.8 | 0.0 | K-box region |
| KH_1 | PF00013.19 | 10.5 | KH domain |
| KR | PF08659.1 | −74.3 | KR domain |
| Kelch_1 | PF01344.15 | 7.8 | Kelch motif |
| Kelch_2 | PF07646.5 | 14.0 | Kelch motif |
| LEA_2 | PF03168.4 | 25.0 | Late embryogenesis abundant protein |
| LEA_4 | PF02987.7 | 22.6 | Late embryogenesis abundant protein |
| LIM | PF00412.12 | 0.0 | LIM domain |
| LRRNT_2 | PF08263.3 | 18.6 | Leucine rich repeat N-terminal domain |
| LRR_1 | PF00560.23 | 7.7 | Leucine Rich Repeat |
| LRR_2 | PF07723.3 | 6.0 | Leucine Rich Repeat |
| Lactamase_B | PF00753.17 | 24.6 | Metallo-beta-lactamase superfamily |
| Linker_histone | PF00538.9 | −8.0 | linker histone H1 and H5 family |
| LysM | PF01476.10 | 20.0 | LysM domain |
| MED7 | PF05983.2 | −39.2 | MED7 protein |
| MFMR | PF07777.2 | −46.7 | G-box binding protein MFMR |
| MFS_1 | PF07690.6 | 23.5 | Major Facilitator Superfamily |
| MIF4G | PF02854.9 | −6.0 | MIF4G domain |
| MIF4G_like | PF09088.1 | 25.0 | MIF4G like |
| MIF4G_like_2 | PF09090.1 | −46.1 | MIF4G like |
| MatE | PF01554.9 | −4.8 | MatE |
| Melibiase | PF02065.9 | −228.6 | Melibiase |
| Methyltransf_11 | PF08241.2 | 20.9 | Methyltransferase domain |
| Methyltransf_12 | PF08242.2 | 23.0 | Methyltransferase domain |
| Mito_carr | PF00153.17 | 0.0 | Mitochondrial carrier protein |
| Mlo | PF03094.6 | −263.0 | Mlo family |
| MtN3_slv | PF03083.6 | 9.7 | MtN3/saliva family |
| Myb_DNA-binding | PF00249.21 | 14.0 | Myb-like DNA-binding domain |
| NAD_binding_1 | PF00175.11 | −3.9 | Oxidoreductase NAD-binding domain |
| NAD_binding_4 | PF07993.2 | −87.7 | Male sterility protein |
| NAF | PF03822.5 | 4.5 | NAF domain |
| NAF1 | PF05492.3 | −43.3 | NAF1 domain |
| NAM | PF02365.6 | −19.0 | No apical meristem (NAM) protein |
| NAS | PF03059.6 | −60.0 | Nicotianamine synthase protein |
| NPH3 | PF03000.5 | 25.0 | NPH3 family |
| Na_H_Exchanger | PF00999.11 | −67.9 | Sodium/hydrogen exchanger family |
| OPT | PF03169.6 | −238.6 | OPT oligopeptide transporter protein |
| Orn_Arg_deC_N | PF02784.7 | −76.0 | Pyridoxal-dependent decarboxylase, pyridoxal binding domain |
| Orn_DAP_Arg_deC | PF00278.12 | 6.7 | Pyridoxal-dependent decarboxylase, C-terminal sheet domain |
| P-II | PF00543.12 | −29.0 | Nitrogen regulatory protein P-II |
| PA | PF02225.12 | 13.0 | PA domain |
| PAN_1 | PF00024.16 | 1.4 | PAN domain |
| PAN_2 | PF08276.2 | −4.9 | PAN-like domain |
| PB1 | PF00564.15 | 12.3 | PB1 domain |
| PBP | PF01161.10 | −20.6 | Phosphatidylethanolamine-binding protein |
| PEMT | PF04191.3 | 25.0 | Phospholipid methyltransferase |
| PEP-utilizers | PF00391.13 | 0.6 | PEP-utilising enzyme, mobile domain |
| PEP-utilizers_C | PF02896.8 | −173.0 | PEP-utilising enzyme, TIM barrel domain |
| PHD | PF00628.19 | 25.9 | PHD-finger |

TABLE 23-continued

| Pfam domain name | Accession # | Gathering cutoff | Domain description |
|---|---|---|---|
| PI-PLC-X | PF00388.9 | 18.8 | Phosphatidylinositol-specific phospholipase C, X domain |
| PI-PLC-Y | PF00387.9 | −11.0 | Phosphatidylinositol-specific phospholipase C, Y domain |
| PI3_PI4_kinase | PF00454.17 | 14.8 | Phosphatidylinositol 3- and 4-kinase |
| PMEI | PF04043.6 | 25.0 | Plant invertase/pectin methylesterase inhibitor |
| PPDK_N | PF01326.9 | −150.2 | Pyruvate phosphate dikinase, PEP/pyruvate binding domain |
| PSK | PF06404.3 | 25.0 | Phytosulfokine precursor protein (PSK) |
| PTR2 | PF00854.12 | −50.0 | POT family |
| PaO | PF08417.2 | 25.0 | Pheophorbide a oxygenase |
| Peptidase_C14 | PF00656.12 | −22.5 | Caspase domain |
| Peptidase_S10 | PF00450.12 | −198.0 | Serine carboxypeptidase |
| Pescadillo_N | PF06732.2 | −167.1 | Pescadillo N-terminus |
| PfkB | PF00294.14 | −67.8 | pfkB family carbohydrate kinase |
| Phytochrome | PF00360.10 | 13.0 | Phytochrome region |
| Pirin | PF02678.6 | 25.0 | Pirin |
| Pirin_C | PF05726.3 | −8.8 | Pirin C-terminal cupin domain |
| Pkinase | PF00069.15 | −70.3 | Protein kinase domain |
| Pkinase_C | PF00433.14 | 14.0 | Protein kinase C terminal domain |
| Pkinase_Tyr | PF07714.7 | 65.0 | Protein tyrosine kinase |
| Pollen_allerg_1 | PF01357.11 | 17.2 | Pollen allergen |
| Prp19 | PF08606.2 | −1.5 | Prp19/Pso4-like |
| Put_Phosphatase | PF06888.3 | −100.0 | Putative Phosphatase |
| Pyridoxal_deC | PF00282.9 | −158.6 | Pyridoxal-dependent decarboxylase conserved domain |
| RPE65 | PF03055.6 | −156.5 | Retinal pigment epithelial membrane protein |
| RRM_1 | PF00076.12 | 17.7 | RNA recognition motif. (a.k.a. RRM, RBD, or RNP domain) |
| Rapamycin_bind | PF08771.1 | 25.0 | Rapamycin binding domain |
| Remorin_C | PF03763.4 | 25.0 | Remorin, C-terminal region |
| Remorin_N | PF03766.4 | 10.1 | Remorin, N-terminal region |
| Response_reg | PF00072.14 | 4.0 | Response regulator receiver domain |
| Ribonuc_2-5A | PF06479.2 | 25.0 | Ribonuclease 2-5A |
| Ribosomal_60s | PF00428.9 | 6.0 | 60s Acidic ribosomal protein |
| Ribosomal_L10 | PF00466.10 | −14.0 | Ribosomal protein L10 |
| Ribosomal_L18p | PF00861.12 | 25.0 | Ribosomal L18p/L5e family |
| Rieske | PF00355.16 | −7.0 | Rieske [2Fe—2S] domain |
| S-methyl_trans | PF02574.6 | −33.2 | Homocysteine S-methyltransferase |
| S6PP | PF05116.4 | −113.7 | Sucrose-6F-phosphate phosphohydrolase |
| S6PP_C | PF08472.1 | −34.2 | Sucrose-6-phosphate phosphohydrolase C-terminal |
| SAC3_GANP | PF03399.6 | −15.2 | SAC3/GANP/Nin1/mts3/eIF-3 p25 family |
| SATase_N | PF06426.4 | 25.0 | Serine acetyltransferase, N-terminal |
| SBP | PF03110.5 | 25.0 | SBP domain |
| SBP56 | PF05694.2 | 25.0 | 56 kDa selenium binding protein (SBP56) |
| SET | PF00856.18 | 23.5 | SET domain |
| SOH1 | PF05669.3 | 25.0 | SOH1 |
| SPX | PF03105.10 | −20.0 | SPX domain |
| SRF-TF | PF00319.9 | 11.0 | SRF-type transcription factor (DNA-binding and dimerisation domain) |
| S_locus_glycop | PF00954.11 | −12.7 | S-locus glycoprotein family |
| Sigma70_r2 | PF04542.4 | 18.6 | Sigma-70 region 2 |
| Sigma70_r3 | PF04539.6 | 10.0 | Sigma-70 region 3 |
| Sigma70_r4 | PF04545.6 | 21.6 | Sigma-70, region 4 |
| Sina | PF03145.7 | −48.4 | Seven in absentia protein family |
| Skp1 | PF01466.9 | −2.0 | Skp1 family, dimerisation domain |
| Skp1_POZ | PF03931.5 | 14.9 | Skp1 family, tetramerisation domain |
| Sterol_desat | PF01598.8 | −13.0 | Sterol desaturase |
| Sugar_tr | PF00083.14 | −85.0 | Sugar (and other) transporter |
| TFIIS | PF08711.1 | 3.0 | Transcription elongation factor S-II protein N terminal |
| TFIIS_C | PF01096.9 | 15.0 | Transcription factor S-II (TFIIS) |
| TFIIS_M | PF07500.4 | 7.4 | Transcription factor S-II (TFIIS), central domain |
| TLC | PF03219.5 | 25.0 | TLC ATP/ADP transporter |
| TPR_1 | PF00515.18 | 7.7 | Tetratricopeptide repeat |
| TPR_2 | PF07719.7 | 20.1 | Tetratricopeptide repeat |
| TPT | PF03151.7 | −15.3 | Triose-phosphate Transporter family |
| Transket_pyr | PF02779.14 | −49.0 | Transketolase, pyrimidine binding domain |
| Transketolase_C | PF02780.10 | −15.5 | Transketolase, C-terminal domain |
| Tub | PF01167.8 | −98.0 | Tub family |
| U-box | PF04564.6 | −7.6 | U-box domain |
| UAA | PF08449.2 | −146.2 | UAA transporter family |
| UDPGP | PF01704.8 | −265.2 | UTP--glucose-1-phosphate uridylyltransferase |
| UPF0005 | PF01027.11 | −6.7 | Uncharacterised protein family UPF0005 |

TABLE 23-continued

| Pfam domain name | Accession # | Gathering cutoff | Domain description |
|---|---|---|---|
| UPF0041 | PF03650.4 | −33.6 | Uncharacterised protein family (UPF0041) |
| Ubie_methyltran | PF01209.9 | −117.0 | ubiE/COQ5 methyltransferase family |
| VDE | PF07137.2 | −40.0 | Violaxanthin de-epoxidase (VDE) |
| WD40 | PF00400.22 | 21.5 | WD domain, G-beta repeat |
| WRKY | PF03106.6 | 25.0 | WRKY DNA-binding domain |
| Zein | PF01559.7 | −21.0 | Zein seed storage protein |
| adh_short | PF00106.15 | −40.2 | short chain dehydrogenase |
| bZIP_1 | PF00170.11 | 24.5 | bZIP transcription factor |
| bZIP_2 | PF07716.5 | 15.0 | Basic region leucine zipper |
| dCMP_cyt_deam_1 | PF00383.13 | −9.0 | Cytidine and deoxycytidylate deaminase zinc-binding region |
| efhand | PF00036.22 | 21.7 | EF hand |
| p450 | PF00067.12 | −105.0 | Cytochrome P450 |
| zf-B_box | PF00643.14 | 15.3 | B-box zinc finger |
| zf-C2H2 | PF00096.16 | 17.7 | Zinc finger, C2H2 type |
| zf-C3HC4 | PF00097.15 | 16.0 | Zinc finger, C3HC4 type (RING finger) |
| zf-CCCH | PF00642.15 | 0.0 | Zinc finger C-x8-C-x5-C-x3-H type (and similar) |
| zf-CCHC | PF00098.13 | 17.9 | Zinc knuckle |
| zf-CHY | PF05495.3 | 25.0 | CHY zinc finger |
| zf-Dof | PF02701.6 | 25.0 | Dof domain, zinc finger |
| zf-LSD1 | PF06943.3 | 25.0 | LSD1 zinc finger |
| zf-UBP | PF02148.9 | 25.0 | Zn-finger in ubiquitin-hydrolases and other protein |

Example 9

Selection of Transgenic Plants with Enhanced Agronomic Trait(s)

This example illustrates the preparation and identification by selection of transgenic seeds and plants derived from transgenic plant cells of this invention having recombinant DNA in a chromosome in the nucleus of such cells. The plants and seeds are identified by screening for a transgenic plant having an enhanced agronomic trait imparted by expression of a protein selected from the group including the homologous proteins identified in Example 6. Transgenic plant cells of corn, soybean, cotton, canola, wheat and rice are transformed with recombinant DNA for expressing each of the homologs identified in Example 6. Plants are regenerated from the transformed plant cells and used to produce progeny plants and seed that are screened for enhanced water use efficiency, enhanced cold tolerance, increased yield, enhanced nitrogen use efficiency, enhanced seed protein and enhanced seed oil. Plants are identified exhibiting enhanced traits imparted by expression of the homologous proteins.

SEQUENCE LISTING (27426 sequences)

SEQ ID NO: 1 - DNA, 832 bp, Arabidopsis thaliana
gagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 2 - DNA, 1087 bp, Zea mays
gtaccggtccggaattcccgggtcgacccacgcgtccgctagccttctcgtcgctcctgttcttctcgcatccccagcccaggtggtgtcccctgtcgcgttgatgcatgctccctcggcggtggccttgagctgaggcggcggagcgatgccggactccgacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgcagcctcagccgccacagcagcagcagcagcaacatcaacagcatcacatggcaatgggaggcagaggaggattcggccaacaaggcggcggcggtggctcctcgtcgtcgtcagggcttggccggcaagacagggcgtgagttgcgacgatacgttcagaatcagaatcgctgatactcctacgtagaattatacctacctaattgatgacaccgcaccgcacctcgttgtgctgcctgtccttgtacgtttactaattattgctgcctgtatgtaaatcaaaatctgaggctcccatttcgaaacggccggtgaactactcttcccgtttcgtttcatacgagaatcgaactcgttttcaattaaaaaaaaaaaaaaaaaaaagggcggccgctctagaggatcca

SEQ ID NO: 3 - DNA, 1205 bp, Zea mays
cggtccggaattcccgggtcgacccacgcgtccgcgcaccctcccgggccgccttctcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaatggaggtatggaccttttctgcgacagctgctcttacctgaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgattacatgtatttgtatcgggaggcataaatattgtgtaatttgtgttaaagactggtgtaattgaactatgggaagagctgctttggttgtaaccatattttgatgcccgtatattaggcaaaaatagaaggctgtgggcgtgcacaacaaaaaaaaaaaaaaaaaaaaaaaaagggcggccgctctagaggatcca

SEQ ID NO: 4 - DNA, 1158 bp, Zea mays
ggtaccggtccggaattcccgggtcgacccacgcgtccgcggacgcgtgggttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacaggtaatctatcgtactgtcatttgttagtaaaacaatactgcagctattttccgtctcactaaacatggcagaaaatttcgatcattacattattccactaataattttctctctgtacgcactcagtaccacaatggggaaacctaataaagggctaatacagcagcaatttatggtaatattattgctccctgaattttgttaactaaagattctgtatcatgctatatgtatgtttccttttttcttcttctttgttttgacaattgcttctttctctacggtgtttatccatcagctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacataccaaaaaaaaaaaaaaaaaaaaaaagggcggccgctctagaggatcca

SEQ ID NO: 5 - DNA, 2240 bp, Arabidopsis thaliana
tgagatttctccatttccgtagcttctggtctcttttctttgtttcattgatcaaaagcaaatcacttcttcttcttcttcttctcgatttcttactgttttcttatccaacgaaatctggaattaaaaatggaatctttatcgaatccaagctgattttgtttctttcattgaatcatctctctaaagtggaattttgtaaagagaagatctgaagttgtgtagaggagcttagtgatggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatgagactctattttcatctgatctgttgtttgtactctgtttttaagttttcaagaccactgctacattttctttttcttttgaggcctttgtatttgtttccttgtccatagtcttcctgtaacatttgactctgtattattcaacaaatcataaactgtttaatctttttttttcca

SEQ ID NO: 6 - DNA, 835 bp, Zea mays
ccacgcgtccgggggaacacacagaacatactcccgctgaagcgctgagaagtagataagaataatatggggttcagtgaggcacaggaagagctcgtcctccgttcatggaaagccatgaagagcgactccgagtcgactgctcttaagttcttcctcaggatctttgagatcgcgccgggtgccaagcagatgttctccttcctgcgcgacgccggcgacgcgccgctggagaaacaccccaagctcaaggcccacgccgtcaccgtcttcgttatggcatgcgagtcggcgacgcagctgagaagcaccggcgacgtgaaggtgagggaggccaccctgaagcggctgggcgcgacgcacgccagggcgggcgtcgccgacgcgcatttcgaggtcgtcaagacggcgctgctggacaccatcagggacgcggtcccggacatgtggacgccggagatgaaggcggcgtgggaagaggcctacgaccagctggccgccgtcatcaaggaggagatgaagaacgccgccgccgccgaggagcagacgaagaacgccgccaccgccgaggaggagattaagaacgccgccgccgccgaggaggagacgacgaacgccgccgcggctgttgatggttcctagctcccactacgctcctctgctagcgaccgtggcacgcgcaccgctgcgttgatgggtgcttttggactgctgctggcctgatacctacctacgaagctgttgctaatgctgctgcatttttgtttgtcgaccgcatcattgtgatgataaataaaatgttcagaaaatgcccgttaaaaaaaaaaaaaaaaag

SEQ ID NO: 7 - DNA, 20001 bp, Arabidopsis thaliana
tgagttattttgtgtcattttaactcttttttaaatagtactcttagttgtagtttattaatttggagagaaaagaacaccaatattttcaccgacattcttgtcacgttatgggattgcgcaacgttaacacttggaccctgtctattcaccatccttgatgtgtacgatgaaaccaagcgatgctatagcctcccacaagccacaactcttttgaaattttatgttggatgtgcttcgtttaattttcgaatgtaatgcttattttgtcatacacaatcattgtgattattttcgttgtaacaacggagaaacacgaactatattttggaggagccatttctttagtttttcctatacatatgaatatgaatactacttaacatacaagcaaaacaaaaatttaccattggagaataaataatgatttctatgatttagaatttttatgaatagaaaaacaaagtttcatcacatctaacaattcaaatccactccataccaaaaaaaagaaaaacaattcaaattaactgaatgatatgattcacatttcatcaatttttcaatatatgatatatcgattaccatacaactattttacaattctactattatttgacattttttattcaaaatttgactaatattcgatatttttttgtatagatattattcctcttatttatttaatttgttgacaaacttaaccatatgcattcaattgaattttttcattttccccattatttttgttcgtaatgactactaattacaacaaaactatagtttattattttcctacaatttaatgatcattttaaaaactccttatctgcttaaaagcataattggaaataataataataaagtgaaatgacaataaaagaaaacttattcaagaaactacaaagttattccttgacaaaaaaagttattctattgtccagtgaacaaatatgagtttttgactattttttttttcacaagtaattttttttctttgacaagtgtatattaaacattctaaacattacatagcccaaacaaagaccctttcagggttttaagtaattaatcagtgacaaaaaaaaatgaaaatattgtatttataagtttttgatagacaaacataagttttacaattttccaaggaaaaagtcatattttcctagtaaaaacctttcgggttttccaatttatttaccaaagataattggtctctgaaagaacaaagcaaaacctaagaaagctaaaaagacactcagcgaattgaatttgtaaaaaaataagagaaaaaatcttgatttcttctgcgatcttcggttctcgacgcatcatgtgttgaagattcttctatcttcctctgtacatactctctctctgcccaagtgttgttgaaccaaaaaggggtcagatttagggtttttggaagatttttgtggctggactggccctgcagcgatgtctacctcgtcgcaatcttttgtggctggacggcctgcatccatggcttccccttcgcaatcgcaccgcttttgtggtccctcagccaccgcttctggtggcggaagctttgacactttgaatcgtgtcatcgctgacctttgcagccgtggtaatcctaaggtaatgaagaacattgtaaagtattctccctttttatgctttagtagaaacccatataacccttttgcttttattgcttatctgacggaatctctctgttctggttaatggaaaattcgaagttttagttcttataggtctggcaatttgtgggttttgatctattgttgttggtttccatcaagtatgcgactttgtttatgatttttggttgttgtattaggagggagctcctttagcgtttaggaaacacgtagaggaagcagttcgtgatcttagtggtgaagcttcctctaggttcatggagcaattatatgacaggattgctaatttaattgagagcactgatgtggcggaaaacatgggtgcactcagagccattgatgagttgacggagattggatttggtgagaatgctactaaggtttctagatttgcgggttacatgaggactgtgttcgagttgaagcgtgatcctgaaatcttggtgcttgctagtagagttttggggcaccttgctcgggcaggtggagcaatgacttctgatgaagtggagtttcaggtaagattgtttgtttccctccccttcctatcactgtctcggctcatagttgctcaattcttgatctcgttttcacagatgaaaacagcttttgattggcttcgcgtagacagggtggaatatcgtcgtttcgccgccgttttaatattaaaggtatcctgatttcagctgcccgatcctttagataagcagatcattttttcttttagttactcagaaagaaacttctgaactaataaattggattatagatgtttgaaaaatgatagtgatgataactttccaatcctaagttaatacggatatggatgttttcttgcaacattgcaggagatggccgaaaatgcttctactgtctttaacgttcatgtccctgaatttgtggatgctatctgggttgcacttagggacccccagttgcaagtgcgagaacgagctgttgaagctttgcgtgcatgccttcgtgttattgagaaaagggagactcgatggcgagtgcagtggtaagtattctcttatccttgaaaatgataatgtctgaaatgttttccttaggttatgtatttggtatgatatttttgatgcaaggcttttctttgtgttgttgcaatactttcatttgcaatcaccctcatttaagtactactttgtatattttattgtgtaaatgcaacttatattagctttttatgctgtggtcccccccccccccccaaaatggatgatattcgaatatatattcttcccatggtgatacgttttgcagactttctactgcatttatatatatcattgccaatgcaatgtttcaaattatcaataggggtttccatctttattaactgatcttctctcaatttggcttttacaggtactatcgaatgtttgaagctacacaggatgggttgggcagaaatgctccggttcacagtattcatggttctttacttgccgtgggggagctgttgaggtaaatgcagaagtggttatctattttgaaagcatccctttcttttagtcagacactcaagtttgattctggaatatttccgtagaacaacttgtttgtccccatgatgctcgggttgttttgttagtttgtcttcgtattgtagtttacatcattaaaaaagtaggcaattcatgtatattcctccactctcagtgtatacctgaacaaaagactcttgacgacgaaaattacgttgttttctgttataagcagattgatttcatggcatattgggtgttagagtttacagcttaatgctagagttcgtttgcaggaatacaggtgagttcatgatgtctaggtatagagaagttgccgaaattgtcctcagataccttgaacatcgtgatcgccttgttcgccttagcatcacctcgttactgcctcgcattgctcactttctccgtgaccggtttgtgacaaactatttaacggtaagtgactgagagattcttaaaaccaaaaaatttctggaaacgtgacacgaattactttcttgcagatatgcatgaatcatattcttactgtgttaagaataccggctgaaagagccagtgggttcatcgcccttggggaaatggctggtgctttggatggtgagcttatccattatttgccgacaattatgtctcatctgcgggatgcggtgggtcaaattttatttatttatttatttattttgtaattacgttttactacttttgtgtcaaagtattatattgggttttagttttgaaaactgaactagacaagtggctttgttcgactatgttgtccctgtagattgctccacgtaaaggcagacctttgcttgaagctgtggcttgtgttggtaacatcgcaaaggcaatgggatccacagtggaaactcatgttcgagatcttttagatgttatgttttcatctagtctctcttccacacttgttgacgctcttgaccagataaccatcaggtaaagttgaacgaaagaagtttgttattacatacattgatgtgtatacgtttaatgctgacaattctttgtatctcagcattccttctttgctgccaacagtacaagatcggcttctagattgcatttcgttggttctttcaaaatcccattattctcaagcaaagcctcctgttaccattgtccgaggtagtacagtgggcatggcaccacagtcttctgaccctagttgttcagctcaagttcaactagccctgcagactcttgctcgtttcaatttcaaggttggcgctctttgcggataacattttctaaagaatatgaaatttctgtctttgagcttctgatttctggcagggacatgatcttcttgaatttgctcgggagtcagttgttgtttatttggatgatgaggatgcagccacaagaaaagatgctgctttgtgttgttgcagactaattgcaaattctctttctggcatcacacaatttggctcgagcaggtcaacacgagcaggggggagacgcaggcgccttgtggaagaggttttatatcatactgaaagcccattacatttttttcttattatgtcttttaatttcactgtttctcattacaaaaggtttctttttattattttccaaatctgaacttaagtatgttaaacatgcttcgtgatggcatttataattgcaataccagtggcggttccaattttctgcttgctgagaaatgatgtttgggttctgcagattgtggaaaagcttctcaggacagccgttgcagatgctgatgtaactgttcgcaaatctatattcgttgctttatttggcaaccaatgtttcgatgattatctagcacaggctgatagtttgactgccatttttgcttccttaaatgatgaggtatgattgtgttatttgtttgaataaaatagcagcttagatgtcatactgcagtcctaatttgttaccgatcttttatttgtctctcttgggtgaattattgtaattgtattgctctttgagattcaatttcatgggttcatgaagttggtatttaattactccccctaatatcaaaatttggataccaagacgtagctgggcttttagtctatgaattagcttctattgtgtcacaaaacagtgttacttattaagttgtactggaaaagtgcagctgagataacttaattggatgatttgtggatggaatgaatgccttttgttggtggatgcatcatgtgataccctgttaacttgatagaatgtttggcttatgtttcacactttcactccacctggctacagtatctggcctagtcaatggaaccatttcaattcatatattacaatatctctgtttaacaggaccttgatgttcgagaatatgccatctcagttgctggaaggttatcggaaaaaaatccagcatacgtacttccagcacttcgtcgccatcttatacagttgttgacctatcttgagctgaggtaactacaaattttttagttcatatgggaagattcatttcctatgattatgtatctgttgcattgacttcaattgtaatgtcagcagtgcagataacaagtgcagggaagagagtgcaaagctccttggttgtttagttcgaaattgtgaacggctcattcttccatacgtagcccctgtccaaaaggtttaatttcttttcatttcttagatagtatggctattattgttgttcacggggttgtaactcttgttttctaggcacttgttgcgagacttagtgaaggaactggagtgaatgctaacaataatattgtcactggagttctcgtaactgttggggatcttgcaagagtggtaagttgaaatataattggcaagttttagattctatattaagtgtcgattcaaacataactgcgtttttgctgcgcgttaaagttgcagtctgatttttgactatttctatctgtgttctaagtctgtgttggctaagcgtatttcaaatttcaatgccctggccggcatctaatattgtattttttgttgtctctaagttaacagaatgttggtacttttatttcctttcctgtcctgttatttattgtgtttggctaagatattcccttcctggttttcttttgcgttgcttgctcagggtggcttggcaatgagacaatatattccggagctgatgcctttaattgttgaagctttaatggatggagctgctgtagcaaaacgtgaggtggctgtttctactcttggtcaagttgttcaaagtacagggtatgagatattgaccttcttttacgactttcttcttgttttatatgataatgctactaggcaattttgaacatgctaattttcttgtaaactaagacaatgctactatcttgattggcgaaagcctggttggactagatgaaaatactggattctaagtgaattttttgacacaaacggggcctccatctcttcttattagctaggtagaagcctgagctatccttaggctgtttatgtgttaatgtatacatatgtgttatgtttatcctttaacctactaaaagtgagaaaattctatatgaaatgacaatattgttatccctagctagttcttctatctgcggtagatctttgtgatggttttttttccgtctctcctgagatggctcattattccggagaaagaatattgcctttctgtgtccggacttgtcatgagttgtattctctgtttgtcgtgcgaaaggattgatttaccaatacctaggatattatgctgcctagatttaatcaactgtatcactggtgtttatgaagttgtagacatttgtagacagtgcggtgatcaacttgcatgttactgtttagtagcttgggacatgtgctaattattgtgcacataactagtacaaaatgaagggagttccagaagtttacaatcctccctgcatgttatttacggctctaatttcattatgaacgtaggtatgttgtgactccatacaaggaatacccattgttgcttgggttactcttgaaattgctgaagggtgacttagtgtggtctaccagacgagaagtgctcaaggtagtttctagagaattgttttactctagactattctagaagatatttttgtgataaacgtggttatatctacaggttcttggaattatgggcgctttggatcctcatgtgcataaacgtaaccaacaaagtttatcaggatcacatggtgaagttcctcgcggcactggtgattctggtcaacctattccatcaattgatgagttacctgtcgaactccggccgtcatttgctacatctgaggattattactcaacggtagttcttaatttgtgtgaatatatttcatttgtagtctgaattgtgctcaattactttccttattgttataggttgctatcaactcgcttatgcgaattcttagagatgcatcacttcttagttaccacaaaagggttgttagatctctgatgatcattttcaaggtaactaaaaccatcttgactgttttttaaaataaacttgtgttggaactgcaatgaggaggttacaactttatcactactttgtttttgcgaggttagtcaatgggattgggatgcgtgccttacttgccgaaggtaggtgtaaataatattgtatctccggcagcttttcgataaatgctctctctgttttacgttgtggtaatttgttgggttggttccacctctgaatttgaaggttttacctgagctttttcacactgttcgaacatctgatgagaacctgaaggacttcattacgtggggtcttgggactcttgtttccattgttcgccaggtatatccaccttaatattttcagttatggtcaaaatacgaccgactttgtgtaaactcatagcttatgttatctgtgtacagcacatacgcaagtatctgccagagctgctttcattagtctctgaactatggtcatccttcaccttgcccggtcccatacgcccatcacgtggtcttccggtaagttgtatgctgcctagagtatgctatgtttcttattgattaaggacagatatcttatggggagtacttcgcctctcttactgataatcaggttctgcatctactggaacatctttgcttggcacttaatgatgaattcagaacttatcttccagtcatccttccatgtttcatccaagtattaggtgacgccgagcggtttaatgattacacctatgttcctgatattctccacacactcgaagtgtttggcggtcagtaatacttatcttgttttgacatcctcatagtcattttatattacttgggtatgcgagttctagtaattaacgtatgcagttcttttacaagaatgtaaagaggttccacattattagattgtgtagtgtaagatgatacaagtagtttcgttattatatgcatatttgtttcttatctattaaatccaattttttttcggtatataggttctttgaatagtcagattgtttactcctgtagtttccattttctcaccatggccagatttcactctgatggttgacccttagagtccttatgtgcaggaactcttgatgagcacatgcatttactccttccggcacttattcgattgtttaaagtagatgctcctgtagctataagacgcgatgccatcaaaactttgacaagagtaatcccgtgtgttcaggttaggagctttggttatttattttgattttttttttccctttgctgatccagaaaaaattccatattaagcttcttgtaatacttttaattatccgtatatatcctcaggttactggtcatatctccgctctcgtgcatcacttgaagctagtattagatgggtgagttatactgattgtcactatctgaaaaacagtatattggttactttttcctaagggttttcttacaatacttcttcaaaacttaggcattgtgtcactatctggttttctcttaaatggttgacaatgcattatcaaaaaggatggaattattattatctcattaactttcaatccgtcattgttactgttacaaatctgttttccataagttgtttgtattgcttagttacaattttttctggccacatgtatttgttattagaactccgcagatgttagttacatttcttaatatcatgggattttatctgccattattgatgggacccaattgttttctagtggattttcatttcacgtttttctaaaccttactcgtgatttcagtttcgtacgtataaatattcttatggggtatatcttctgtaatcgcaggaagaatgatgagttgcggaaagatgctgtcgatgcactatgctgtttggctcatgcacttggagaggacttcaccatattcattgaatcaattcacaagcttttattgaagcatcgattgcgggtcttgcattttactatcttttaaataaaaatagcagcaaaaatttatctgtcatgtattataaatgtcatttgtgaacttctgtctgtaaaatctcactgtacaacattttttcagcataaagaatttgaggaaattcatgctcgctggcggagacgtgaaccattgattgtagctacaactgcaacccaacaattaagtaggcgactgccagttgaggttatcagggatcctgtaattgagaatgagatcgatcctttcgaagaaggaactgacagaaaccatcaggtactcttttctgtgtcgtatataatcacatatagattcttaatgtgtgaaaattttgttatcaagtttcaagttaaaatcatgattttactctaacattgtacaaaatttctggtcggcatagtcattattagtatgacttcattgaggcaaacatggggtgtattgtagggttccttagctgaataaggcggatctttttttctttctttttcctatctaaatgatgggtaggtttatctatagcaacgttcattcattgaagcttagtcttggtcctgagccatttgcttcaatgagtttgtaaatatgtcctctatatttcctcttctccatggacattcagcttttaaaaacaaataaaactatatatgggcttgatttaacatgatcctctagtaaagtttatttggttctttcttagttttgaaagagctaaaactttcactcatggctttgatgatctgctgaacaggttaatgatggtagactacggacagctggagaagcttctcaacgcagcaccaaagaagattgggaggaatggatgagacattttagtattgaattacttaaggagtctccctctccagcattaagaacttgtgcaaaacttgctcagttgcaggtgtttcatctatgctctttcttttcctctctcaaaagggtgcattttaatgattgtgttttgcagccatttgtcgggagagagttgtttgctgctggctttgtcagttgctgggcacagctaaacgagtctagccaaaagcagttagttaggagcttggaaatggccttttcatctccaaatatccctccagaaattttagctacactactcaatttggtatgttcgttgttacattacaagaaaacttaaacatgataaagacctttgattgagtcactggctataacgaacagcaaatttgtttcctgtggctatgcttgtgcttattgagtgcttgtgttttagcttaggcgattgttatgagttgactacattttccaagactggaaacaaaaacttcttaggtcaccatttctttagcggttgcacctgttaatctttctatgtaaaacacgttttttgttgctaaaaccatcaacaaaacgatctgtgagtgtacatggaaacatgacgtgtaatttttatttaatctaatattaacactataatccaaatatctgcttatacttcgtttaatctatattacgtttaggttggataaacaatcataagttcagaatcaatatcaacctacctttatgtgtgatcctgttgcttggtcctgtcacttgtgcttgattttattatttctcttcttaggcagagtttatggaacatgatgagaagcctcttcccattgatattcgtcttctgggggctcttgctgaaaaggtttgcgttatgtatttgctagttaaattagatttggtacttttttcatttgcgtatcaagaattcatctgattttcttggtaatgtgcaatattccaactttgtagtgccgtgtttttgccaaagctctgcattataaagagatggaatttgaaggtccacgatccaagaggatggatgccaacccagttgctgttgtcgaggctcttatacacataaataatcagttacaccagcatgaggtacactgtattttgtatcctatttcgaccatctttgatatttgttattattgattggttggaattctttgtataggctgctgtcggtatactaacctatgctcaacaacatcttgatgtgcaattaaaagaatcatggtaacatggcttttctgaatcatgatgcacttattttcagttctgtttgataggcattccgtcacaagattgtgtgtggttccattctttgatcctaatcagtggaaaagcactaacagtgtttgtttctaggtatgagaagctgcagcgctgggacgatgcactcaaggcgtacactttgaaagcatctcaaacaacaaatcctcatcttgtattagaagccacattaggtttgtggtaaccaagactaatattgggaggatttagtgggtttttttcttcgataatgtttttttctaagttctgttggcatttttttgtcggtattctgttagtagttcatagagaactgtgggttcataacattcttacaagttagcagaacaacagatcaacgcatttttttccagtctaaaattcatatgatgcttctcttttcttttcatgaaatggcctgattctattgcttatttaccacgttgtaggacaaatgagatgtcttgctgcacttgcacgatgggaagagctcaacaatctctgcaaagagtactggagtcctgctgagccatctgcgcgtctggaaatggcaccaatggttggtaacttctacttatgctacattcggtgatatagctacatggttacataatgtctttttgcaaccatactaggctgcacaagctgcatggaacatgggagagtgggatcaaatggccgaatatgtgtctcggctagatgatggtgatgaaacaaagcttcggggtttagcaagcccggtttctagtggcgatgggagcagtaatggcacattcttcagggctgttctgttagttcgaagggcaaaggtacacttggacctatattttcgtactataaatcttatcaggcttacttataatctatttgcagacactaatttctgcgtatgtgtgcctgtggatatttttctttcctttttagtacgacgaggcacgcgaatatgtggaaagagctagaaaatgtcttgccacagaacttgcagcgctggtaggtttcatttctggtagtattttcattataaacttttgtgaaaaatatctatgaatcatctgttgtgaataaagggaacagatgtatatcagcaaagatatttgtaactggtctcagccttttccattatgttcttgaaactatttgagtacgccttgtggtgttggaagtaggattatacattcctgacatcttagttacatatttagctctatttaaataacattttgtgcatgctatcgttggttcctttcaatagaagcatcatgtaatcaccatgttaccttcttagttgctcacgcatactgaaaaacttgtaattgtctatttgcgccttctacaggttttggagagctatgagcgtgcgtacagcaatatggttcgtgttcagcagctgtcagaactagaggaggttagatctcaattatccaagatcccttctcctggacaccctccctaacacccctccatatacatgattaatctttctatttttttcccctgttgtatcgatactaggtaattgaatattatacgctgcctgtgggaaatactattgccgaagaacggagagctctaattcgtaatatgtggactcagcggattcagggatctaagcgtaatgtggaggtatattatttttaatgttatcatgttagttgagccactagtgaatgacaaggcatttggtattttaagcatcaaatattgcagtatggtgactttattaaatgaatcttcgctaggatcaaattgattttttccatattaggtttgctttatttagtttccgtctgttgatttataaagtaaagtagcttcttaccaaactgttagtcagagcttgtatcctacgtagataaaaaaacaaatccaaataagaaaactcattaaaattttattgagtgatctcaggttttttgtataatagtgtgctttttaatactttgcattcccaatactactcaggtgtggcaagcacttttggctgtccgggcacttgtgctacctcctacagaagatgtggaaacttggctcaagtttgcctcgctttgtcgaaagagtgggaggatcagtcaggcgaaatctactctactcaagctcttaccggtcttgaacttttaccttttgattgttgaattttctctgccaagagtgtatctttattctgttatgtctaacttgggcccttattttgcagtttgatccagaagtatcaccagaaaacatgcaatatcacggacctccacaagtgatgcttggatacttaaaataccaatggtcacttggagaggaacgtaagcgcaaagaggcatttaccaagctgcaggtatgtcatataccagttgctacttgcattgtctgggcttattctctttttcacattttcccatatcttgcttgaacggccatgttatagcttccctcgatctaaattttaattgtttctagattctaacgagagagctctcaagtgtgccacattctcaatctgacatactggctagcatggtatctagcaagggcgcaaatgttccacttcttgcacgtgtaaatctcaaactgggaacgtggcagtgggcactttcttccggtttgaatgatgggtctattcaaggtgaattgtagttgcttttaaatgtgtaagtgtaatcaaactacgtctgaccttaacactttggtgaccaaatatactcttttccagaaattcgtgatgcgtttgacaaatctacttgctatgctcctaaatgggctaaagcatggcacacatgggcattattcaatacagcagtgatgtcgcattacatttcaagaggtcaaattgcttcccagtacgttgtttctgcagtcactggatatttttattctatagcatgtgcagcaaatgccaaaggagttgatgatagtttacaggtaaagcgtgcatgcatccatggcttttccatgttacacaaacgaaaacgtgtctttcttttcttttccatgttgctacttttcttatacttgttgaaatgaggtgttgttttaccatactggtggtctgttaaattattttcctctgctgtctcatttccataggacatactgcgtcttctgacattgtggttcaaccatggagctacagctgatgtccaaaccgcattgaagacaggattcagtcatgtcaacattaacacatggcttgttgtgctacctcaaatcattgctaggatacattctaataatcgtgctgtcagggaactgattcagtctcttctcatccgcataggcgaaaaccacccacaggtttgcagccttctagaaattttataaatcttcatcagtattacaattctatggtgggaattaagacatacataaagttttactctgccattttgattgcatatgtacttcgattttggatgcataatttctccttgactatttatttttcaaatgttttcaggctctgatgtatccccttctcgttgcatgtaaatcaataagcaatcttcggagagctgcggctcaagaggtggttgataaagttcgccagcacagtggtgcactcgtggatcaggttaaaagtcatctcttgtgtttgtcgattttattgaattatatatttttacctgagctaattagtgacccccttcctctacacccataacaacaaaaaaacaggcgcaacttgtatcacatgaacttatcagggttgccatactttggcatgaaatgtggcatgaagcactagaagaagctagtcgcttgtattttggtgaacataacattgaaggcatgctgaaagtacttgaacccttacatgacatgctcgacgaaggtgtaaaaaaggacagtacgaccatacaggaaagagcatttatagaggttggaaatttcaatcccggatttttggtatttgggtgtgtgtgatcacgttatttataattacatctttatctagcacaggggtgtacagcattgcagtatctaggtttatttgctatgtaacttgtagtcatttttcctcttcgcgattttaaagtattaaaataaaccagttgcccttgatagaatcagattactaatgttactgtatggagtgtttcttgtcgcatatgtttcagtaactgttatatgtgaactttacaatgttctttaatgtcagcaacttaagttagtgtaatgttgatgcaggcataccgtcacgaactaaaagaggcacatgaatgctgttgcaattacaagataactgggaaagatgctgaacttacacaggtgatcagaaattttgaacaaaatttcagatgagtgtttgctgtcttcttattaaagggacgggaattgacataatttttcttttcaattctctatcttcttaggcttgggatctttactatcacgttttcaaacggattgacaaacagctagccagtctcacgacattggatttggaagtaataagattctctttttctttggttctctcgctccttttgagttctaatctgactggcatgttacttgttgtatagtctgtttctcctgagttgctgctgtgccgtgacttggagctagcagttcctggaacatatcgtgcaggtaacaacatattgaactgcttaagtttgcctgagctgatttattttattaacccagacttcattgcttacatacatacttcgtttttcttcttattagatgcccccgtcgtgactatatcatctttttcacgccaacttgttgttataacctctaaacaaagaccaaggaaattgactattcacggaaatgacggtgaggactacgccttcttgttgaagggacatgaagatttaaggcaagatgagcgtgttatgcaggtgattctcaaaaaaatcagttatgcattgttctgatgaattcttgttggagaatacgtaattgaagttttcagtttacacttcacaaatatacagttttcagctacaaaatcacatctatccctttcctcttatttgtgtttcagctttttggtttggtgaacactttgcttgagaattccagaaaaacagccgaaaaagatctttccattcaacgctattctgtaataccactatctcccaatagtggactcatcggatgggttccgaactgcgatacccttcaccatcttattcgagagcacagagatgcaagaaaggtttgtcttgtattcactaaggttttcagtcctgaaactatctgcggtttacgttaattcttacacatgcctgtctgaattcatagatcattcttaatcaagaaaataagcatatgttgagttttgctccagactatgacaatctaccgcttatagcaaaggttgaagtatttgagtatgctctagaaaacacagagggaaatgatctatccagggtactcaattcattctggtaactctatttattttgggtaaagtacctaatctggaatactaagttgcttctattcttctccttcttattaggttctctggttaaaaagtcgctcgtcagaagtttggctagaaagaagaacaaactatactagaagtttagcagttatgagtatggtatgtagttgatctcatcctttgttctccacttgtgtagcatcaaataaaaagtttctggtgtttaactcgccaataaaatgaacttcatgcgttactttgtgtcaggttggttatattcttgggttaggtgatcgacacccaagtaaccttatgcttcatagatacaggtacataaaactgaaataaggtttacattacattttcaaccttgggttctatttctttatcaatggttttaattgtgcagtggaaagatcttgcatattgattttggagattgttttgaggcttctatgaatagagagaagtttcctgaaaaggtattaattttaatgtttccctcgtatatacttgtttgtgggtatcaaagaacaattttgtgaggattgcttaaataatgttaggttccattccgcctgacaagaatgcttgtcaaagcaatggaagtcagtggcattgaaggaaacttccgctcaacctgcgaaaacgttatgcaagttctcagaaccaataaagatagtgtaatggcaatgatggaagcgtttgtacatgatcctttaatcaattggcgtcttttcaatttcaatgaagtcccccaattagcactgctcggtaacaacaaccccaatgctcctgctgatgttgagcctgacgaagaagatgaagatcccgctgatatagatcttcctcagcctcaaaggagtactcgagagaaggagattcttcaggtttcttttgaaaatcttattatgtttttttcttctcaaagggggatttttttatatttaaatttgatttttggattatttcaggctgtaaatatgcttggagatgctaatgaagttttaaatgagcgtgccgtagttgttatggcacgtatgagtcataagcttacagggcgtgatttttcttcgtctgcaattccgagcaatcccattgctgatcataataacttgctcggaggagattctcatgaagtcgaacatggtttgtctgtgaaagttcaggttcaaaaactaatcaatcaagccacttcccatgagaatctctgtcaaaactatgttgggtatgttcctctacacttctacactcctaaaccccgattgctttagttcatttaaaattgaacatgcatatttcttgtgtttgttcttttattacaggtggtgccctttctggtgagatgggtcatctgtacatttttaatgtaaataggctttttaattttcaactaatttgcatttatgtttgactaattcgataataaactatgttctttttaatgtaaataatttattagtttcatagtcatgtattaatacatgatgtagcgtggatgaataaatgggcaggtcaccttttttacttttctgaaatatacattctcatatcctcaaggtattttaatggaattgcgacaaaagaagaagaagaagaagatggtgtacaatgtacatgttttatgaactatataaagcaattggaatatgcatgttctttttaatgaaacatgtttccggagtttaagatggatttcataaaaatcaacataattttgttaatagtccaaataatataatttttttattttttttttgttaaagcaaatttgtcacatttttttatataaaatttgtgatgtcaaaagagaagacaaatgtaaaattgtgttgtgggttgttacagtatgtagttggtatctttattaaacctaccaaaacgagacaatttgtaacattgagggagcatgtgatagtacattgggtattatactattaagctaacatgagtaatgatgtttttttgttttttttttctcttctatgtattttgtttttgtaccaatattattaatacagaatggggacaaaaaggagacgtggagtctcgcgttacgttaccactctctcaaatgcggcaatttggcagccacacacacatggacagcgttagcgtactgtagataaataatccgtactcgtgctaacgtacgcttcaaatagttaaaggtgataactttcaccgttgtctcggcaccacttgctcgaatattgacacctttttcttccccagaaaaaatccaaacaaatagaattttgccgtctgaaattcctaaaactataaaacacagcttccttcttctcctatatattcatcggcgacgccttgatcatgattctttccggaaactgataagaggaacaaaaatggcttcttcttctctggagattgttaaattgtgtggctctcctgtatcgtttccccgccataaatctcccataaaattggaatgtagaaaaagggttttcagattacccaattctaggagttggcatcgtcttagggtttcttcatctgctctcaatggtggtgataatcagtccaaaggtcagtttttttttttttttttttgttgcttaactctctaaaagaagtaattagagttgattttgattataactgatatttgattagtcaatagattataaagatgtgattttgattctttccccttttagatagaatttgttgtcattagttctctaatagtatcattagttctccaatcttgtttcttgaatctcttttcataagtcaaaaaggggttttaatatacaagttatccattttacttggactctttcttcttgtaatggtgtgtattcattacttagattttcctctacctgaatttggagtttgatttgtatgagttgtgtaggtgaag

SEQ ID NO: 8 - DNA, 401 bp, Escherichia coli
gatcaaaagacaggcgaccttttcaaggaatagcatgaaaaagattgatgcgattataaaacccttcaagctggacgatgtccgcgaagcactggccgaagtcggtattaccggcatgacggtgaccgaagtgaaaggctttggtcgccagaaaggccataccgagctgtaccgcggcgcggagtatatggtggattttctgccgaaagtgaaaattgagattgtcgtaccggacgacattgtcgatacctgtgtcgataccattattcgcacggcgcaaaccggcaaaatcggtgacggtaaaatcttcgtctttgacgtggcacgggtcattcgcatccgtaccggtgaagaggacgacgcggcaatttaaaccgcgtcaagggttgccggatgtttcc

SEQ ID NO: 9 - DNA, 877 bp, Arabidopsis thaliana
cgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagacccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattttgatttttctttgttggatgattatatgattcttcaaaaaagaagaacgttaataaaaaaattcgtttatc

SEQ ID NO: 10 - DNA, 726 bp, Arabidopsis thaliana
atggcctcgtcatcatcatcatcttatagattccaatctgggtcttaccctctttcgtcaagtccttctcttgggaatttcgtcgaacgcattaaagacgcttgtcatttccttgtctctgctgttttgggtaccattatctccgcgatcttgaccttcttcttcgcactagtgggcacattgctaggggcacttacaggagctttgataggtcaagaaactgagagtggtttcattagaggagcagcaattggagccatttcgggagctgttttctctatcgaggtctttgaatcatctctggatctctggaaatccgatgagtcgggtttcggatgttttctctacttgattgatgtcattgttagtcttctaagcgggagacttgtacgagagcgcattggtcctgcaatgctaagtgcagtgcaaagtcaaatgggagctgtggatacagcttttgatgatcacacaagcctttttgatacaggaggctcaaaaggattgacaggagaccttgttgagaaaatcccaaagatgacaatcactggcaacaataacactgatgcttctgagaacacagactcatgttctgtttgtcttcaggatttccagctcggtgaaacagttagaagcttgcctcattgtcatcacatgtttcacttaccttgcatagacaattggctccttagacacggttcttgcccgatgtgtagacgtgatatttaa

SEQ ID NO: 11 - DNA, 989 bp, Arabidopsis thaliana
ctctgctggtatcattggagtctagggttttgttattgacatgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatggtgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtactacttgtcgagaaacggttaaacctttaaggcttttagatggatcatcagactttgtactcacttatgaagataaggggattggatgcttgttggagatgttccatggagaatgtttatcaactcggtgaaaaggcttcggatcatgggaacctcagaagctagtggactagctccaagacgtcaagagcagaaggatagacaaagaaacaaccctgtttagcttcccttccaaagctggcattgtttatgtattgtttgaggtttgcaatttactcgatactttttgaagaaagtattttggagaatatggataaaagcatgcagaagcttagatatgatttgaatccggttttcggatatggttttgcttaggtcattcaattcgtagttttccagtttgtttcttctttggctgtgtaccaattatctatgttctgtgagagaaagctcttg

SEQ ID NO: 12 - DNA, 3380 bp, Zea mays
ctcttctccccccactcctcccccaccaaatcctcgttcatttttttttccaagcgacttcgcgtgtgagggcgggagagcgcgcggggctagggtttccgcgggtgatggaagcagaggctgccgcggcggtagtggcgtcgtccgcatctgcctcggcttccgcgggccggtctcgcccatctagcagcgccgcccaggtcaccagtaattcggctgtgcgagctggagaagaaaatgctgcctccctctatgttttatctgttattgactcgttaaaaaagaggattaccgcagatcgtttgacttacattaagaataggataggggagaacaagactaatatcagcagctatacacagaggacttacaatttatcaaaaaataggcaaattagtacatcaaagggtactgattcagcatcaaatttgctcacaaaaaggcaagatgatgcgctatgcaccctgcatagtcttgatattattccggttgacaaagatggtggcacttttcaagacgaaagtcctttctcttcatctaatgttatgtttggtggaaatcttggtcccaagaatgctattattagaccaattaaactaccagaagtgccaaagcttccaccttatacaacatggatatttttggacaggaaccaaaggatgacagaagaccaatctgtacttggtcgacggaggatttactatgataccagttgtggtgaagctctaatttgcagtgatagtgaagatgaagccattgaagatgaggaggaaaaaaaggaatttaaacattctgaagatcacattattcggatgacagttcaagaatgtggcatgtctgatgctgtactgcaaacgctagctcgacacatggagcgggctgctgatgacataaaggccaggtatgaaattctgcatggtgagaaaactaaggattcttgcaagaaagggactgagcataatgtcaaagtggaagatttgtactgtgacaaagatttggatgcagcattggattcttttgacaatctcttctgtcgacgatgtctagtacgcttgactgtaactttcagatattcttttctaggacctgtgtgctgatggacatttctgctcattggtgatgctgataggtgtttgattgcaagctacatgggtgttctcaagatttagtatttcctgtaagttttcacaagttgaaagagttatttataaaattgtgtgtttacttgatttgtgtcttctttgtacagacagaaaaacaaccagcttggagtggcgttgatgacagtgtaccctgtggtattcattgccataaactggcatctgaaccagattctgctgctggtgctgatcacatgctttttgatgttgaggagccaactcactcatcagacaatgtgatgaaccagccaggttcaaataggaaaaagaacggctccagtggaaggaagactaaatctcaacaaagtgaaagctcttcaactgcaagagttatctcagaaagcagtgattcggaagtacatccaataagcaataaatctccacaacactcccctagtccctcaaaagttaaaattgggccaaaaggtggaatcagaaagattaccaatagacgaatcgctgagagaattcttatgagtgtgaagaaaggacaaagggaaatggcatcatctgattctaattttgttagtggatatcttttggcaagggacatgaagcttaggtctgatacacgaaatggaaataaggaattaattgtatcctcacaacagagttctccaagcacaagaagttccaaaaagaagagtacacctcaaattgggaacagctcagcttttgctgaggctcataatgattcaacagaggaagcaaataaccgtcattcagcaacagatggttacgatagttcaaggaaagaagaattcgtcaatgagaatttatgcaagcaggaggtgtacttgagatcatggaaggcaattgagcagggacttcttgtgaaaggattagagatttttggaaggaacagttgtttaattgctcggaaccttcttggtggaatgaagacgtgcaaagatgtttttcaatatatgaattatattgaaaacaacagtgcctctggagctcttagtggtgttgattctcttgtcaaaggatatattaagggtactgagttgcgcacaagatcaagatattttagaaggcgaggtaaagtccgtcgtttgaagtacacctggaaatctgcaggttacaatttcaaaaggattaccgaaaggaaggatcagccttgtcgacaatataatccttgtggttgtcaatctacatgcggaaagcagtgtccatgtctttcaaatgggacatgttgtgagaaatactgtgggtgtccaaaaatttgcaagaatcgttttcgaggatgtcactgtgcaaagagccagtgtcgcagccgccaatgtccatgttttgcagctgacagggaatgcgatccggatgtttgcagaaactgttgggttgggtgtggtgatggtacattgggagttccaaaccagagaggagataattatgaatgccggaacatgaaactgcttcttaaacaacaacaaagggtcttacttggaagatcagatgtctctggctggggagcattcctcaagaatagtgttagcaaacatgaataccttggtgagtacactggggaactaatctcacacaaagaagcagataagcgtggaaagatatatgatcgtgagaactcatcgttccttttcaacctgaacaacgagtatgttcttgacgcatacagaatgggtgacaagctgaaatttgccaaccatgcccctgacccgaattgctatgccaaggttatcatggtaactggtgatcatagagtgggcatattcgccaaagaaagaatcctcgctggtgaagagttattctacgattaccgctatgagcctgacagagcccctgcttgggcccgtaagcctgaggcgtcgggagcaaaggatgatgggcaaccgttcaatgggcgtgcaaagaagctcgcccaaaacaacagaggctgaatctgatttgattctttcattgttaggacaaatttggcagccattcaactaatataaggaacctgtcattcataggccccaatttatttgaactcgtcattgtaactcgtatgtgcttgaattctccatggcagctggtcctgccatccgtagagttaggtcccgtttgttttgaggaactaaaaattaatccctctattttagtcacattgagtcttagattgttaaacggcgggactaaaacaaaagactaaactatttgtctctagtacctcaagccatgactaaaagggaataaatcatataaattttattttaaaaa

SEQ ID NO: 13 - DNA, 2941 bp, Zea mays
ccctcttctccccccacccctccctcccccaccaaatcctcgttcattttttttccaagcgacttcgcgtgtgagggcgggagagcgcgcggggctagggtttccacgggtgatggaagcagaggctgccgcggcggtagtggcgtcgtccgcatctgcctcggcttccgcgggccggtctcgcccatctagcagcgccgcccaggtcaccagtaattcggctgtgcgagctggagaagaaaatgctgcctccctctatgttttatctgttattgactcgttaaaaaagaggattaccgcagatcgtttgacttacattaagaataggataggggagaacaagactaatatcagcagctatacacagaggacttacaatttatcaaaaaataggcaaattagtacatcaaagggtactgattcagcatcaaatttgctcacaaaaaggcaagatgatgcgctatgcaccctgcatagtcttgatattattccggttgacaaagatggtggtacttttcaagacgaaagtcctttctcttcatctaatgttatgtttggtggaaatcttggtcccaagaatgctattattagaccaattaaactaccagaagtgccaaagcttccaccttatacaacatggatatttttggacaggaaccaaaggatgacagaagaccaatctgtacttggtcgacggaggatttactatgataccagttgtggtgaagctctaatttgcagtgatagtgaagatgaagccattgaagatgaggaggaaaaaaaggaatttaaacattctgaagatcacattattcggatgacagttcaagaatgtggcatgtctgatgctgtactgcaaacgctagctcgacacatggagcgggctgctgatgacataaaggccaggacctgtgtgctgatggacatttctgctcattggtgatgctgataggtgtttgattgcaagctacatgggtgttctcaagatttagtatttcctacagaaaaacaaccagcttggagtggcgttgatgacagtgtaccctgtggtattcattgccataaactggcatctgaaccagatgctgctgctggtgctgatcacatgctttttgatgttgaggagccaactcactcatcagacaatgtgatgaaccagccaggttcaaataggaaaaagaacggctccagtggaaggaagactaaatctcaacaaagtgaaagctcttcaactgcaagagttatctcagaaagcagtgattcggaagtacatccaataagcaataaatctccacaacactcccctagtccctcaaaagttaaaattgggccgaaaggtggaatcagaaagattaccaatagacgaatcgctgagagaattcttatgagtgtgaagaaaggacaaagggaaatggcatcatctgattctaattttgttagtggatatcttttggcaagggacatgaagcttaggtctgatacacgaaatggaaataaggaattaattgtatcctcacaacagagttctccaagcacaagaagttccaaaaagaagagtacacctcaaattgggaacagctcagcttttgctgaggctcataatgattcaacagaggaagcaaataaccgtcattcagcaacagatggttacgatagttcaaggaaagaagaattcgtcaatgagaatttatgcaagcaggaggtgtacttgagatcatggaaggcaattgagcagggacttcttgtgaaaggattagagatttttggaaggaacagttgtttaattgctcggaaccttcttggtggaatgaagacgtgcaaagatgtttttcaatatatgaattatattgaaaacaacagtgcctctggagctcttagtggtgttgattctcttgttaaaggatatattaagggtactgagttgcgcacaagatcaagatattttagaaggcgaggtaaagtccgtcgtttgaagtacacctggaaatctgcaggttacaatttcaaaaggattaccgaaaggaaggatcagccttgtcgacaatataatccttgtggttgtcaatctacatgcggaaagcagtgtccatgtctttcaaatgggacatgttgtgagaaatactgtgggtgtccaaaaatttgcaagaatcgttttcgaggatgtcactgtgcaaagagccagtgtcgcagccgccaatgtccatgttttgcagctgacagggaatgcgatccggatgtttgcagaaactgttgggttgggtgtggtgatggtacattgggagttccaaaccagagaggagataattatgaatgccggaacatgaaactgcttcttaaacaacaacaaagggtcttacttggaagatcagatgtctctggctggggagcattcctcaagaatagtgttagcaaacatgaataccttggtgagtacactggggaactaatctcacacaaagaagcagataagcgtggaaagatatatgatcgtgagaactcatcgttccttttcaacctgaacaatgagtatgttcttgacgcatacagaatgggtgacaagctgaaatttgccaaccatgcccctgacccgaattgctatgccaaggttatcatggtaactggtgatcatagagtgggcatattcgccaaagaaagaatcctcgctggtgaagagttattctacgattaccgctatgagcctgacagagctcctgcttgggcccgtaagcctgaggcgtcgggagcaaaggatgatgggcaaccgttcaatgggcgtgcaaagaagctcgcccaaaacaaccgaggctgaatctgatttgattctttcattgttaggacaaatttggcagccattcaactaatacaaggaacctgtcattcataggccccaatttatttgaactcgtcattgtaactcgtatgtgcttgaattctccaaaaa

SEQ ID NO: 14 - DNA, 1508 bp, Zea mays
gcccgccgaaaccctagcccgccccgcctcgccgacggcgatgggcgctgcatgatcggtgcgtccccttggaaccgcctgccttctggcatcgccaagcccgctgccgcggctgccgtcgtcgtagcggcgctcgcgtcctccttcctcgccctcccgcgtcctcgcgccgccccgcccccagcgggatccgggcccctcatgtcgaaggcaaaggtctacaccgacgtcaacgttctgcgtcccaaggagtactgggactacgaggcgctcaccgtccaatggggtgagcaggatgactatgaagttgtcagaaaagttggaagaggtaaatatagtgaggtctttgaaggcatcaatgttaacaattatgagaaatgcatcattaagatccttaagcctgtcaagaaaaagaagatcaaaagggagatcaaaatacttcagaatctctgtggaggtccaaacattgtgaagttgcttgatattgtcagagatcagcattcaaagactcccagtttgatatttgaattcgtcaacaacacagacttcaaagtcttgtaccccacattgacggattatgacatccgctactacatatatgagctactcaaggctctagattactgccattctcaaggcatcatgcatcgagatgtcaagccccataatgtcatgatagatcacgagcttcgcaaacttcggttgatagactggggcttagctgagttttaccatccaggcaaggaatataatgtccgcgttgcatcgaggtatttcaagggacctgaactccttgttgatttacaagactatgattattctttggacatgtggagtcttggttgcatgtttgctggaatgatatttcgcaaggaaccattcttttatggccatgacaaccatgaccaacttgtgaagattgcaaaggtccttggaacagatgggttgaatgcttatttgaacaagtatcacattgagctggaccctcaacttgaagctcttgttggaaggcatagtagaaaaccctggtcaaagttcatgaatgctgataaccaacatctagtatcacctgaggccatagattttctcgataagctcctgcgctatgatcaccaagataggctcactgcacgtgaagctatggcacatccctacttcctccaagtcagagctgtggagaacagtagaacgagaccacaataatcgttgtctacaccctcgaaatgaagttgttgctaatttctggaacatcataggctaaaaccgttcaataagcatctcgctccaggaatctgggccatgactccgtggcagtgaatcagatagtatgggtcgcatcatgtgggcaaccttggcagatgtttttattgttgtctttaatcttgggactactgtagctttaaacctacaggctgtgcttgaatgacatgatattcatatcatatcgtctcctgtggtgggatatgaaattgtatgttatctttaaacataaacatactggttgtatt

SEQ ID NO: 15 - DNA, 1800 bp, Zea mays
cggacgcgtgggcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatt

SEQ ID NO: 16 - DNA, 2316 bp, Zea mays
attcggctcgagtgggcgcctccaccacctgatccacctctgtttcttcttcctttcatccgttcatacgggggttagatgatggagtcctgtgattgtatagatacgcagtatccgccggatgaacttcttgtgaagtatcagtatatctcggatgtgctaattgctcttgcgtatttttcgattccggtggagctcatctattttgttcagaagtctgctttctttccgtatagatgggtgcttatgcagtttggtgcctttattgttctctgtggagcaactcatttcataaacctgtggacattctctccgcactctaagtctgttgctgttgtcatgacgattgccaaagtttcgtgtgctattgtgtcatgtgcgacggcactgatgcttgtacacattattcccgatctgttgagtgtcaagaggcgcgaatcgatcctcaagaacaaggctgaagagcttgacagagagatgggacttattcttactcaggaagagacgggaagacatgttagaatgttgactcatgaaattaggagcacacttgacaggcatacaattttaaagactactcttgtggagctggggaggactttgggcttggaggagtgtgcattatggatgccttcgagaagtggtctgaatctgcaactttcccatactttaacctatcatgtgcaagttgggtctacggtgcaaacaaacaatcctattgtcaatgaagttttcaacagccctcaagctatgcggataccacccacctgtccattggccaggatcagacctcttgtgggaagatatgtgccccctgaagttgttgctgttcgggtgccgcttttgaatctgtcaaattttcaaattaacgattggcctgatatttcagcaaagagctatgcaatcatggttctcatcctccctactgacagtgttagaaaatggcgagaccatgagttggaacttgttgatgttgttgcagatcaggtagcagttgccctttcacatgctgctattttggaggagtctatgcgtgcccgtgatcaactcatggagcagaatgttgctttagatttagcccggcgagaggcagagatggcaattcatgctcgcaatgattttcttgctgtcatgaatcatgaaatgaggacaccaatgcatgcaattatagcattgtcatcacttctcttggagactgaactgacgccagagcaaagggttatgatagagacagtgttgaagagtagtaatgttttggcaacactcattaatgatgttctagatctttctcgacttgaagatggtagcctcgaattagaaatgggaaaattcaacctccatggagttttgggagagattgttgaactgataaaaccaatagcatccgtgaaaaagttacctatcaccttaattctgtctcctgatctgcctactcatgccattggtgatgaaaagcggcttacacaaactcttttgaatgtcgtgggtaatgctgtcaaattcactaaggagggctatgtttctgtaagagtatcagttgcaaaaccagaatcttcacaggattggcgacctccagagttttatccagcatctagtgatggccatttctacattcgagtccaggttaaggactctggatgtgggattctcccacaagatattccgcatctctttaccaagtttgcccagtctcggagtggaccagctcgacctagcagtggtgcaggtcttgggcttgccatttgtaaaagatttgtaaacctcatgggaggccacatatggattgagagtgagggccttgacaaaggaagcacagctacatttatagtcaaacttgggatttgtggcaatccagatccatccgatcatcaagctgcaaacagaagccaagcatatagtggaagtggtggcctcgctagatttaaacccttcatcacagatgaaaacgacactggtttttctactagacgcaatcaaagaagtttctaatatccaagacaccaaaattgcatacctctcaatcacagtcgacaagatggagtaaacctcctactttcattttgcatgtgctaaattgtataatttgcagtttgcggctgtagaataggattactatgtcaggcatatttctaacaaacaggttttatgcgaactcctgttgtattaactagaatacaatacaacaaaacaaagttgagagacgatctgttacttaatttgacttgtagtatatattgtcagtggcttttgccgtttagcgttcataaaaatgacagtattggcatgaaaaaaaaaaaaaaaaaaaaaaaaaaaaag

SEQ ID NO: 17 - DNA, 822 bp, Zea mays
ctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgtccgttctacctttggattaggtgttggtacccctgttgttccctttgtttgctcccgctatgaaacgagacgagagaagaatgagcaaggtttttgttcgcagctatttttgtccaatgatattgatatgttgttcccctgtctgttgctggattgttgtgtggctatacaaatatcaacaaactgttaaaaa

SEQ ID NO: 18 - DNA, 2031 bp, Zea mays
ccacgcgtccgccaaaagtgaactgtgaaccggacgatccaggcatccagctaaccgcttccccctcgtcgcgctcgcgccgcgccgcgcctcgcctccaccagctacgccgtcacgcgagctcacggcccgggggcctcggaagcacaaccaccacgcgtccacgccgaagccacgaggagagcctgtctctcctccggggattctatcgccggctggtctcagcggcgccacttggagcaggcggcacccgctccgtactgctgctgatttggtgagcgcgggcagccgcgggatgggagatctggtggcgtgatggtgagcccgggcagtaaccggggcggcctgtcgcgcgtatcgacgcggggcggcgtcgccgggccggggagcccgcgcgcctctcctgccgcgaccgctttcgcggcgctacggcgcaggtggcggtgggcgcccccgggctcgtcgacgctggagcgcgcggcccgcgcgttcctgctggcctccgcagcgctcgtgctctcctgcgcgctctacctctacgtgctgcgctacgtcggccggggaggtcgcgccttcgccgccgcgggcttcgtcggggacgccgtcctgggcctcggcggcgagccgtgcgacgtgttcgacggcgcctgggtgcccgacgacaccggcctccgcccgctctacaatagctccgggtgcccgttcgctgagcgcgggtttgactgcctcgccaacgggcggaacgacactgggtacctcaagtggcggtggaagccgcgccggtgcggcgtgccgcggtttgcggcccgcaccgcgctggagcggctgcgcgggaagcgggtggtgttcgtgggggattccatgagccgctcgcagtgggagtccttcatatgcatgctcatggccggcgtggatgaccccaggacggtcttcgaggtgaacgggaacgagatcaccaagacgatacgccacctggcggtcaggttcgcgtctcacggcctcaccgtggaattcttccggtccgtgttcctcgtgcaggagcatcctgccccgcggcatgcccccaagagggtcaaatccactttgaggcttgacaggatggataatttcagccggaaatgggtcaattcggacgtactgattttcaacactgggcattggtggacaccgaccaaattgtttgatacgggttgctattttcaggctggacgttctcttaaattaggtacatccattgatgctggtttcaggatggcactggagacctgggcctcatgggtacaaaaaagagttgatttaaaccgaacacatgtattctttcgcacatatgagccatcgcattggggggatacaagccaaaaggtgtgtgaggtaacagagcagccttcatcagaggccaaaggaaatgataagagtgaatttggggctatacttgctgatgttgtaaccaacatgaaagttcctatcacagtactaaatgtaactttaatgggatcgtttcgaagtgatgcacatgttggcacttggagttatcctcccactatacttgattgcagccactggtgtcttcctggagtccctgatgcttggaacgaactcgtgttttcgtaccttttgacaaatggttggcgaaacatggcgggctgaattttttggcagcacaatctacccgcacctattgcattgtgatatttgacattaccaggtatactagagaattaacatacgtccgggacaaggcagctgcagctgctaggtggttcactggacttctacattcttttcttctttttgatttttgactcgtatacacggtgaagcatgctacatgcaactagagttgtatgtagttggtaagggattagaaggccttggcattcgttctatttgctcaatttactaacggttcattttattatgttgttaaaaatcgagtttgtattgtaacctgtatgtacaaacatttacttgatacattgtgagaaagtgccctctctcaattggattgataaaaaaaaaaaaaaaaaaaag

SEQ ID NO: 19 - DNA, 1686 bp, Zea mays
gtcctgcccacgcgacgcgagagcgggagcggtgggtcgagtgacgagctggaccccgccgctagtcccctacccctgcctgctcccccccgcctgccccgtgtttatatctgccgcgccgcacagggagagagtcgagtccagctcggcaggtcagtcagtagtggatagctccgctcgcggtcgcgggcggctcgagtcgcaccccagatcccaatgcgccccgccgcgccgcactaggccgcggaacggaagctaggtgcgtcacacgccggggccggtcgcggtcaccggaccggacgcacaggggcgccgtacgtgcagtcatcggccatgaaggtcctcgtcctcgccgtgctggcgctcgtcgccgccgcctccgccgctggtcagggcgaggaggggggcgggccgccgctgccgttcgcgttgggcgcggcgccggcgggctgcgacgtcgcgcagggcgagtgggtgcgcgacgacgacgcccgcccatggtaccaggaatgggagtgcccctacatccagccgcagctgacgtgccaggcgcacggccgccccgacaaggcgtaccagagctggcgctggcagccgcggggctgctcgctgcccagcttcaacgcgacgctgatgctggagatgctgcgggggaagcggatgctgttcgtgggtgactcgctgaaccgggggcagtacgtgtccctcctctgcctcctgcaccgggccatccccgacggcgccaagtcgttcgagacggtggactcgctgagcgtcttccgggcgaagaactacgacgccaccatcgagttctactgggcgccgatgctggccgagtccaactccgacgacgccgtggtgcactccgccgacgaccgcctcatccgcggcgcgcccatggacaggcactacagcttctggaagggcgccgacgtcctcgtcttcaactcctacctctggtgggtcgccggggacaaaatccagatcctgaggggcgccgacaacgacccgagcaaggacatcgtggagatgaagtcggaggaggcctaccggctggtgctgcaccaggtggtccggtggctggagcgcaacgtggaccccggcaagtcacgggtgttcttcgtcaccgcttcgccgacgcacacggacggcagagcgtggggcgacgacgacgcggagggcagcagcaactgctacaaccagacgtcgccgatcagcgccgcctcgtcctaccgtggcggcacgagccgggagatgctgcgcgcaacggaggaggtgctggccacgtcgcgggtgcccgtcgggctggtcaacatcacgcggctgtccgagtaccgccgggacgcgcacacgcagacctacaagaagcagtgggtggagccgacggccgagcagcgcgccgaccccaggagctacgccgactgcacgcactggtgcctccccggcgtgccggacacgtggaacgagctgctctactggaagctcttcttccccagcaacgatcaggtcctctgatggtgaattggtgcctgcatacatacgcctggaaaccaactgctaggggctagcccaaagaaaatgtgtctagatgaacaaagacatggggttcaaatgttttgttttgatttcggatatggacgctgtcgatgctcttgttctctgtggaattcttcttaccaaaaaaaa

SEQ ID NO: 20 - DNA, 2069 bp, Zea mays
cccacgcgtccggcaagcttcggcctcacctccagcggcaggtggtgctgcggagcttctcctcgccctagatcccgcgcacccaacgccagatcagagatcagggcgcgccggccgtctccattgcccggcggatcctgcgatgcgagctggaccgagagggaggagcgagggagcgcgcgggtagagaaggcggggcggggggaggaaggaaggaaggagcgccggccggagcagacgtcccctcggggccctcggtcggatgagatcgacgatgaaggcgcagcacgccaacgggcgggggagcaggagccccttcctgacgtcctacgcgctcacgctcgccttcatcaccttcgtctccgtgctctactttaaggacttctcctccacgctgcaccgccccttcctccaccgcccccgccgccacgccgccccagacaaaagccaggcggggcgccgcgcggcggcggagcggctgccgttcgcggtgggcgcggcgccggcggggtgtgacgtcgggcgaggggagtgggtgtacgacgacgcggcgcggccgtggtaccaggaggaggagtgcccctacatccagccgcagctcacgtgccaggcgcacggccgccccgaccgggcgtaccagcactggcggtggcagccgcgcgggtgctcgctgcccagcttcaatgcaactctaatgctagagatgttgcggggtaaacgaatgttgtttgttggagattctctgaaccgtgggcaatatgtatctttggtttgcctcctgcaccgaatcatccctgagagctccaagtcaatggagacagttgattcccttacagttttcaaagcaaaggactacaatgccaccattgagttctattgggctccctttctggccgagtcgaattcggatgatgctgttgtgcaccggatcgcggatcggattgtaagagggacatccattgagaagcatgccaagttttggaagggggctgacatcttggtattcaacacctacctatggtggatgactggacaaaagatgaagattttgcggaactccttcgaagataaaagcaaggatatcatagagatggaaacggaggaagcctatgagatggtacttaatgctgtgctgaaatgggtggagagcaacatgaaccccaggacatcaagaacattctttgtcactatgtcacccacccacacaaggagcagagactggggcgatgatactgacgggaactgctacaaccagacagcccccatcgaggacctgtcctactgggggccagacaccagcaagggcctgatgcgcgtgatcggagaagtgttcagcgcgtctaagtccaggatccccgtgggggttgtgaacatcacccagctctccgagtacaggaaggacgcgcacacccagatatacaagaagcagtggaacccgctgaccccggagcaggtcgcggaccctaagagctacgcggactgcacgcactggtgcctgccggggctccaggacacgtggaacgagctgctctactccaagctctttttcccctgagttaaagggtttgagttgcgaggtgcacggtgaagttggggtctctctctggcattattggcacgctgcacaatactagttagcttggcataggcccagcagtctgaagatggatgctctgcctctgctgcggtagtttctcgggggcaaaccttccacgcggcatggcatggtattgttgatgtacgattcattcgttggaaaacctggacgtgagtgctggaattgcaccatctggccttttctgtacatgcctgatgtaacggtggtgttgtgtttccccaccaccacctctcttttcacgatgatgacgcagtgcatgtataattgtatgggttaatgacgcagtgcatgccttgcggagtgggccggtagacaaacatttcggcggctggtcacttggtcagtgacccgttgatattattattattattggatctaatgcaacaaccagttctggtgttggtgtccaaaaaaaaaaaaaaaaaaaaaaaaaaaaaaaaaaaaaaaaaaa

SEQ ID NO: 21 - DNA, 1499 bp, Zea mays
cccacgcgtccgcccacgcgtccggcggtgagcccggccaccagcgccggaggccgtcgtcgtcttactagccgacgctcgacttgggcatgaattgctagccgcgcgggtgagagattgctaggtagccagctaggtacggtgtggggagttgaatcggaggtctgccgctcgaggcggcggcggcagaaggccggtaggatgaagaagctccactggctggtgcggttcctgttcgggccggtgccggtctacttctcggcgctggccatcctcatcgtgctcaccaacgcgcagtacttcgggctggtgggcgtcggcgtggcgccgcgcaccgcgaagctggcctcctcggcgcccgtggtcagcgtcatgaagtactgcgacatcttccgcggcgagtgggtgccggacgcggaggcgccctactacaaccacaagacgtgccacatgatccaggagcaccagaactgcctcaagtacggccgccccgacctgggcttcctcaagtggcggtggcggccctccggatgcgagctgccgcgcttcgacccgctgcagttcctgcagttcgcccgcgggaagtcgctggccttcgtcggggactcgctggcgcggaaccacatgcagtcgctgctctgcctcctgtcccaggtggcgtatcccaaggacctgtcggcgaacccgtcggaccagaacaaggtgtaccactaccgggcgtacaacttcaccatcagcatgttctggtcgccgttcctggtgcgcgcccgggagcccgaccacgacggccccgcgcacacgggccactggagcctctacctggacgagcccgacgacaagtgggtgtcccagatgccccgcttcgactacgtgctggtgtcggcggccaactggttctcccgcccctccctcttctacgagcggcggcgcctcgtcgggtgcagcttctgcagccgccagtacggcgtgcccgacctgacgctctactactcgcagcgccgcgcgtggcgcgtggcgctgcgcgccatcaacgacctggagcgcctgcgagggcgcgtcatcgtgcgcatgctctccccgatgtcgcacttcgagaacgggacctgggaccacggcggcgactgcaggcgcacgcagccgctgcgggcgaaccagaccgccatggagggccgcgacctgcacttctacaccgcgcagatggaggagttccgcgccgcggagaaggccgccgccgagaaggggcggcgcctgatgctcatggacgccacggcggcgatgctgatgcggcccgacggccaccccagccgctacgggcactggcccaacgagaaggtgcagctctacaacgactgcatccactggtgcctcccgggacccatcgacatctggaacgacatgctcttccagatgctcctcgcctagcagcaagcagcaaagattaaaaaaaaaactcagcaattcggtcgccaaaaaaaaaaaaaaaaaaaaaaaaaaaaaaa

SEQ ID NO: 22 - DNA, 813 bp, Arabidopsis thaliana
atggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttag

SEQ ID NO: 23 - DNA, 750 bp, Arabidopsis thaliana
atggcttatgggaagaggccttttggaggtgatgaatctgaagaaagggaagaagatgagaacttgttcccggtcttctcggcccgatctcaacacgacatgcgtgttatggtctcggccttgactcaagtaatcggaaaccaacaaagcaaatctcatgataacatcagctctattgatgataactatccttctgtgtataatccacaagaccctaatcaacaagttgcgcctactcatcaagaccaaggggacttgaggaggagacattatagaggtgtaaggcaaaggccatggggaaagtgggcagctgaaatccgagacccaaaaaaggcggcacgtgtgtggctcgggacatttgaaaccgctgaatctgcggccttagcttatgatgaagcagccctaaagttcaaaggaagcaaagcaaaactcaatttcccggagagggttcagcttggaagtaactctacatattactcctccaaccaaattccacaaatggaaccacaaagtataccgaactataatcaatactatcatgatgcgagtagtggtgatatgctaagttttaatttgggcggtgggtatgggagtggtaccggatattcaatgtctcatgataatagtactacgactgctgctacaacttcttcgtcttctggtggctcttctaggcaacaagaagagcaagattatgccagattctggcgctttggggattcttcttcctctcctcattcgggatattag

SEQ ID NO: 24 - DNA, 477 bp, Arabidopsis thaliana
atggaggtctctaactcttgttcttcattttcttcatcctctgtcgacagtactaaaccttctccttctgaatcttctgttaatctctcccttagtctcacatttccttctacttctccacaaagagaagcaagacaagattggccaccgataaagtctagattaagagatacactaaagggtcgtcgtcttcttcgtcgtggtgatgacacttctctctttgttaaggtttatatggaaggtgttcccattggaagaaaactcgacctttgcgtattctcaggctacgagagtctattagaaaatctctctcacatgttcgatacttcaatcatctgcggtaatcgagatcgaaaacatcatgttttgacatatgaagacaaggatggagattggatgatggtcggagatattccatgggatatgtttcttgaaaccgtgagaagactaaagatcacgagaccggagaggtattag

SEQ ID NO: 25 - DNA, 1164 bp, Arabidopsis thaliana
atggcgtcgtctccgttgactgcaaatgttcagggtaccaacgcttctttgaggaatagagatgaagaaactgcagacaagcagatacaattcaatgaccaaagttttgggggaaatgactatgcacccaaggtacggaagccatacacgataacaaaagagagagagagatggacagatgaagagcacaagaagtttgttgaagccttgaaattatacgggcgagcttggagacgaatagaagaacatgtgggctcaaagaccgcagttcagattcgaagccatgctcagaagtttttctctaaggttgctcgagaagcaactggaggtgatgggagctcagtagagccgattgtaatacctcctcctcgtcccaagagaaagccagcgcatccgtaccctcgtaagtttgggaacgaggcagatcaaacgagtagatcggtttctccctcagaacgtgatactcaatctccaacctctgtgttgtccactgttggatcagaagcattgtgttcccttgattcgagttcacccaatcgaagcttgtccccagtttcttctgcatcaccaccagctgctcttacaaccactgcaaatgcacctgaagagcttgagactctgaagctggagttgtttcctagtgagagactcttaaacagggagagctcgatcaaggaaccaacgaagcaaagtcttaaactctttgggaagacagttttggtatctgattcaggcatgtcctcttctctaacaacttcaacatattgtaaatccccaattcagccattaccacggaaactctcatcatccaagacactacccataataagaaactcacaagaagaactcttgagctgctggatacaagtccctcttaagcaagaagatgtggaaaatagatgtttggattcaggaaaggctgtccaaaacgaaggatcatcgactggatcaaacactggttcggtggatgatacgggacacacggaaaagaccacagaacccgaaacaatgctatgtcaatgggagtttaaaccaagtgagaggtctgcattttctgagctcagaagaacaaactccgagtcaaattcaagaggatttggtccatacaagaagagaaagatggtaacagaagaagaagagcatgagattcatctccacttatag

SEQ ID NO: 26 - DNA, 1047 bp, Arabidopsis thaliana
atggcctccgaggattgggatctcttcgccgtcgtcagaagctgcagctcttctgtttccaccaccaattcttgtgctggtcatgaagacgacataggaaactgtaaacaacaacaagatcctcctcctcctcctctgtttcaagcttcttcttcttgcaacgagttacaagattcttgcaaaccatttttacccgttactactactactactactacttggtctcctcctcctctacttcctcctcctaaagcctcatcaccatctcccaatatcttactaaaacaagaacaagtacttctcgaatcacaagatcaaaaacctcctcttagtgttagggttttcccaccatccacttcttcttctgtctttgtttttagaggtcaacgcgaccagcttcttcaacaacaatcccaacctccccttcgatctagaaaaagaaagaatcagcaaaaaagaaccatatgtcatgtaacgcaagagaatctttcttctgatttgtgggcttggcgtaaatacggtcaaaaacccatcaaaggctctccttatccaaggaattattacagatgtagtagctcaaaaggatgtttagcacgaaaacaagttgaaagaagtaatttagatcctaatatcttcatcgttacttacaccggagaacacactcatccacgtcctactcaccggaactctctcgccggaagtactcgtaacaaatctcagcccgttaacccggttcctaaaccggacacatctcctttatcggatacagtaaaagaagagattcatctttctccgacgacaccgttgaaaggaaacgatgacgttcaagaaacgaatggagatgaagatatggttggtcaagaagtcaacatggaagaggaagaggaggaagaagaagtggaagaagatgatgaagaagaagaagatgatgatgacgtggatgatcttttgataccaaatttagcggtgagagatcgagatgatttgttcttcgctggaagttttccatcttggtccgccggatccgccggtgacggtggtggatag

SEQ ID NO: 27 - DNA, 750 bp, Arabidopsis thaliana
atggcttgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtctgtttccgaggtggatatgtggatgcttgatgatgtcattgcgtcgtatgagtag

SEQ ID NO: 28 - DNA, 1197 bp, Arabidopsis thaliana
atggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggatatgggcaaacaggcagtccgcagcacgatcgaaagaaaggaagacgagatacatatttgagcttgagagaaaagtacagactttgcaaacagaggctacaactctctcagcccagttgaccctcttacagagagacacaaatggcttgactgttgaaaacaatgagctgaagctgcggttacaaacaatggagcagcaggttcacttgcaggatgaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactag

SEQ ID NO: 29 - DNA, 639 bp, Arabidopsis thaliana
atggtctccgctctcagccgtgtcatagagaatccgacagacccgccggtcaaacaagagcttgataaatcggatcaacatcaaccagaccaagatcaaccaagaagaagacactatagaggcgtaaggcagagaccatggggtaaatgggcggcagaaatccgcgatccaaagaaagcagcccgtgtctggctcgggactttcgagacggcagaggaagctgctttagcctatgaccgagctgccctcaaattcaaaggcaccaaggctaaactgaacttccctgaacgggtccaaggccctactaccaccacaaccatttctcatgcaccaagaggagttagtgaatccatgaactcacctcctcctcgacctggtccaccttcaactactactacttcgtggccaatgacttataaccaggacatacttcaatacgctcagttgcttacgagtaacaatgaggttgatttatcatactacacgtcgactctcttcagtcaacctttttcaacgccttcttcatcttcttcttcctcccaacagacgcagcaacagcagctacaacaacaacaacagcagcgtgaagaagaagagaagaattatggttacaattattataactacccaagagaataa

SEQ ID NO: 30 - DNA, 2163 bp, Zea mays
atggagatgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaaggaaggagttgtctgaaaaaggaagtcgctcggaagttcttaatctcttccgtgatgccccatctgcatcattttcttcagttaacaaaagctcttcaaatcatggggcacccaggaggaccgaggcaagtaaaacagaaagccgagatatgtccatcatggaaaataattcttttaaccccaacacccaagaggatgtaaaggtgatcagtgatcaggaaatggaaaggcttaatggtatccagatcagatctaaatgtgaacattctcatgaggggtatttggacatctcaacgcaacaaatgaagctaatgccaaagtctgtggagacaacatatgtggatgaacaaactgcaagagcttcacacaccctagcagagagcaacgggacagctagcgttccagtgactgtacctgaaggaactcatcctgatcaaacaagtgatcaagtgggaatcaatggaagcatgaacccatgcatccatccaatggtttctgcagacccaaaatttggtagtagtgccacaccacagacttttcctcataattatgctgcctttgctccaatgatgcagtgcaactgcaaccaagatacgtacaggtcattcaccaacatgtcatccacgttctccagcatgcttgtttccacgttgttgtcaaaccctgccatccatgcagctgccaggctcgcagcatcatactggccagcagctgaaggtaacactcctattgatccgaatcaagaaaaccctgcagatggcgtccaaggaaggaacataggctctcctccaagcatggcttctattgtagcagctacagttgctgcagcatctgcatggtgggcaacacaaggtcttctccctttcttcgctccacccgtggcttttccatttgtaccagctcctagtgctgcctttcccacagttgatgttccacgaccttcagagaaagacagagattgcccagttgaaaatgcacagaatgaatgccaagaagctcgaaaacaggtacagttcgaaggtttaagagttgctgcttcttcagagtctgatgggagtggaaaaggcgaggtgtctctccatacggagttaaagctatctcctgcccagaatgctgatgccacacctaccacaggagctggcacaaatgatgcattcaggaataagaaaaagcaggatcgctcttcatgcggttctaacacaccttcaagtagtgatgtagatgcgggcaatgttcctgaggaggacaatgctaatgagaaggcgaagcaagcctcctgcagcaactcttcagctggtgacactaaccaccgcagatttagaagcaatggaagcacaagtgattcatggaaggaagtttccgaagagggtcgtctggctttcgatgcgctgttcagtagggaaaagcttccgcaaagcttttctcccccacaagcagtagactcgaaggaggttgccaaggaggaggaagatgaagtgaccacagtggcggttgacctcaacaagaatgccacaagcattgatcatgatgacctcgacacaatggatgagcccagggcttcctttcccaatgaattgtcgcacctgaagctgaaatcgcgccgtacaggcttcaaaccatacaagagatgttctgtggaagcgaaggaaaaccgggtgccgactagcgacatggttggtaccaagaggattcgtcttgatagcgaagcatccacataa

SEQ ID NO: 31 - DNA, 1223 bp, Zea mays
ccacgcgtccgggtgaagccgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggactggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggcccgagttgaacaaaaaaaaaaaaaaaaaaaaaaaaaaaaaaaaaaaaaaaaaaaaaaaaaaaaaaaaaaaaa

SEQ ID NO: 32 - DNA, 1073 bp, Zea mays
ccacgcgtccgcggacgcgtgggttctgctttaccactcaatctggttgagagtcgccggcgccggcgattcctcctccaccgattcgcccggcgggagtctccgcagggctcaccgggaccgcgggtccacgatggccgccaacttctggacgtcgtcgcactgcaagcagctgctggaccccgaggacgtggacctggtgccggcggcggaccgggagcgaggcatcacgccggaagagttccgcctcatcaagatccatatgtcgttccatatctggaggctagcacagcaggttaaagttaggcaaagagttgtagctacagcaatagcttacttcaggcgtgtgtatacaaggaagagcatgtcagactatgatcctcgtttggttgcacctacttgtttgtatttggcatctaaggtggaggagagtacagtgcaagcccgacttcttgtattttatataaaaaagatgtgtggttccgatgataagtatcggtttgaaattaaggatattcttgaaatggaaatgaagctcctggaagctctcgactattatttggttgttttccatccatatcgtcctctcttacagttgttgcaggatgctggcataacagacctgacacaatttgcctggggccttgttaatgatacatacaagatggaccttatcctcatataccctccctacatgattgcactggcctgcatatacatagcgagtgttttgaaagataaggacaccacagcatggtttgaagagctccgtgttgacatgaacatagttaagaatatctctatggaaatattagacttctatgacacctacaagattgatcctcaaaggggcatccctgaggataagataagccccgtgatgaacaagttgccggcaaaggcttaactcagatttggcgagcttaggagttgtaaactagtagtaaactacatcatacttccaccatgtgtgtactcagcctgcactgtcgcttgtgacgtgttgatgaactacttgatagattcaatgcaagaaccccatggaattgtttgtgtaaaaaaaaaaaaaaaag

SEQ ID NO: 33 - DNA, 2001 bp, Arabidopsis thaliana
aaaccatggccttgtctcacatagtatcaataatgtttaattaaacacgcttttaaaacactaactggtccccaccaaactgccgcaaaagtccatctagttcatgactttcagctaacctcacacccccgtcaccctaatgctgtcacatccaaccaatactttacttccacgtgtaatataaccaatgagttcacgccaaaaaccacaaacactatcgtgtcacgttagcacttcccaaaaccaccaccgtgataaaacagtcctctccatttctctactcaacatccatccgaaccaactcgaagatattatttttcatggattgagcaaagaagaggacgataatttcgaaaatatcgcgatacaatggacaagttctcgtacaattcgtatccagattcagctgaatcgtcgccaagatctcgcgatgtcgaatttgaaaatccgtcgccatgggaggaccagcagcagcagaactacaaggtgaagctcatgtgcagctatggcggcaagatccagcctcgtccacacgataaccagcttacttatgtaaacggcgataccaaaatcatgtcggtcgatcgtggtatcagatttccggctttagtatcgaagctctccgccgtctgcagcggtggtggtgatggaggagaaatctcgttcaagtatcagcttccaggtgaagatctagatgcgttgatttcggtgactaatgatgaggatctggagcacatgatgcatgagtacgatcggttgcttcgtttgtctactaaaccagctaggatgcgtttgtttctcttcccgtcttctcccatttccggcggatttggctccgaaggttcgactaaatcggatcgggatacgcttaatccaatccctagccgacctgaatcggagaaatctgtaaccgctcctccgaataatgctgatttcttgtttggatcggagaaagtagctccaattccgccgtcgccagtgaaggttcctcaaccggtaccggaaccagtggtgcttgaaccgccgcagatgttcgtagatcaacggatgttacaaccggaacacggcgtaaatccggcggagattcaaagacaaatccaggaatttcagatgattcaaatcagagaccaagagcaacaaatgcttcatcagaatcagctacatcaacaacaacaacaacaagaggctatacatcaaaatcagcttcatcaccaacaagaggttatacatcagaatcagctgcttcaacaagaggctatacatcagaatcagatgcttcaacaacaacaacaacaagaggctatgtacagaagaaaaaccgaagacgaagccggaagatacttccctcccacatacactcaaaatccggcgccggtgacgaatcaacaacctccggttggctactggcaaggaaacaccaacaacagtaatattcaggggaatatctacacaacaacgtcacagaatctaccggagcaacaacaacaacaacaacaagtatacatgattccagctcaatctcaagctccagggacattataccaaagcgtcatgagaccaacggtacaaggaaaccaaggttattacccatcacctgttcagcgacttcatcatcctgatgcatacatggaacagcagaaccagccaggttacaacgtggttcaaccacagccaacgttttcaggtggtccacaagttatgactagtgttggtccgcaagttatgactagtgtcggtcctccaatggggttacaggaaccttattcacagatggggaagcctgtgtactatacggtggctggagaaggcatgatggttcaaccgccaccagcccagcctcagcagcagcagcagcagtaccagggaatgggtcaaccggttagtggcatgaccgatctcagaaccggaccggatgggaaagtggcggttaacatggctgcaccacaagtttcagattcggtgtgagtgtgagattgagttaacattgaggttaatgttatg

SEQ ID NO: 34 - DNA, 1511 bp, Glycine max
attcggctcgagtaggtgtctctcactctcccaccgaatccacattctaaagtaatacgccggagaatgacgtcacactcccactacccacccgacttagacgccgactccgtcacctcctccccacgctccgatcacttccacgacgcgccgccccgcatccgcttcatgtgcagcttcggcggcaagatcctcccccgcccccacgacaaccagctccgctacgtcggcggcgacacccgcatcgtcgccgtcaaccgctccatcactttctccgccctcattctcaaactctccaaactctcaggcatgagcaacataacagccaagtaccagctcccgaacgaggatctggacgcgttgatctcggtcaccacggacgaggacgtggagaacatgatggacgagtacgaccgcgtcgcacacaatcagaacccgcgatcggcgcggctccggctcttcctcttccccgaaggagaagactcccgcgccagcagcatcagctcgctcctaaacggctcagccaagcgcgaaaactggttcctcgacgctttaaacggcggcgtttcgggcctcgaacgaggccgctccgaagcctcttctatggtctctgaagtacccgattacctcttcgggttagacaactccgaagaaataacaaatcaccaacgcgacccgagacccaaacccggacccattattcaagataacgtttccgtttcagatccgggttcgcccgccccggttgtctcgtccccttattgttccacgtcatcagcgccgcccgtgccctctctcccgaaccttccctatgttaaaaccaaacctttaaacttaaatccggttcctgatactgactccaaggaaaatcaaaccgaacctgaaacggaacctcacccgaacctgaacctgaaccaaaacccgaacatgtattcaaataaccctgttgttcactaccctccagaagctgcttattcggcgcattcagtaaacccggttccggtttactatgtttccggtccggttcgaccgggatccgtgccggttcctatgcaaaccccttatcactacgttcaacaatcgtatcatgctgtggtgccacctcaggttcctatcgggtaccatcctttggttccgggttcgggtcaagtatatggagcgggcgtgaggcacatgaccccactgcaaccttacagcccctccaccacggcggtggttcatgacggtttgaaacagcacgtgtatcatgccgtgccaaattcgggtccggttccggttcacccagttattccgatgacgggtttggatgaaccgcagagaggtggagcgtaatttgtgacgggtcggggccccaattcacttaataactgatcccatttttatttagtggatgggtgctgaatttttactaccataccatcatgcaaatggtaatttatgtctatatatatacaagtgccttcactaaaaaaaaaaaaaaaaaaaaaaaaaaaaaaaaaaaaaaaaaaggg

SEQ ID NO: 35 - DNA, 1599 bp, Glycine max
attcggctcgagtttccacatatctgacagaaaaaaatggagaactatcagtacccggcgtcgtaccctgactccggcgagtcctccccgcgctcgcgcgagatcgacttcgagaacccgccgccgtgggacgagcagcagaaccaaaactacaaggccaagttcatgtgcagctacggcggcaagatccagccccgcacccacgacaatcagctctcctacgtcggcggcgacaccaagatcctcgccgtcgaccgctccgttaagttctccgccttcctctccaagctctccgccctctgcgactccccgccacaggacctcaccttcaagtaccagctccccggcgaagacctcgacgccctcatctccgtcaccaacgacgacgacctcgaacacatgatgcacgaatacgacagactctatcgccctaacctaaaacctgttagaatgagactcttccttttcacactctctaattcaaaccctaattcctctttctcctccgaacgcgaccgtttcgttgaggctcttaattcgggtccggttccttctcaacccgatccgatcaaaaccccacccgttacgccttctaatgttgattatctcttcggtctcgataaagccgttgctcctccaaatcttcctccgaacttcgcagcggttaaattccacgatccggtgccggaacctgtcgctccgacgccggtagagtatcaatcgagagtttccgatcgggttgttggatcggatccgaatgtgaattcgatggaaattcagagacagatgcagcaggagatgcagcgattgcagattgcggagaatgaatatcgtagaaggagtgaggatggatttgcaactggttatgctgctgcagccggaggagattattacatgcagaaggtgcaggagaaggttccgccgcagaatgcggcggtgccgcctccggcggcgtactggtcggagaagcagttttccggggagggatatcagacgacggtgacgacggcggctccgggaggaggtgaccagccgatgtatgttatggcggcgccggggacgttctatcaccactcgccggtgatgcgacctccggcggcggcgcagggatactacgctgtgcagaggatgggttctgatggctaccgtgaacagcaggcggtgtacggaggcatggctgcgccgaaagcggggttttcgacggcggggatggttaaggggccggcgtattcggagggatatagtggcggcgtggtgaggccggcggggttgccggataatgcggcgtatgcgcaggtggcgtatgatagcgcgagtgggagacaggtttactatactgcgcagggaggagtggtgcacgcgccgccgcagtaccaggggggtccgcctcaggatgtgaggccgggtggggtttcggtggggcaggatggtaaggtggttaacaaggttaaccaaggttctgtgtgattataatagctgtgattgagattgtcattatgttaattttgaaataaataatacactaaatatgttttgctttttttttcatggtttatatataataccaatattgttagcttataaaaaaaaaaaaaaagg

SEQ ID NO: 36 - DNA, 2308 bp, Glycine max
gcccccaaaacagagcaaaacagaggatccactccaccactactcctaatggatcctccacccctctctgccgccactcaaaaaaaccatcccgaatcggtagagtccttttctccatgtttccgcgttgcggaaacgtggactgatgagactctaccggcggttcctggtgccaagctgcgcctcatgtgcagctacggtggccacattatgccacgccctcacgacaaatctctcagctacatcggtggcgacacgaggatcgtggtggtggaccgccactcgtcgttgaaagatctatgttcacggctttcccgaactatcctcaatggaagacccttcacactcaagtaccagcttcccaatgaagaccttgagagtcttatcactgtcaccactgatgaagaccttgacaacatggtggaagagtatgatcggataatggcaaaaggttcggcttcttcgcggctcagggtgttcctgttcttcaccaaacctgaggccacagtttcaatggggtcactccttgatgatgccaagtcggagacatggtttgttgatgcactcaacaactctggcatgatatcaagagtggtgtcagattctgctgccggggattcttttgttaaccttgatggtgttggtgttggtggtgttagtgctagtggttcaagcaacaacttggagtctttgcctgatgctaacaaggttaagaattttcctgaagtggtgcaagtgcaatcaacacctggttcgcctatgatggagaacagttcttcttctccttctttctctccttctctggttaatctgcctccaattcgggttcatgttgatgacaatggtagtaggcttcagcaagagaataaggttggtttggtggtggaggagcaatttgctcagatgacaattgcaagtggggtgaagccagatgatggattggtgaatgttgtttcttctgcagtggctgtgcctgtaattcctgcatctgtgactatggcatcagctggggtgattactactagtgataatgtgatgaatagagttgtttgtgaggatgacagatcagatcccgggtttcagaagccccctttaccattgcagcttgtgcagccaaggactagtggtggtgtgggtttgccttcacctgattcagttgcaagtgatagtagtattgcagctgcaaattctttctccaagactgtttactaccaagatcaagtccaagctgcactactagacaacaaaattgttgctatgccaaatgccaagagtgaaatatctgatcagatgattcaggtccaaggacaacttcaagattctggctacacattacccccacaattggatccaaacaagcaacatttccagcagcagaagccatttgtccatgccagcactcactacatccaccacccagcagccacaggtccagtgccagtttcatcatactacccagtttatgccccaccacaacctcaacaacttcaccctccaattggtcaacaacagtacccagtttatgtaatgccagttggacctacacaagtaacacaaccctacaacatggcattgcagcccaatatagctgatcctaatgtggtagcttcaagcaggtcattaatgccacaaagtattgttacctcagcagcatacaaagatggtactccacctatttaccccaccaagtcagttagctctactatggcatcaaattctggatatgctccaatacctaccaaccaatttcaaccacagtatgtgggtttgcatcagttccatcatccaccacagtccattgctgtggctccttctagtactactactaataataattatggttatgaatatggtggccatgtgcaagaccaagcttactacactcaacaaaccaccactgctccattgcttcctcagtaccaatccatgaccccagctgcagctgctgcagcactatcagatgcttcaaaatagtttcctgcagacaacattcagcagccaactagagcatcacaaccagtatgaatcaaaaagtggagaaaaatgaatgaatgagtttggtggaggcatgttggggaggggtggggtgaggggcaattagactttactttcattttttaaccatgaacatatgcaccctaatttctacagaaaaaaaaaaaaaaggaaataaggagtaaagcataggttatttcttttttatctataatgaaatgaatgacatgtaagatcatattctgcaaacttagctttttctggtcgtcacagtttactcagttgaataaagcaagttgttgccattaaaaaa

SEQ ID NO: 37 - DNA, 2196 bp, Zea mays
cggacgcgtgggctcccttttccagcacggggagcgacctgcgccgccgccacgatgccgaagcactaccgccctgcgggtaagaagaaggaagggaatgcggcaaagtacatcacgaggaccaaggcggtcaactacctgcaagttagcctcgcaatctttaggaagctatgcattctaaagggtgtctttccacgtcagccaaagaagaaggtggaagggaaccacaagacctactaccacacaaaggatattgcattcctcgctcatgaccctttgatcgagaagttcagggagattaaggtccatcgaaggaaggttaaaaaggctgttgctaagaaaaacagggatcttgcagacaggctgttgaatcggccaccaacttacaagcttgataggcttgtccttgaaaggtatccaacattcgttgatgctcttcgtgacttggatgactgccttacaatggtgcatctgtttgcggcattacctgctgttgacggtgaacgtgttgaggtcaaacgaatccataactgccgcaggttaagccatgaatggcaagcatacatatcccgaacccattctctgaggaagacatttatttccgtgaagggcatatattatcaggctgaagttcaaggacaaaagatcacctggctaactccgcatgctcttcagcaagtattaactgatgatgttgatttcaatgtgatgctttcttttctagaattctatgagactcttctaggatttgtgaacttcaaactctatcattcaataaatgtaaattatcctcctattctggatccacgtctggaagctttagctgctgagctctatgcattgtgccgatacatgtctgctggttccagaagaatgattgggaattcacaaactgacgaagtaatggaagataaggatgagaaaagtaaagctgaggaagtaattaaggaagagaaggttgtgaagaataaagcaagctcaaaagcagatgaatctgagctcagattagcacagcttcaacatcagctcccaaccaatgaacctggtgcactgatgaatcttgtagaagaatcaactgccgatgatgcagatgatgatgatactaaagattgtaaaggtttatttaagaacttaaagttctacttgagtcgagaggtgcctagggagtccctgttatttataattccagcgtttggagggactgtttcatgggaaggagaaggagctccatttaaagaaatagacgaagatatcactcaccagattgttgataggccgacacaaagccatgttttcctctccagggattatgttcaaccacagtgggtctttgattgtgtaaatgctcgtatcatattgccaacagaaggttatcttgttggaagagtacctccaccacatttgtctccttttgtggacaatgatgccgagggctacatgcctgagtatgcagagacaataaagaggctccaagctgctgctcgcaatgaggtgttgcctcttccaggtattggtgatgaagatctagacaattcactggtagcagcaatgatggatcgaacagcttctaacgaagctgctgaaaagaagaggaagctggagatgctagagaagcaatacatcgatgaactgaagaaggaaattgatggcgttgctttctctagtttgtcaaacaaggaagcagataaatcaccgaatgcaaaagatgatactcagtcagatcgtgaggaggatgccagtaaacaagaggaggatgatgatgatgatattggtactgctctcatgtctcgcaagcagagaggcctttataaggctatgaagatgggcaaagaaaagaaaaaggagaaagttgagctactcaagaagagaaaaaagaacgcggattctggcgcttcttccaagaagcggcactgatgtgtcacaaatcttcatcgcattggtgtgtcatctctagtagaaatgttaccatgatcagctctgcgtgccaatcccccatgatgggtgggttgccttttgatatctgctatgtatgcttaagatgagttcaaggatatgtaacatgaaacttgaatagaaaagttttgatctgtcttacgaagcatttagactcgttattattgtgaaacttgaatagaaaagttttgacctgtcttacgaagcatttatagttattattgagaagcctggataaaaaaa

SEQ ID NO: 38 - DNA, 2684 bp, Saccharomyces cerevisiae
caaccgagcatcatattccttggtgtgcttttcaccttcgacaggtatgttatggagtttgttgatgaatgataattgcttggcaagtcgcatttgaatttctttaatatctgctccttccaagggaagacctgataaccgcaacaatttttttacagcttcagcagacggtggctctagtttttcctctttagtgtttatgcctaaatattcgtggacggaccatacaggtcttgataaataatcccttatttgattcatattttcaaattttttaccaatctttgcccctcccgtagatacgaaccgatgacttccatcatggcataacccacccactgtatgtgttctgcatagacgccatgttttgtacatcgttctagcactatgggtaagtgcaaatagttcgatctaaaagcctaaatgctagtcactattacctccttgatgttatatttacagaataatgtcatgtcgtctgtggtgactattattattgcctgaaaaaattaaagaaaattttttgcgatgagatgagatgagaaaaaatgaaaaattttggaaggttaattagagatgtgtagtaaatcctgctggtggaatacattttattcctgtagaaaatagtatagtaacagcggtatcctacttatacaatgagaatcaagaagaaaaacaccagaggtaacgcaagaaactttattaccagatctcaagctgtgagaaaattacaggtttctcttgctgatttcagaagattatgtatattcaaaggtatctatcctagagagccaagaaataaaaagaaggcaaacaagggctctactgcaccaactactttttactatgctaaggatattcaatatctaatgcatgagcccgttttggctaaatttagagaacacaagacttttgctaggaaactaacaagggctttgggtaggggagaagtctcttctgctaaaaggttagaggaaaacagagatagttatactttagaccatattatcaaggagcgttatccaagtttcccagatgctataagggatattgatgatgctttgaatatgttatttcttttctctaatttgccctctaccaaccaggtttcctcgaaaattatcaatgatgctcagaaaatctgtaatcaatggttagcctatgttgccaaggaacgcttggttcgtaaagtgtttgtatccattaaaggtgtttattatcaagccaatattaagggtgaagaagttagatggttagttccattcaagtttccagaaaacatccccagtgacgttgatttcagaattatgttgaccttcttagaattctactcgactctattgcatttcgtcctatataagttatacaccgatagtgggttgatttatccgccaaaattggatcttaaaaaggataaaatcataagtggtttgtcatcatatattctagaatccagacaagaagacagcctactaaaacttgacccaactgagattgaggaagacgtaaaagttgaaagtttggacgcatcgacattaaagtctgccttgaatgccgatgaggcaaatactgatgaaacagaaaaggaggaagaacaagaaaagaaacaagaaaaggaacaagaaaaggaacaaaatgaggaaacggaactagatactttcgaggataacaataagaacaagggtgacatcttaatacagccaagtaagtacgattctcctgttgcttctttgttttctgcatttgttttttacgttagcagagaagttccgatcgatattcttgagttcttgatcttatcttgtggtggtaatgtcatcagtgaagctgctatggaccaaattgaaaataagaaggatattgacatgtccaaggtcactcatcaaattgttgacaggccagttttgaaaaacaaggtagctggcagaacgtatattcagccacagtggatatttgattgtatcaataaaggcgaattggtacctgccaacaaatatcttccaggggaggctcttccacctcacttaagcccatggggtgatgctattggttacgatccaactgctcctgtcgaagaaggcgaagaagaagaaagtgaaagtgaaagtgaaagtgaagatcaagttgaggaggaagatcaagaagttgttgctggagaagaagatgatgacgatgacgaagagctacaagctcaaaaagagcttgaattggaagcacaaggtatcaaatattctgaaacttcagaagctgataaggatgtcaataagtcaaagaacaaaaagagaaaggtggatgaagaagaagaagaaaagaaattgaaaatgataatgatgagtaacaaacaaaagaaactttacaaaaaaatgaagtattctaatgctaaaaaggaggaacaagctgagaacttaaaaaagaaaaagaagcaaattgccaaacaaaaagctaaactgaataaactagattccaagaaatagttttctcttcttttccaatagcctctcaaaaattttgtcttttaatttaacatctttattactttataattcctcggtatagcaacattagatatataactacacatttttgtttgtagatatagaaatacctgtacattaaaagtggttactgttgttctgtataactatatgagtgaattttgtaaaaatatgcccaggtgccaatga

SEQ ID NO: 39 - DNA, 1099 bp, Zea mays
tcactgttctctgataacaacgttgttagttgtcaccatggttgttctgtctcagccagcattaaaccagtttttccttctgaaaacatgcaagcccacgcccttgttcgcggggattcctgtggtcgacctcacggaccccgatgccaagacccacatagtcaatgcctgcagggacttcggcttcttcaagctcgtgaaccacggtgttccgttacagttcatggccaatttggaaaacgaaaccctcgggttcttcaaaaaacctcaatccgagaaagacagggctggtccccctgacccttttggctacggcagcaagaggattggccctaacggcgatgtcggttgggtcgaatacctccttctcaacaccaaccctgatgtcatctcccccaagtcacagttcattttcagagaaggtcctcagaatttcagggcggtggtggaggaatacattagagcggtgaagaacatgtgctatgaggtgttggaattgatggctgagggattggggataacgcagaggaatgtgttgagtaggttgctgaaggatgagaagagtgattcttgcttcagacttaaccactacccgccatgcccggaggtgcaagcattgaacggaaggaatttggttggatttggagagcacacagacccacagataatttctgtcttgagatctaacagcacctcaggcctgcaaatctgtctcacagatggcacttgggtttctgtcccacctgatcaaacttcctttttcatcaatgttggtgacactcttcaggtaatgactaatgggaggtttaaaagtgtaaagcatagagttttggctgacccaaccaagtcaaggttgtcaatgatctactttggaggaccacccttgtgtgaaaagatagcacctttaccttcactcatgttaaaaggagaagagagtttctacaaagagttcacatggtgggaatacaagaaggctgcgtacgcgtcaaggctagcggataatagactcggcccttttgagaaatctgctgctgattaaggaggcaaagtgtgtcaaaattctactactcaattttggcacgtgttgttaggccaactt

SEQ ID NO: 40 - DNA, 2311 bp, Zea mays
ccacgcgtccgatttattaattaacaaagagaagacttcttccttcctcgtcgtctccagcccattccaattcttgattccatcgccccaccatccacaactcccctaatccttccaacctcctcgtcgtccagtccaccacctccacgcgcaatggccagcggctaggcggcaccaaccagatcacaaggattcgtttcatccggcagcgcagctctagagcctccatgggcagctacgcgtacaagtactgtatgtgcttcacgcgcaagttccgatccccggacgcccagccgccgccggacgtccgcgccgcccacctctccttcgcctctgacgcccatgccctccgccgcttcgtcgccggcgtccagggcgagtcccccgccgacgtcgaccgcatcctcgccatgctctccgggggccacagccatggaatcgcccgcctcgtcacaaggtcgccggcggcatccacgcccacgctcgaagacttcttcgccttcctcttctcccccgacctcaacccacccatcgcgcaccaggttcaccaggacatgtcagcgccgttctctcactatttcgtgttcaccgggcataattcctacctcactgggaaccagctcaatagtgactccagtgacgtcccaattgtaaaggcgttgcagagaggtgttagagtcattgaactcgatatgtggcccaatccttcaaaggacaatgtcgatattcttcatggagggacattgactgccccagtggaaatgatcaaatgtttgaagtccatcaaagaatacgccttctgtgcctcaaattatcctcttgttattactcttgaggatcacctcacatcagatctccaagctaaagttgctacgatgctcactgaaacatttggagatcttcttttcgtccctaatccagacccgatgaaagagtttccttctccagcatctctaatgaagagaataatcatatcaaccaaacctccacaagaatataaggagtttctcaaagccgagaataatcgcagtggcagcggaaacatagctgagttgccagaccaaggaagcctgagaagaatagattcaaatgccgatgaatctgatgggaaggatgaactggatgagcaagacgaggaagactccgacgaggacgatcccaaatttcagcaggatacagcctgtgagtataggaaactcatcaccatccaagctggcaaaccaaaaggccatttgcgggatgcgctaaaagtggatccagacaaagtcaggcggctttctttgagcgagacacagttagctaaagcgacaatctctcatggtgctgaagtcataaggttcacacagaagaatatactccgtgtgtatccaaagggcacgagggttaattcttcaaactacgatccaatgaacgcctggacccatggtgcgcagatggttgcgttcaacatgcagggccatgataaagcgctccggttgatgcaagggtttttcagagccaatgggggctgtggttatgttaaaaagcctgacttcttgctaagaacaggtccaaatggggaagtatttgaccccaaggctagtttgccagtgaagaaaaccctcaaggtgaaagtttatatgggagacgggtggcgcatggacttcagtaaaactcatttcgatgccttttcgcctccagatttctatactagggtagggatcgcaggtgtgaaggcagacagtgtgatgaagaagacaagggtgattgaggaccagtgggtgccgatgtgggatgaggagttcacgttccttctgacggttccggagctggccctcctgagggtagaggtccaggagtacgacatgtcggagaagcacgacttcggggggcagacagtcttgccggtatgggagctgaagcagggcatccgtgctgtgcccctgcacgatcgcaagggtgtcaggtacaagtccgtcaggctcctcatgcgatttgattttgtgtagccgagccgagccgccattcagattcagcttcttcttttttttcccttcttgtgtgaattgaatgtattactcccttccttccatcttcaacgtatatgtgtatgtatgtacttatttttgtcggaataaaagttgtatggaatggaatggaaggaaggagtagaactgtcttcaaactccagcttctagatctgtacgggtgattcagttttacttgctggcacattgtttgtttgtttactttactggagatagatttgcacattaaaaaaaaaaaaaaaaaaaaaaaaaaaaaaaaaaaaaaaaaaaaaaaaaaaaaaaag

SEQ ID NO: 41 - DNA, 2525 bp, Zea mays
ccacgcgtccgggctccgtggcttttgcctgtcctgtggcagcgaatcggagagcggaggggaggggaaagcgcagcaacgccggcgagcgagcgggccgttcgaggatcgcaatgtgagcacgagcagggacacacaagatgcttcatcctagctgggtcggtgtctcggcacacgtctcggagtattggtctgtgataatcgccactgttgttttcgcatttgttggcgcggtgacaatttactatacagtcaatcagttgaacaagaacatcagcttgagcctgataagggctatcaaggccagggccaagaggtacaagaaatcgaaggacaaggtgcccgctgcatcccacatctggaggaaagaagttgtctcccgcagcaaaggcctgaaatgctgcgtgtgcttgaagtccgtttcacctcctcagtactctggggggaccatccatcagtgcgatatctgcggggccgctgcgcatccgagctgctcggggaatgcacacaaggattgcaagtgtgtatctatggctggtttgggccatgtgcttcaccagtgggctgtacaatggattgacagcgcggatcactctgaagaagactctttctgttgccactgtgatgaatcttgcaatggagctttccttgcaggctcaccagtttggtactgtatgtggtgtcagcgactggtgcatgttgattgtcacagcagcttggccaaggaaactggtgatatctgtgacttgggaccattgaaacgattgatattatcacctctttgtgttaaggagcttcattggacaggtgctgggattttgagttctatcacaaatggggctaatgaattggcttccagtgtccgagagacaattcggattcgtagtaaaaggtacaaaaggggtagcgcttctgctgattcagatagctctggggctattgagctaccatctgatgctgaaggagattcacaagaagtaaacagcaaagcaaaggtgagggatgatcatgccaattgcaaactcaatgaggtacaccaaagctctgaatcagagaaagataagcaacttgtaccagataacgcagcaacaaccaatatgtcagatgtacaacgtgaaaattctcatgtacagaacaatcagaagtacgaaattatcaatgtgccttctgattctaggccacttctagttttcattaacaagagaagtggggcacagagtggtgattcactgagacagcgtctgcaaattcttcttaatcctgtgcaggttttcgagttgagcaaacagcaaggtccagatgttggtttagctttatttcggaaggtaacccatttcagagttcttgtatgtggtggagatggcactgctggttgggttttggatgccattgagaaacagaagtttgaaaccccgcctcctgtagccatccttccagctggtactggtaatgatcttgcgagggttttatgttggggtggtggccttggtgttattgagaagcggggaggtctattctcagttttgcaagatgtagagcatgctgcagtcactgttcttgacagatggaagatcacaataaaggacaaccaagggaaacttatgagaccaccaaaatttatgaacaactactttggggttggctgtgatgcaaaggttgccttagatatacacaacctgagggaagagaaccctgaacggttttatagccagtttatgaacaaggtgctgtatgcaagagagggagcaaagaacataatggataacacatttgattgttttccttgggatgtcaagcttgagatagatggatccaaaattgatattcctcaggactccgaaggtatccttgttgccaatatcaggagttacatgggaggggttgacctttggaagaacgaggatgatgtctctgacacttacctccctcagtccatgcatgacaagaagctggaagttgttagcttcacaggaatgctgcatctcgggaaactgcaggttgggctttctcgtgcaaaaagattagcccaaggccatcatataaaggttgaagtcagtactacaatgccgatccaagttgatggagagccatggtcccaggagccgggaaccatagaggtttctcatcatagccaggccttcatgcttaagagagtctccgaagaaccgctgggtcatgccgcttcggtaatggccgacatcttggaaaacgctgagagcagtggcattatctcagccttgcagaagaggactttgctccaggagatagcgtctaggcttttgtaggacacagttctaacgccagtagttgtgtgtagctcaccctatagctctctcacgtcttcagcagccagaggcttgcttctgggctactagagaattgcgcctggtcgttgtacatacaccatcatggtattttaccctgattcggattgtgttgtgtatgattctgtaaaattttgtacaccctattgggtgagcacacactgacactgttgcggtcggaaaaaaaaaaaaaaaaaaaag

SEQ ID NO: 42 - DNA, 2025 bp, Zea mays
ccacgcgtccgctttgccgggggaaaagaaaacaaccgccccgcccccgcccccgcccctacgagcacgacggcctccggatgagggtcctgccgcgtcttttaccgtcagctggatgtcaaatcacaacgcgccctgtgacatccccaagccggcctccgtcgacgagttcctcgccaagaatggcaagaagaagaagtccttcatgtcgggcctcttccgcaagaaagggaggggcgcggacaagaagctgctctcgcggcgggacatcgtcttcgatttggaaggcagaagcggcgacaggatggacctcttggagacgtccgccgctgtccgcaagagcttctcagatcggcactgcacgacgcggatcgagaacctgacgctgagctgcctggattctcccaggagacccaatgtcgacacccgggagtaccgggtgtttgtaggcacatggaacgtgggagggaagcctcctgacagcagcgttaacctccaagagtttctgcagatcgaaggcttgcccgatatatatgtcttggggtttcaggagatcgtgcctctgaacgcgggcaacgtgctggtcgtggaggacaacgagccggcgggcaagtggatggacctcatctaccaggccctgaacaggccgccgccccaccaggacggccagtcctccggcgacgagctctcgccgccgccgtccacctcctcctcccactaccccagccggccgcaaggtgccgcccgcgaccccagcaacgccgccgccatccccaagacctccagcggcggcatgctctgcgcgcagaagccgccgccgccgctcaagatggtcagcaagtgctaccgcgtcgacaacgcgctggtgaagacgtgcacctgcatgtccgacccgtccaccatgcagctccgggcgcgtgagatgcgcgagttcctctgccgcgtcgaggccgccgccgcctcgccgggccgcggcgccgacgacgacgcgctggcctccatcgaaggcggcgaccagaggggcggcggcggcggcatgaactactgcctcgtcgcgaggaagcagatggtcgggatcttcctgtcagtgtgggtgcgccgggagctagtgcagtacgtcggccacctccgggtcgactgcatcggccggggcatcatgggccgcctcgggaacaagggatgcatcgccatgagcatgacgctgcaccacacgagcatctgcttcgtgtgctgccacctggcgtccggcgagaaggaaggcgacgaggtgcggaggaactccgacgtcgccgagatcctcaagaacgcgcagttcccgcgcatctgcaaggtgcccggccagcgcgtccccgagaagatcattgaccacgaccggatcatctggcttggggatttgaattaccgagtctcgttgagctacgaggaaactaagacgctcctggaggataatgagtgggacatcttattggagaaagatcagctcgcgatggagagacaagccgggagagtgttcaaagggtggaaggagggcaagatctacttcgcccctacatacaagtacaagcagaactccgactcgtatctatgggagaccgccaaatcgaagaagaaacgacgaacgcccgcatggtgtgaccggatactgtggcacggccaaggcatcgagcagctgcagtacatcaggggcgagttcaggctctccgaccacaggccggtctgcagcgtgttcgtgatcgaagccgatgtagatagcgggagcaagatcaggaagggctactcaacgctggacgctaggatccactgcgagtcccccgagatacccaagagacacagcttctacgatgacttctgaaattttggcccgtgatgctagttttgtctataacatagcagcttacaaagatcaggcacgtttgtagcgaaaaggctcaggtttctcaagcctaacacctgtcttaatttgtaccaagcggtatactaactgaaagtcaatggtggttactgcacagaaaaaaaaaaaaaaag

SEQ ID NO: 43 - DNA, 750 bp, Anabaena
atgaagccatttctttttgtcaccgatttggatcatactctggtaggtaatgatgcagccctggcagaactcagccagatactcactcaccatcgtcaagaatatggcacaaagatagtttatgccactgggcgatcgcctattctttacaaagaactgcaagtagaaaaaaacctgatagaacctgatgggttagttttgtctgtgggtacggaaatctatcttgatggtagtggtaatcctgattctgactggtcagaaattcttaacgatggctggaatcgagaactagtattgtccgtaactaaaaaatttcctgaattaatgctgcaaccagactcggaacaacgtccttttaaagtcagtttttttctgcatcaagaagcctcatttaaggtcataccacaacttgagacagagttagcgaaatgtaaactaaatataaagttaatttatagtagcggtatagaccttgacattgtaccattaaacagcgataaaggtcaggcaatgcagtttcttcgtcaaaagtggaaatttgcagcagaaagaacagttgtctgtggtgattcaggtaatgatattgctttgttcgctgtgggcaacgaaaggggaatcatcgtcgggaatgcccgaccggagttgcttcagtggcacagtgagtatcccgcagaccatcgctacctggcaaaaaacttttgtgcaggtggaattattgaaggtttacaattctttggtttcctcgaatga

SEQ ID NO: 44 - DNA, 1272 bp, Zea mays
atggataagctcagtggttctgcacgtcttatgattgtttcagatcttgaccatacaatggttgatcatcatgacgaggagaacctgtccttgcttaggtttggtgccctgtgggaatctgtttactgtgaggattctctactagtcttctcgactggaagatcaccaactctttacaaggaattaaggaaagagaagcctatgctaactccagacatcactatcatgtctgttggcactgagataacatatggggaggcaatggttcctgatgatggctgggaagaatatctgaacaataagtgggacaggaatattgttgtagcagaaactgtgagcttttctgagctgaagcttcagccagagacagaacagcgcccgcacaaggtcagcttttttgttgataagaagaatgcccaggaagtgataaaatctgttgccgagagattggacaaatgtgggctagatgccaaaataatatatagtggtggccaggaccttgatatattacctcaaggagctggaaagggccaagcacttgcatatttgcttgaaaagctaagctcatgtggaaaaccgcccaacaatactcttgtttgtggtgactctggtaatgatgcagaattattcagcatccctggtgtacatggtgtcatggtcagcaatgcccaagaggaactacttcagtggtacacagaaaatgcgaaggataacccaaagataattcattcaaatgagagatgtgcagctggtattatacaagctattggacacttcaagctaggacctaacatttctcctagagacctgcagtttccttatgcaaaggaagcctctttcaaacctacagatgctgtagtgaagttctacgttctctatgagaagtggcgcagggctgaggttccaaagtctgattcagttataaagtacttcaaaaacatcactcatgcaaatggagttaccatccatcctgctgggcttgaactctcactccatgcatccattgatgcgttgggatcatgttatggtgacaaacaagggagaaagtaccgagcatgggtggacagactttttatcacacagactggttcagatagttgggtggggaggtttgacttgtgggaatcagaaggtgatgtgcgtgtgtgttctctgtcaagtcttgctttgattctgaaggctgaatccccagagggctttgtgctaacccacatccaaaagacatggctgaacggatactcgtcaggggttgagcaggcgtttaagctgtag

SEQ ID NO: 45 - DNA, 1422 bp, Zea mays
atggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccctctttgaataacagcggaaaacttgacatcttattggctcagggcaaagagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaagtacccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaa

SEQ ID NO: 46 - DNA, 2415 bp, Glycine max
attcggctcgagtctgtatctatctatccttctcttaaaaccgcagtgtctgagacgagcgagccactatgacccgccgcgacttcgatctccggcaatctaactaaaacggcggcgtatagcgggatctgcgagcatggagggtgagaacgcgagcaaggtgatcgaattggtgaacgagatagccagcatctccgagtacaggcctccggtgaagaagcagtactgcaacttggcgcggaggctgaagcttctgatcccgatgttcgaggagattagggacatgaacaaagacgcgcttcccgaggacacttccaacgccgtcctcgccttcaaggaagctctccaatccgctagggaactcctcagattcggaagcgaaggcagcaagctttacttggtccttgagcgggacgatattatgaataagttctacgaggtgacagctcagttggaacagtcattgggtggtatttcccatgataaacttgatatatcagatgaagttaaagagcaggttgagttggttcttgcccagttcagaagagctaaagggagggttgatgaaccagatgtcaggttgtatgaggatatgttgtctgtttacaacagcagcagtgatgcagctacagatccatctgttctaagtcaattagctgaaaaattgcaattgatgggaatagctgatcttactcaagaatcacttgctttgcatgagatggtggcatcaagtggtggggatccaggagcacgcattgagaaaatgtcaatgttattgaagaagataaaggatttcgtgcaaatagaaaatctagtcaaggatgataatttaggaggaaaaggcattttctcaaaagtctatggacttgggacaaatgaaaagagtcatcaggctcctgttatccctgatgattttcgatgtccgatttccctggaattaatgaaggaccctgtcattgtttcaacaggacagacttatgagcgtacttgtattgagaagtggttgcaagcagggcacgggacctgccccaaaacacagcagactctcactagtactgttctcacacctaactatgtattacggagcctcatagcacaatggtgtgaagccaatggcatagagccaccaaaacgacctagcgattcacaacctagtaaatcagcatcagcctactctcctgctgagcaaagtaagattgaaagtcttctccaaaagctcacatctgtgagtcctgaagaccagagatcagctgctggcgagatccgccttcttgcaaagcgcaacgcagataaccgcgttgccattgctgaagctggtgcaatacctctccttgttggtcttttgtctgtgcctgactcccgcactcaagaacatgccgtgacagcgctcctgaatctttccatatatgaaaacaacaaaggaagtattgtttcttcaggagcagttccaggtatagttcatgtgctgaagaagggaagcatggaggctcgggaaaatgcagcagcaacacttttcagcctttcagtaatagatgaaaacaaggttacaattggatctttaggagccataccaccactagtgacactgctaagtgagggtaaccaaaggggtaagaaagatgctgcaacagcactcttcaatttgtgcatttatcagggcaacaagggaaaggcagtgagggctggcgttattcccacgctgatgcgactactgactgaacctagcgggggaatggtggatgaagcattagctattttggcaatattggctagccatcctgaagggaaggctactattagagcttcagaggcagtgccggttttagtagagtttattgggaatggctcaccaaggaacaaagagaatgcagctgccgttttagttcacctctgttctggagatcaacaatatcttgcacaggcacaagagctgggggtgatgggtccactgttagaattggctcaaaatggtacagacagaggcaaaagaaaggctggacaattgctagaacgtatgagcaggttagttgagcaacagcaggaagttccaatacaaactgaaactcaagctcagaacgaggatacccaaccacctttgattactaaccccgatgattcctaagatgtcttattatactttgttcattttgtctttttgttctctttaaagtgttgaaagaagcatctgtttggaggaaagggtggaagatcaccttcctactccataagttatttgtttgtttgtgtgatattcagcagagatgtaatgcaaaaaacttgtgaaagtgggcaagaagaaatcgaagcaaatgggcaagcttgaagtggaaaatgtataatttgtaacatgcactgtattctaatcatcctcagattttaatgaagagatgttttgtttaaaaaaaaaaaaaaagg

SEQ ID NO: 47 - DNA, 1569 bp, Glycine max
gcaaaaagaaagaaagaaacaaagatcgttcattgctttgtagtaagatcagatcatcaaaaatggttttgtcttggtcaagaaggaacgttttccgccgtgccaagaaggagaagtcacaaactcaattggaagtggaggttgtgattcccaaccactttcactgcccggtgagtctggagctgatgacagacccagtgactttatcaaccggcatcacctacgaccgtgtgagcattgagaagtggatcgagggagggaacagaacctgccccgtcaccaaccaggtgctgacaaccttcgacatcatccccaaccacgccattcgcaggatgattcaggattggtgtgtcgaaaatagttcttatgggattgatagaatccccacacctcgtattcctatctcggcatacgaggtttccgacacgtgtaccaggatcttgtcggcttgccagcgtggagatgacaagaggtgtcaggagttggtcgggaagattaaggtttggagtagagagagtgagaggaacaagaggtgcatagttggtgctggtgctggtgctgttcttgcatatgcctttgattgtttctcaagtaactctattgaaaaacatgtggtgcttttggaggaggttttggaggtgatgacatggatggtcccacttggggaagagggtgtttctaaattgagttcaggagcttctttgaattcgttggtatggtttctagaggggaaagaccttgcatcaaggcaaagtgctgctttgttgcttaaagaagtgtgtgttcaagaattggccaaggttggagaagttgttgaagctttggttaagatggttagggagcctattgggagcacttccaccaaggcttgtttggcaacaatttttaacttggtgtcgttggctgcgaatagagagggaattgctcaaagatttgtggagttgggtttggtttcacttttgctagaggctattgttgatggagagaaaggggtgtgtgagaaggcacttggggtgttggattgcatttgtgattgcgagaaggggaaggaggttgtgaagagcaatgctctagccttgcctcttgttgttaggaagcttttgagggtgtcaccattggcttcaggttttgctgtgtctattcttaggaagatttgtgacaagagggaggaagggattctgattgaggcacttcaagttgggctttttcagaagctcttggttctgctgcaggttgggtgtgatgagagccccaaggagaatgctaccgggttgttgaaactgttgaatggttacaggaacaaagcggagtgcactgactcatcattgaatttcgagcatcttaagaagccattttaattagtgatgaatggcaactagattcatttattctttttttttttttgtgtaggtcaatttattgatacagaattctttgctgtaaaaagatacacacatcaattgattctttgaattcattctttggaaaattgattcgaagtaattagttagatataataatcatggttgtggcaaatacaaaaaaaaaaaaaaaaaaaaaaaaaaaaaa

SEQ ID NO: 48 - DNA, 2363 bp, Glycine max
ctaattaattattagtttcacttcaatgactcaaagggatcgtcgcaccctatcattcccggcggttcacccatgcgaagccatttctccgccgacacttgtcacctctctaatcactctctcccaatccatatgcaatttccaaccccaatcattccccacccaacgaaggaacgccagggaaacaatacgccaaataagcattgtcttaatgttccttcaagaaattcgactaatccccaactccactatcctctctttggcggaactccacttcaccttacaaaaaatccactttttattgcaagattgcaccctccaaggctcgcgcctcctcctgctcgccaaatcgcaacacgtagcgtccctgttccccgccctccttcgctccgtggccacctctctggacgtcttgcctcttcaccagctccacttgtgccccgaagtcagggagctggccgaccttgttaccaagcaagccagcaaggccaagttccagctggaccccagcgacgcacgtgccaccaaaaccctccacacgcttctgcgccagttctccatgggcaccgaacctgacctcacttccatgcagggaatcctccactacctccaaattagaacctggacagattgcaatacggagattaaattcttagaagaagaaatcaccttagagtgccgcgaccgtgaagaaaaagaggttcccttacttagtagcttggtagggttcttatgttactgcagaggagttattttcgaaactaatcaatcccaaggaagatgcagcacggagatgacatcgttaaacttaaccctgttgacgtccgttaatccagatgatttccgttgccctatttctctcgagttgatgacggatccggtcactgtgtcaacaggtcaaacctacgaccgagcctctattcagaaatggctcaaagccgggaacacaaatgtcccaaaaacaggggaaaaactaacaaacacggacttagttcccaacacaacgctcaagagactcatccaacagttctgcgccgacaacggcatttccgtcgctaactcctgtaaccgtaaaaccaacaccgtctcagcaggtagtcccgcggcggcacacgcgattcagttcctcgcgtggttcctcacgcgcaggctagcattcggaacccaagaccagaagcacaaagccgcgcaggagattcgctttctcgccagaaccagcattttcaatagggcgtgtttgattgaaatgggaacagtgcctcctctgattgaacttttagcctctgcatcgaacgataataaatccacgcaagagactacaatctctgctctactgaagctctctaaacacccgaatggacccaaaaacatcatcaacagcgggggcctaaccgtaattctctcggtgttaaaaaatggacttagccttgaagctcgtcaagtcgcggctgctacaatattttatctttcttcggtgaaagaatttcgcaagttaataggggaaaaccctgatgtcattccggctttggtggagttagttaaagaaggaacaacctgtgggagaaagaatgctgtggttgctattttcggattacttttgcttcctaggaatcatcaaagggttatcgctgctggtgctgttccggcgcttcttgacattatagcttcttcgaataaggacgagcttgtgactgaatctttggcggttcttgccgcgctggcggagaacgttgatggggcgcgtgagatactgcaaggttcggcgttgcggttgattgtagggatgctgcgatctgccacgtcacgcgaggggaaagagcactctgcttcgattttgttgtcgctttgcgtcaatgttggagcggaggttgtggcggttctcgctaaggagccttcgttgatgcctttgctttattcgcttctcacggatggaacttgtcatgctgcaaagaaagcgcggtttctcatcaaggtcatacaggattttcacgagactagaagtgctggactcaagggttcctcgcttccgcaggaacgctcgcttcacgtttggtgattgttgatcaatcatgactaagaatttggaatctcttccctttctgtgaatatgccaaaccttatttatttttgtgtaaatactaaatactaaatactgtaacacatgacattagttttttttttttgtcacgttttagatttgtgaaattagctctgtgcttgtttttatcgccggctagctaatttcaataagtgaggcttttatttagctcacactccgaagtggaatttttcgtttatctctgtctggctatgaattgaattgttgtgtgaaaaaaaaaaaaaaaaaaaaaaaaaaaaaaaaa

SEQ ID NO: 49 - DNA, 2081 bp, Zea mays
gaattcccgggtcgacccacgcgtccgatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtgtcgaagaagtcggggcttctcttcgagcggcggctcatcgagcgctacattgaggaccatggcaagtgccccatcaccaaggatgagcttactatggatgatatcgtgccggtcaataccaacaaggtcgtgaagcccaggcctttgcaggctgcaagcattccaggactccttgggatttttcagaacgagtgggatgctctcatgctttctaattttgctttggagcagcagctacacacagcaagacaagaacttagtcatgcactctaccagcatgacgctgcctgccgtgttatagccaggttgaagaaggaaagagatgaggctagagcacttttggctcaagctgagagacagattccagcatcagttgcaggagctgctcctgcagctgttgtttccaatggaaaaagagcaatggaagatgaaattggccctgacggaaagaagattcgtcctggtatcaaccctgtcatgattgatgaacttacagagtgtaataccatgctttcagcacagcgtaagaaaagacaggttcctccaactctggcaccattagatgcactcgagagatacactcaaatctccagccatccccttcataagacaaacaaaccaggcattttgtccatggatgttcatccttcaaaggatgttgttgcaactgggggtatcgatacaaatgcagtaatctttgatcggtcatctggtcaaatcttgtgcacgcttactggtcactcaaagaagataaccactttaaagtttgttccacgggatcaactctttgtaactggatcagcagataagactgttcgcatttggcaagagaacgagaatggaaactataactgcgtccatacattgaaagatcatactgctgaggttgaagctgttacagtacatgcgactcagaagtattttgtgagtgcttccaaggataattcgtggtgcttctatgatatttcaacaggatcttgcctgacacaggttggcgaggcttcaggacaagagggatatacatccgcgtctttccatccagatggtcttatccttggaacaggaactactgatgctgttgttaaaatttgggatgtgaagactcagtcgaatgtcgcgaagtttgaggggcatgtaggaccagtcactgctatgtccttctctgaaaatggttacttcctagcgactgctgctcatgatggtgtcaagctttgggatcttcggaaattaagaaattttaggaccttctctccctatgattcagatacgccaacaaatactgtggaatttgattttagtggaaactatcttgccattggtggttcagatataagggtctaccaagtagctaatgttaaggccgaatggaatctcatcaagacattaccagatttatctggaacagggaaagtaacttcggtaaagttcggagcagatgctaagtacatagccgtaggttctatggaccgcaatctacggatatttggcctccctggagacgaccaaatggaggaatcaaccacagcggcagagtgaggaaaatccatggtacctaatttcctcctcctggtatactccgcaatatgttctgatgatgggtagactgagtgcaaatggatacatcacgagagaagggtcctcgcggcgatgaactggcttgagcttcggtcggtgtaaacaagctgtgacattattgtattgtaggcctcactaattcgtctgatggggatacaatttgttttgatgagtacgagtgtacgacgctaaacagccaaagttctatgcataaaaaaaaaaaaaaaaaaaaaaaaaaaaaaaaaaaaaaaaaaagggcggccgc

SEQ ID NO: 50 - DNA, 1398 bp, Zea mays
gtcgacccacgcgtccgcccacgcgtccgcccacgcgtccgtcgcattccacccgcccccttttcgcgtgaacgcgccggcgccgcggatcctgccgtcacgaatggaggcgtggccggacgatttccgctgccccatcacgctggaggtcatgacggacccggtcatcctcccctccggccacaccttcgagcgccgcagcatccagagctggctcgacggggggcacctcacctgccccgtcaccaacctcccgctgccgccctccccgccgctcatccccaaccacgcgctgcgccgcctcatagccgccgtctcgccttccgcggcggcgtctctcgtccctgcggagggaggggcgcacgcgaggcaagaagcggtgtcggcggcggcggcggcggcggtgccagcccggcccgcgtcgcccgtgccggcgctgctgaggctggccaagtccggcgccgcagggcggaaggaggtgctggagtccggcagcgcggcggtgctgctgcggcacgcggaggccggggacgaggcggcggccagggcgctgctgcacctcagcctggacggcgacgacacgcgcgtgggcctcgtggcggacggcgccgtggacgcgctgtccgccgcggtgtcccgcggcggcgcggcggcggcgtccgcggccacggcgctgaccagcctcgccaccgtggacgtgaacaagtgcaccatcggggcgcacccctcggccatcccggcgctggcggggctcctccgccgcggcgggccgcgggagcgccgcgaggccgccacggcgctctacgagctctgcaagctgccggagaaccggcgccgcgcggtgcgcgagggcgcggcgcccgcgctcgccgacttcgccgccgccggctccgcgcgcgccgtcgaggtgctcggcctccttgcccggtgccgggaggggcggcaggagctgtgcagggtccccggcgtcgtgtccgtgctcacgggcgccgccgggagcggcaacgcgcgcgcaatcgagcaggccctgctcgtcctcaactggatttgctccgagagcaacgagttggcggtggaagcaatcaagctgcaggctttcgacctctgcgaggctctggtgaacgacgacaactgcaagatcgccaagaacgcggtcgacttggcccggacgctcgagaaagcgtagaattggattgggctgtctcccccaaaacatgagatgagattcgccatgggttttgattcaacacctgctcgattggtcgggtgttggcctcattgtacagaggtagcaacagcaaaggtgaaccttttatctttcttctcttactccgtttcatttccaagttgtagctgcgccgaaaggaggacaaaaaaaaaaaaaaaaagggcggccgc

SEQ ID NO: 51 - DNA, 1823 bp, Saccharomyces cerevisiae
tataaattaattatgttttatttgtttgcgcgattgctttcttgcctgtttttccgcaacatagttacagctaaacatttgcccaaaaccatcttcttatatatatatctgcgatggcgagcccagcggaagggatgtccgcttactaattccgacacaccggtttaaccccccggcgtgctggggtgggtgcccctaagggagcgggttctgtacttccagtaagcggcatttgcgctgtcatcgccttatcgaacccgctactgagatcatgtcctgagtgggtgagtcgcacgcccaatcggctgcacttcagagatacttacgtccaatttcgcatcatgccaatattacctgtggaagttgaaactttttttgcagatgccgataattttcacatggatgagtcgcagtgtcgtcgtacgtgatgagggcaggcttgaaaattattcttcgagcccaattctctttacttataggcatgccatgtctaattaggtagtcatctcagtttatcttgtgcagggtagaaccaaagataacagcaaaagaaagagcaagcaattatgaccgcaccattggtagtattgggtaacccacttttagatttccaagccgacgtcacggctgaatacctggccaagtattctctaaaggaaaacgacgcaattttggtcgatgccaaatcaggcgatgctaagatggctatttttgacgagctcttacagatgccagaaacaaagcttgttgcaggtggtgctgctcaaaacactgctagaggggcagcatacgttttgggcgccggccaggtggtgtacttcggttccgtcggtaaggacaagttcagcgagagattgcttaacgaaaacgaaaaagctggtgtcaagtctatgtaccaagttcaaaatgatattggtaccggtaagtgtgccgcattaatcactggccataaccggtccttggtcactgacttgggtgctgccaatttctttactccagaccacttggacaagcattgggacttggtcgaagcagctaagctcttctacatcggtggtttccacttgaccgtgtctccagacgctatcgttaagttgggccaacatgctaaagagaacagcaaacctttcgtgttgaactttagtgctcctttcattcctcatgtcttcaaagacgcattggccagagttttgccttatgctaccgtcatcatcgctaacgaatcggaggccgaagccttttgcgacgccttccaattagactgtgccaacactgatttggaagctattgctcaaagaattgtcaaggactctccagttgaaaagactgtcatcttcacccacggtgtcgaaccaacagtggtcgtgtcctccaagggtaccagcacatatccagtcaaacctttggactcttctaagatcgtcgacaccaacggtgctggtgacgccttcgctggtggctttatggctgggttgactaaaggtgaagatttggaaacctctattgacatgggtcaatggctagctgctttgtctattcaagaagttggtccctcttacccttccgaaaaaatatcttactctaaatagattcttcttacaatataatagaaataaaatatactctacgtgttccctctagcttttcattcgtagacatgtttaccgcttgttcttaaaccaaataagccaccgttaccacaataaggaaaagaggcgctataaagtacagcttcaagaaaaaaggacaagcagcgctaagaacaaaatactcgttcatcctctccacatacggccgtacacaagcaacaataacacaataat

SEQ ID NO: 52 - DNA, 1531 bp, Zea mays
ccaaaggaggcggccggccgtgcccacatgtcacggaaatcatgtagcatcaccgtgcgtacgtccaccaaccaccgtcgaacacgaggagggtgacaggtgggccatccgaggtttgggcgagccaaacaaaaaccctcttcacaccggtcaccacttcatctcgcccacacgaactcgagacctcgcccgcccaaatacgaaagcctcagatctcagtgaccagcgccgccgcttcgttcgtgtcgaggggagaagaggaaatggcggcgagcgagggcgtgctcctggggatgggcaaccccctcctcgacatctccgccgttgtcgatgacgccttcctagcaaagtatgacatcaagctgaacaatgccattctcgctgaggagaagcacttgcctatgtatgatgagttggctagcaacagcaatgttgaatatattgctggaggagccacccagaactctatcagggttgcccaatggatgcttcaaactcctggtgcaacaagttacatgggatgcattgggaaggacaagtttggtgaggagatgaagaaaaatgctcaagctgcaggagttactgctcattactatgaggatgagactgctcctactggcacatgtgctgtatgtgttgttggtggtgaaaggtcattgattgcaaatctgtcggcggcaaactgttacaaatctgagcatctcaagagaccagagaactgggcactagttgagaaggcaaaatacatctacattgctggatttttccttacggtgtcacctgattctatccagttagttgctgagcatgctgcaacaaataacaaggtgttcctcatgaacctctctgctcccttcatctgtgagtttttctgtgatgcccaagagaaggtcctcccgtatgctgacttcatcttcggcaatgaaaccgaggcaaaaatcttcgccaaagttcgaggatgggagacagagaatgtcgaggagattgctttgaagatctctcagcttcctttggcttcaggcaagcaaaagaggactgctgtgattactcaaggcgctgatccagtggttgttgctgaggatgggaaggtgaaaacgttccctgtgatcctattgcccaaggagaagcttgttgacaccaacggcgcaggtgacgctttcgtcggaggctttctctctcggctggtccagggcaagagcatcgaggactgcgtgacggctggttgctacgccgccaatgttatcatccagcgcccaggttgtacctacccagagaagcctgacttcaactagtgcaatactcaggcacgttacgagcggttcggcgtgtacactcccctgtatcctttccggtccggccaattttttgtcgccgtgatatttgttcagcaactatggacgacgtcgcctctgttctgtacgaggcatggtttgccatcattattctgttagcttcggcgatgcttgcaatgcgacgagaatgcgttggaaccatatatgcaatgcaaagttagcaaaaaaaaaaaaaaaaa

SEQ ID NO: 53 - DNA, 1358 bp, Glycine max
attcggctcgagctcattctcattcgttcactgtcactttacccaatcctaacactttcttctctctgttttccttcttcctcgcatcaatggagttggacggcgttctcctcggcatgtgcaaccctctcctcgacatctctgccgtcgtcgacgacgctttcttgcaaaaatacggtatcaagttgaacgatgcgattctcgccgaggataaacacaaacctatgtatgaagaattggctaacaatcctaatgtggagtacattgctggaggtgctactcagaattcaatcagggttgctcagtggatgcttcaagcaccaggtgccacaagttatataggttgcataggaaaggacaaatttggagaggagatgaagaagaaatgtacactagatggtgtaaaggttaactattatgaaatcgacaatacacctacaggaacttgtgctgtttgtgtggttggtggtgaaaggtcccttgttgccaacttatcagctgcaaattgctacaagtctgagcatttgacgagaccggaaaattgggcattagttgaaaaggccaagtattactacatttctggctttttcctcactgtatctcctgattccatacaattggttgctgaacatgcagctgcaaataacaagatcttcatgatgaacctttctgctccctttatatgtgagttctttaagggtgcactggacaaagttctgccatatatggattatgtttttggaaatgaaactgaagcaagaacattttctaaagctcaaggctgggagactgataatgttgaagaaatagctttaaagatttctcaattgccaaaagcatcagaaaaacataaaaggattactgttatcacccaaggtgcagatcctgtttgtgtcgctgaggatggaaaagtaaaattgtatcctgtgatactattacctaaagagaaattaattgatacaaatggagcaggagatgcttttgtgggaggatttctttcgcaattggttaagcagaagcccattgaagaatgtgtgagagctgggtgttatgcagccaatgttatcatccaaaggcctggctgcacatacccagagaagcctgattttcattaagtgatttctccttttctgttactgctatgaattattattattattttttatcattgagaagaattttaacagccacactctaactggtgtggggttttttaatcccccgtctagggaaaacaacgtgaaaaagttgcaggaaaagagataaaacttgaataagttcatatatttgaagtccgatcaggcatcaattctcaaaaaaaaaaaaaaaaaaaaaaaaaaaaaaaaaaaaaaaaaagt

SEQ ID NO: 54 - DNA, 1101 bp, Synechocystis PCC6803
tccggtaaattaatctaaccattgtcagtcaagccattctgccctaggataacattcgttataaagtggaatccgtgaggttgcaatgggtcacaaatacgatgtctatggcatgggaaatgccctggtggatatggaatttgaggttaccccagagcagttggccagcctaggcattgataaaggggtgatgaccttggtggaagaggccagggaaaatgaattaattgcccaattggcccaacagcgtggcaagcaaagcagtggcggatcagcggccaatactctggtgtccctggcccaactggggggtacgggtttttatgcctgcaaagtgggtaaggatgaagcgggagccttttacctccaggatttgaacgattgcggcctcgataccaatccccaccatgaaaccgctggcgaaggcattacgggcaaatgcttagtgtttgtcacccccgatgctgaccgcaccatgaatgcttttttgggcattagtggcagtttgtccgtaaccgaaatggattggtctgctttaaaacagtcccaatacctttacctggaaggctatctggtcacttcccccagtgccaaagcggcctgcattgaagccaaggcgatcgccgaacaatccggggtgaaaacctgtctatccctatccgatcccaacatggccaaattttttcaagacggtttaaaggaaatgctggggtcaggggtagatctactattcgccaatgaagcggaagccctggaaatggccggtacttcagacctcaaccaggcgatcgcctactgtaaaagtattgccaaaaactttgccctgaccaggggcggagcaggctcactaatttttgatggtgagaatttattgaccattggcacccccaaagtccaacccatcgatacggtgggagcgggggatatgtacgctgggggatttttatatggcctaacccatggcatggactatgaaaaagctgggcaattggcttcggaaacagccgccaaagtagttacctgttatggtccccgcctagacacagaaattctgcaagagattttacagtctgttcaagcagtttagaacaaaaagctact

SEQ ID NO: 55 - DNA, 1832 bp, Zea mays
attcggctcgagcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgccttgactggggcgaggcgggcggccccgacctcatcgtcgacgacggcggcgacgccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcagccagcacacggcttgcagctcactcgggccgttgtgtgctatgaagttcgctacactggcctgtcagttatcttttgcatgcatatgcattatcatatacgcagtcgcgtagcaggtttccttatggttatcgcttgagctgagggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctcaaaaaaaaaaaaaaaagg

SEQ ID NO: 56 - DNA, 2001 bp, Saccharomyces cerevisiae
aagccgtattttagattttccaatctcttatttagtaacgtggtttattaactccatgattccattcctatttgtttttctttctttctgaaaatcctcttctcctcgaaataacccaactgacaaaaagaacaattcccaatgtctgctccagctcaaaactacaaaatcgctgatatctctttggctgccttcggtagaaaggaaatcgaattggctgaacatgaaatgccaggtttgatggccatcagaaaggcttacggtgacgtccaacctttgaaaggcgcccgtattgctggttgtttgcacatgaccattcaaactgctgttttaattgaaactttagttgctttgggtgccgaagttacctggtcctcttgtaacatctattcgactcaagatcatgccgccgctgctattgccgcttccggtgttccagtttttgcctggaagggtgaaactgaagaagagtatttgtggtgtattgaacaacaattgtttgccttcaaggacaacaagaaattgaacttgatcttagatgatggtggtgatttaaccactttagttcatgaaaagcaccctgaaatgctggaagactgctttggtctttccgaagaaactaccaccggtgttcaccacttatacagaatggtcaaagaaggcaagttaaaggttcctgccattaacgttaacgactccgtcactaagtccaagtttgacaacttgtacggctgtagagaatccttagtcgacggtattaagagagccactgatgtcatgttggctggtaaggttgccgttgttgctggttacggtgatgtcggtaagggttgtgctgctgccttaagaggaatgggtgctcgtgtcttggttaccgaaattgacccaatcaacgctttacaagctgccatggaaggctaccaagttgttaccatggaagatgcatcccacattggtcaagttttcgttaccaccactggttgtagagatattatcaacggtgaacatttcatcaacatgccagaagatgccattgtttgtaacattggccatttcgatatcgaaattgatgtcgcctggttaaaggctaacgctaaagaatgtattaacatcaaaccacaagtcgaccgttacttgttgtcttctggtagacacgtcatcttgttggctaacggtagattagttaacttgggttgtgctactggtcactcatctttcgttatgtcttgttccttctctaaccaagtcttagctcaaattgctttgttcaagtctaacgataagtctttcagagaaaagcacattgaattccaaaagacaggcccattcgaagttggtgtccacgttttgccaaagatcttggatgaagctgtcgctaagttccacttgggcaacttgggtgttagattgactaaattgagtaaagtccaatctgaatacttgggtattccagaagaaggtccattcaaggccgaccactacagatattgatcaattcaattcccatttcagttcttctttctcactattttttaatgttcaaaaactcaacggtttgatcatcaaaaaagatcataaataaattgcaaatataaaaacaacagctaacaatcctatcacagtattaatactaatacatgtgatactaagttacgttatcgaaaagatagatcctgtatacctatatatataataaattcttcaacagtaaatatttcattcatgcacttgactttttttcataaataagggcacgtacactaaaaaagctacatttctctcagataatgagtagggcatgcatatccctgtggattcttatctaaatataactggtggtattcttcagcatcgtaaaagttcttgattggttcaataactgtggcaatcttattaccccattttggttgccattcttcctttattttggctaattcttttaaatcagcatctgaatgagcgaacaatccactgcgatactgtgtacctttatcaggtcct

SEQ ID NO: 57 - DNA, 2001 bp, Synechocystis PCC6803
ttccagtgatgacaatgagtgcatttcaacttttctccgagaggcgaattataactcccattatcacatttccaaatagtgccccaaggagttgcttgaaaagtcccctggccccaagcctagggggataggtttaaagttctgcagggttgccagagctttggtaggaaaatttaggatcagattagagctttgcctacctgcgctaaccgtctgtcaatggacaaaggggcgatcgccattccagaccgataaaatgttaagttatatcacattcaagcaaagttcttaggaattaccccgtatggtagcaacgcccgttaaacagaaatacgatattaaagatattagcctcgctccccaaggtcgtcagcgcatcgaatgggcggcccgggaaatgcccgtgttaaaacaaatccgggaacgctttgcccaggaaaaacccttcgccggtatccgcttggtggcctgctgtcacgttaccaccgaaaccgctaacttggcgatcgccttgcatgctggtggcgctgattctttgctcattgccagtaaccccctgtccacccaagacgacgtggccgcctgtttggtagccgactacggcattcccgtttacgccatcaaaggggaggataatgaaacctatcaccgccatgtgcagattgcgctggatcaccgccccaacatcatcattgacgacggtagcgacgtggtagccaccctggtacaggaacggcaacaccaactcagtgacatcattggcaccaccgaagaaaccaccactggtattgtgcgtctgcgggccatgttcaacgatggggtactcaccttccccgccatgaacgttaacgatgcggacaccaagcatttttatgacaaccgctatggcaccggccaatccaccctggacggtatcatccgggccaccaatattctcctggccggtaaaaccattgtggtggctggctatggctggtgtggtaaaggagtcgccatgcgggccaaaggcatgggggctgacgtaattgtcaccgaaattagtcccgtaccggcgattgaagccgccatggatggtttccgggtcatgcccatggccgaagctgcccaccagggagacatcttcatcaccgtcaccggcaacaaacacgttattcgtcctgagcattttgccgttatgaaagatggggcgattgtttgtaactccggtcacttcgacattgaaattgacctcaaatccctcaaggaacaagccaaggaagttaaggaagttcggaacttcaccgagcaatacattctccccaatggcaagtccattattgtgattggcgaaggtcgtttagttaacctggccgccgccgaaggtcatcccagtgcggtgatggatatgagctttgccaaccaggccctagcctgtgagcatttggtcaaaaataaaggtcaactagaacctggcatgcactccattccggtggaagtggaccaagaaattgcccgcttgaaactccaagccatgggcattgccattgacagcttgacccccgaacaggtggaatacatcaattcctgggcttccggtacctaaaaccgtttacggattcattttttacctaaaaccccttcaatctcccatatttcgggggatttttttatttttaggcaggccatagacgcaatgcccataattccccaggctaagttttcaatcccccaatgttaggatttgcggatatcctctagtgggggatggtgatcggctgggcctccaaactaaccagaaattacccgacgcaggtccatcacatcactcatatttttaattttggccatgatgcccaatagctgttgatagtcgtgaatatcaattttgagactaataatggcgggtcgtcccaaatgggttttaacatcggcgttgcggacgttaatgtggttgtcgctgaggcgagaaagaatatccttcagcacccctacccggtcaatggcttcaatgacaatgtccac

SEQ ID NO: 58 - DNA, 1742 bp, Glycine max
ataaatgggttttggaggaaggaagagatccttgtgttgtgggttgaggtgagaagggaagggatgtggagttcaacttcaagcacagcagcgattccctccgacgaggaacctagcgaatcctcctcctcgtcctccttctccacctctctcttcaatttctcttctggaaacccgagaatcgaggagacccgtggcctcatgcatctcttcccagacgacactccttctactctacccgttggacggaagcctctcgtttgcgttgtcggcgtcccaaatcacatgacctatgcggatttctgccagttctgtggttccttcattcagcacatgctagagatgcgcatagtcaggatggatgggatggaggatcagtacagtgttttagttcgctttgacgatcaagactccaccgacagcttctacaagcactacaatggccgccgtttctcttctctcgaggttgaggtttgccgtgttcttttcacattagacgtgcagtacactggctccattgaacatgcacaaccctccaatgctacttcaactgaactgcctacttgtcctgtttgccttgagcgattagatcaggacaccggtggaattcttacaactatatgcaaccattctttccattgttcctgtatttctaaatgggcagattcttcttgtcctgtatgccgctattgccagcagcaagctgaaaaatctatatgttttgtttgtcaaaccactgagaacctatggatatgtgttatatgtgggtatgttggctgtggaagatacaagggagggcatgctataatacactggaaagagacacagcattgctattccctagaagtggaaacaaaacgagtttgggattatgtgggagacaactatgttcatagacttattcagtccaaaactgatgggaagttgattgagctgaacactcagtgtgcgcatgcagacaatggatgtggaagttgcagctgtgaagataatgccatgaatgaggctatacttaatagtaaagttgaagctattgtcaatgagtacaatgaattgcttgctactcaacttgaaaaccaaaaattatattttgaatccttgttacaagaagtaaaagaagaatctgagagaaaaatttccaaagctgttcagaaggctatcagtcttaaacagcagaagattcagtccaagattgacagatgtaagaaagagaagaaatttctggatgatcttaatgagaatcttgtgaaaaatgaggacatttggaaaactaagatacttgcgattgaagagagggagaaaaaaaccacgagactgatgggtgatagagtagcggacctggaaatgcagcttggtgatctcatggtttgtcttgagggtgggaggacggtagaacagctggcagcttcagatgagattaaagaagggattatcttggacaaatcaatagaatcctcgacaactagtggctctgacctggtgggaagagacgcataacagaagaatggttccttttaatgacagaagaatgattccttttaatggactacattgcacggactgacctataccatgtttataatcacagatttatagaaactacactcgtggatccacagttgacatgttttcactctaattttttcccatataaaactcccagtgtatgtatctgtttagatttgtaaataaaaagatttccaactaccagtataaattcttaatatttataaaaaaaaaaa

SEQ ID NO: 59 - DNA, 4337 bp, Emericella nidulans
ctcgaggttctccgcctagctggtgggttgaaccgcttactcagtgtcgaaaggataaatgagatcaatttctcccgtgaagccattcagcaaggtatccatgcggctctcgtggaacacaatgctaacgccctcaccaccctccttaagctcgacgagtttaccttccgttgccagaacaaccttgtagatgccgtgtataccctaccaccagagcatttccgcaccgctgtccgtgtggcacgacacgactctagcttcttccagcttctgctgcgtgcgagtgctgagtctgttccctacgacgattcggagatcacgcactgggcagttactacgggtggtccttttgaacaatggctactggatttcatgctgcagctgccggagcaaatcagggcgacaaccaagggaagtcaacaaatgttctatcatgggggcttgaatacagcaagtgccatgacagaaaggtatcttcgagatattctgggaacggatgagcttaaggtctggctagaagagtcgtcgtacgattttcccagcgaatggattgttgagagttgatgttgaagatattgaacaaatttctgtggtgatgagcgctggaagaatcagtgtacaacgaaaggagcagacaagactcccttgctatactcaggtgtgacacctgcaaatccagtaggaaaatacggtaattaatcccagggtcttttccctccgccaggcaccacgccccttgccggaaacgtcggccagtcgcgttcagcaccaggtacattccaatcaacaatgcaagaatgtgaaacgcgaagtatatatcagcgaacaacatcaagccgacataatcaaacggtttcagtctctatcgcgttttgcacttgagcgtcattttgattcctccgggatccagccatgtacctctccacggtcctcttcccactactggctctgaaccttggtctctcacacgcgagattcgtccgtgaaactctcgagctgacatgggaatacggatcacccaacggcggtacgccgcgcgagatggtcttcacgaatggggagtatccaggtccggatctgatatttgatgaagatgatgatgtcgaggtacaaccaagttttcaccgtatgtacatccgacaacagagttgacaatcacaggttcttgtcatcaataaccttcccttcaatacaaccgttcactggcatggtttagagtgtgtgccctttccgcgtcccatttctgcatggacctaaaaattcttgcattctcacacactctctctagaatgcgagaaacacctgaagcggacggtgtcccgggccttacgcaaacaccaatagagcccggtgcgacgttcacgtatcggttcagagcgtatccagctggtacgttctggtatcactcgcattacaaggggctcatgcaagatgggcaggtaggagcaatgtatattcggtacgtctgatcagattacaccttatctgcacgatgaagcccattgaggcagtcttattgatcatgtctcaatagccgcaagcctgatgctttgcgaccctacgcggttataacggaagacccgagagagttagcagaaatacagtacgcagaagataatccttatttgatgcttgctacggactggacatatcttacttcggcggagtatcataacatcgaggttgagtctggctataacgtcttgtaagctcgatttttcctttacttcctgttgcgaactaattcaattgcaaaagctgcgtggatagtctcctcatcaatggtcgaggctcagtctactgtcccggataccaataccttgaggaagtgagcgacacggccttactgtccgtcctcgaaggaacacatctgaccgagaaagggtaagtctctgcacgcgtacgcccagtcaagattatataaatactgatattgtatgatacatagctgcctccaaccggacctacataatgtccaaggcgactacggcccctggaacctctctgctgttcccacagaagtcgtctttaattgcaccccgtccagtgtcgagcccccggtgatctacgtcgatcccgaattcaacggttgggtcagccttaatttcattggcggcgctgcgcaaaaggccataactttttctgtcgacaatcacccaatgtgggtatatgaagttgacggacagtttgttgaaccgcgtgaagtcgaaatggttggcgtatactcgggagctcggtacgccgtcatgatcaagctagaccagacaccaggcgactacgcgattcggattgccgtcaatggcgcggatcaggttatgagcgtttacgccatcctctcgtatgtcaatcaggattggatccacagggagaatgtgcccaaggccgctatcggaccgcatacagatacagtgggctacatgaactacggcggtggcaacacatctgcagatgtacgccagcttctcttcacagaaaatctgccggcctttgcggtcccgcctcccccaccttcgagcgaggtctcaacaaccctacgtaccggcatgatccgcgtaaacaactcctactcttggtcattgggaaacaacgtgctgtacgagcccgaaatgacctcctcgacaccgctcctcttcgaaccggatccgctagccgtcatcgcaccaaagtacgccctcacgacagaaaacaacacctgggtcgacattgtcctcgaaatcactgccgacccgcgcgacctcatccacccgccacatccgatccataagcacggtaacagagcatatataattggcaacggggttggcaaattcagatgggagaatgtgagtgctgcagaggcagaagtaccggatttgttttacgtcaacgagactgcggcgttgcgggatacatttgtcacggatttttttgattcgcggctcatggatggggcatggatagttattcggtattttgtgcaggacaagttcccaagtatcttgcattgtcatattgcgtcccatcaaatgggaggaatggcgctggccttgttggacggggttgatgtttgggattcttaggtgagctctcatattcgtacttacaagatgtttgttctaaaattatttaataattattttttaatctctatgaaatggagaagcttttttttctctcttttttggcttctttaaattatatcagcatatttattaaatcattggaactctagatgtacgccccagagaagtagaactacatattcccaatcaacctcagaatacctctgaccctcccagccagcgtgatctgataccccgtctcaacaacccccttgcacatctcaaatgcaccatccccattctctttctccgcttctcccttcataatcggataatccacgcgcggcggaatcctcgtcgccataaggcgcgggaacctgtcaacgcaaatcgctttgatattacttacgccccgcagaccttcttcgcccgcaaaccggccatacccagatcccttgacgccgccgaatggcagctgtactgtgtagtagctgccaaaatcgttaacagagaccatgcctgcctttattcctgagacacaagcattcacgtcgcgcgtgttgtagccaaataccgaggcacctagcgcgtattgggtagaatttgcgatggtgattgcgtcggagacggaagatgcacgcatcatgaggaagacgggggcgaagagctctgtttgggcaatttccatggagggcgtgacgtctgcaaggagggtcggtgtgaaatagtgaccgagcggataggttgggtgttcgaattgtttcccaccagcgacgaggcgagcaccttggctgacggcgcggctgaatgagaaactccaagcgggagaaagaggccggggagatcatggcccccacgtctggggcacctgacttgttgtttgggttgttgggctttgtgtctagtaagactgagaccgaggcggagggctttaatgcgggaggtgacggtgtcaaggagtttgtgtatacgccagggagggcaatgacgcgctccaacccgatgcagttttgaccggcggattggaaaacgccgcgcatgaggacagatgcgacagaggttacttcgctgatagttctgctgtcatcgaggatgacagagggatctttcccaccgagttcgactgttactggtgtcaatgcctttgctgcagactcgcatactttgtgcgccaccggacgcgagccgatgaatgtgatctgggcaattccagggtgcgaggttaaatggtcggcgaccttaggcagacagacaacgctctgaacgagatcacggggatggccacagttttctaga

SEQ ID NO: 60 - DNA, 2163 bp, Synechocystis PCC6803
atgagctattcatcaaaatacattttactaattagtgtccatggtttaattcggggagaaaaccttgagttgggcagagatgccgacaccggcgggcaaaccaaatatgtgctggaactggcccgggccttggtaaaaaatccccaggtggccagggtggatttgctgacccgtttaattaaagatcccaaagtagatgcagattatgcccagcctagagaacttattggcgatcgggcccagattgttcgcattgagtgcggcccggaggaatatattgccaaggaaatgctctgggactatttggataattttgctgaccatgccctggactatctcaaagaacagcccgaactgcccgatgtcatccatagccattacgccgatgcgggttacgtgggcaccagactttctcaccaattgggtattcctttggtgcacaccggacattccctgggtcgtagtaagcgcacccgtctcctgctcagtgggattaaagccgacgaaattgaaagccgttacaatatggcccgccggattaacgcggaggaagaaaccctaggatcagcggcgagggtgattaccagtacccatcaggaaatcgcagaacagtacgcccaatacgactattaccagccagaccagatgttggttattccccccggcactgatttagaaaagttttatccccccaaagggaacgagtgggaaacgcccattgttcaagagttgcaacgatttctacggcatccccgtaagcctattatcctcgctttgtcccgaccggatccccgcaaaaatatccataaattaattgcagcctatggccagtccccgcagttacaggcccaggccaatttggtcattgtggcgggcaatcgggatgacatcacggatctagaccaggggccgagggaagtactgacggatttactgttgaccattgaccgttacgatctctacggcaaagtggcttaccccaaacagaatcaggcggaggatgtgtatgctttgtttcgcctcactgctttatcccagggagtatttatcaatccggctttgacggaaccctttggtttaactttgattgaagcggcggcctgtggtgtgcccattgtggccacggaggatgggggcccggtggatattatcaaaaattgtcagaatggctatctaattaatcccctcgatgaagtggatattgcggataaattgctcaaagtactaaacgacaaacaacaatggcaattcctttctgaaagtggtctagagggagttaagcgccattattcttggccttcccacgttgaaagttatttagaagccatcaacgctctgacccaacagacttcagtgctgaaacgtagtgatttaaagcggcggcggactttgtactataacggtgccctggttactagtttggaccaaaatttactgggggcattacaggggggattaccgggcgatcgccagacgttggacgaattactggaagtgctgtatcaacatcgaaaaaatgtcggcttttgcattgccactgggagaagattggattcggtgctgaaaattttgcgggagtatcgcattccccaaccggatatgttgatcaccagcatgggcacggaaatttattcttccccggatttgatccccgaccagagttggcgcaatcacattgattatttgtggaaccgtaacgccattgtgcgtattttgggggaattacccggtttagccctccaacccaaggaagaactgagcgcctataaaattagctatttctacgatgcggcgatcgcccctaacctagaagaaattcggcaactgttgcataaaggggaacaaaccgtaaataccatcatttcctttggtcaatttttggatattctgcccatccgagcttccaaaggctatgctgtgcgttggttgagccaacagtggaatattcccctggagcacgttttcaccgccggaggatcgggagccgacgaagatatgatgcggggtaacaccctttccgtcgtcgtggctaaccgtcaccatgaggaactttctaatctaggggagatcgaaccgatttatttttccgaaaaacgttacgccgccggtattctggacggtctggcccattaccgcttctttgagttgttagaccccgtttaa

SEQ ID NO: 61 - DNA, 2206 bp, Saccharomyces cerevisiae
aatataaagaaatattagttaggaaaaaattaatagggaagaaagatctagaagcaaacagcaatgactgccgtcgcctctactagcgggaagcaagatgctgaccataaccagtctatagagtgtccaaggttttcgcgtggacagaaagagattttgttggaccatgaggatgcgaaggggaaggattcaataatcaactcccccgtgtcagggaggcaatcaataagccctactttgtcgaatgctactaccacgactacgaaatctattatgaatgccaccggcacctccggcgcagtagtaagtaatactccggagcctggtttgaagagagtccccgccgtcactttcagtgatctaaagcaacagcaaaagcaggatagtctgactcagctgaagaacgactcagaaaggaccaagtctccaaatagtaatcctgctcctgtctcaaattccattcctggcaatcatgcagttataccgaaccacaccaacacttcaagaacaacgcaattatctgggtctccactcgtcaacgaaatgaaagattatgatcctaagaaaaaagacagtgctcttaaaatagttgataccatgaagcctgacaaaatcatggccacttcaacgccaataagtagagaaaataataaggtaaccgccaaagcccccaccagtattacacttcgaaaggaagatgcacaagatcaagctaacaatgtttcaggccaaattaatgtgcgttctaccccggaagaaacgccagtgaagcagtccgtcattccttccatcatccccaaaagagagaactccaagaatttggatcccagactacctcaagatgatggaaaattgcacgtgttgtttggcgctacaggttcgttatcggtatttaagatcaagccaatgattaaaaaactagaagaaatatatggacgtgatagaataagcattcaagttatcctcactcaatcagcaacacagtttttcgaacaaagatataccaagaaaattatcaaatcttcagaaaaactaaataaaatgtcgcagtacgaatccactccggcaactccagtgacaccaacaccaggacaatgcaacatggctcaagtagtcgagttacccccacatattcaactatggaccgaccaagatgaatgggacgcatggaaacaacgaactgatcctgtacttcatatagaactacgtcgctgggcggatatactggtagtagctccattaactgcaaacacattatcaaaaattgctttgggcctgtgcgacaatcttctgacaagtgtcattagagcttggaatccgagttatcccattcttttggcaccttctatggtgagtagcacttttaattctatgatgacaaagaagcaactacaaacgataaaggaggaaatgtcctgggtcactgttttcaagccgtctgagaaagttatggatataaatggtgatattggtctcgggggtatgatggactggaatgagattgttaacaaaatcgttatgaaattgggtgggtacccaaaaaataacgaggaagaggacgatgatgaggatgaggaagaagacgacgacgaagaagaagatacagaagataagaacgaaaacaacaacgatgatgatgacgatgacgacgatgacgacgacgacgacgacgacgacgacgacgacgacgacgatgatgacgaggacgaggacgaagcagaaaccccaggtataatagataagcatcaataaatagtctatgaattacaaatacactaaacacattctacttatttgtgttttgtaatttctggaaaaatactcattaggcaaattcacgcagcatatttacaaaatgtcacaaatttttttccttttttacttgcagtaggtatgtaatgccatactagcgtacatagagctcttcatataaaccgctatttattactaattttaataattcagtaattcattaaatacattcattactttctgggtaaatatctattcgtttctcatttttctttttttgacatatcccggtaccggaataagtccgatactattcaaaagcttctggaaaaaaaaaataaaaaaaagaaatgattagtaatcatttaatttcatgacatattaaaaaggtattctaagcagaagtctttcatcacatttgatctaagcatatacactgtaagtgaaggtatcg

SEQ ID NO: 62 - DNA, 3339 bp, Saccharomyces cerevisiae
tgggtaatatattataatggtagctctatggggcatgcgttgcaagtttattcggttgcttgtccaatgagcaactaaagcaattattgaccgatgacaaccctgttgaatatgatcaagaatgatgtagatttattaaaaagctgtggatacggtaatttacacgagcacctaaaggtggggactttgattcagaacctaatacaccacggttattctcaagacgtttatctttttatccggtttgttatgaaatatattaaatttcttaccccagaaatgccaacaatccgagcataacggagagcccctatactaggttaacggaactatcatgtatactcatgtttctttggcgagaccatacttggcaccattggtggtaaatgatttgaagcatgaaataaaaacgtcaaaatattactattataagcattatccaaatatgcctcctataaacgcgaatcagtaagaaaaacacagagatcctcttcggaatttcgacataggatggaggtattggataatttaggcctgttgtgctcattaataaaaagactaataattgatgaaaagactcccagatcagctacggagattgctgtggtaccaaggatgaaaagtctatcattaacaaggattattgaaggtcaactaaacaacattccatactggataaaatctggtgaacgaagtacatggcccgcactagctttaattaagacaagatgtgcagtcgaatttaaattagacgacataataagagcaagacggagtaggtagtatcgtttccacttttttctgtcttattttttttattgatagagctcgattgcatatatttttcattgatattgtacttaaaaatatattcagttcatagaaaaaacaataatacgagaatcaatgtgcctcgtatataatcttatcattatttagcgataaaatagttttgttgactccttctcattcagatataggtattcattttcaacgacgtgtaggcttgtgtttgaagttgcaatgggtgcgccgcccctgcaaacgtgcaatgagccggttacgtcctttgcaaaaccggtcttcagaggattcaagttcaaataatcattgatttgataaaggaagatttgtagaaattttgcagattcgaggaatgaacagaagcatcgtattcatctatattaaatatgtccgaattggaaacaatgattagcactttgcattgcctcaaaagaggtgtgatgaacttattgtttaattctgaacagttaggcgcttactagcgacaacagtaattctggttgttcgatgataacaatggtgtcagttgggttattttgtatagcagcggagaactttgcgagtacgtcacttagtattttgtctcttggcttattatggatattattaacgatgaagtcggacaggaagtctaaaacattgtagttattagatgggatctttagcttgtttaatgaatttgtaaaatagttctgttcgtggataaacgacgcaaggactgcatgggagcgagttgacgaaggtagcatcgatgaagaagattcattaagggaacttggggaacctaacacgtgcgtttctactagtgcgtttatcatccatagtggttgagtacagattgatgggtgatgaagaataagttatgagagttgctgtcttggaaaaagtgggcaggaagcactgattggtcgctgaataggaccaaatcttgtcgttgaacactacccataaatgtgtatttagttatttttgtggaggttctggacggtttttgcctaacttctactagcctcaatttagtacttttatttttttttcatttttcattctgctcatcgcctatcaattcatgcctaagagatgcaaagatagcgtactatagatgtgaaaaggttggataaacaaagcccatgatataagccacggcttcagccttaaaattggggttaaaggctaagaacgaattgcaaattcttttgcttcagcaggaattttccaacagcaaagtataaaaaatctatctaagccgcttttaaattaaggagcgtatataaaattatataatcacactcgaaggaccaatctgtgctctacataccttacgcgctctaataatatgatctatgcttcatcagtcttgtttattcttaaagtatttttttttatgtttggttcttgttattgaacaaaaaaatgaattaacccgaacactaccaaatcaatagcagaagaaaagaagaaaatgataaaataaaggtgagaaccattttaaagcattattcattatgaaatcctcctatctagtataacttgattcgacaccttgctaatatttctctgaagcactgtctttagaggcaaaacggtactatcgcatattcttacccggtttcaagttttgccctcacgcttttttagggagaaatgacttccaccgaaaggataatttgagaacaccactacaacttaaagtccaagagcttcatcagtacaacgagttcgtatcatcaagaacgcacatcagcagaataatgggaggtatacttaaaaacccgctagccttatcgccggagcagctggcgcaacaggatccagaaacgcttgaagagtttagaagacaagtttacgaaaatacgcagaaaaatgccaaattgacatcacataaaaggaatataccgggactagataatacaaaagaggagggggagataattggaacatcgagtaccttccttccaaaggacacactgtcactgaaacatgagcaagacatgttggccaagatgacaccagaagagcgagttcaatggaaccaaagaaatttagcagaaaatgaaataacaaaaaagcagttccaagatattcacatagacgagcccaagaccccctaccaaggtgctgtggaccctcacggggaatactacagagtagatgatgatgaagatgaggataatagtgataaaaaaccatgccaggtggcaaacgatgacatcgacgatttgtccctgggcgaaccggaatttgaaatcaaagagaacaaacaaccggattttgagaccaacgacgagaatgatgaagactcaccggaggctagacataagaaatttgaagaaatgagaaagaagcattacgacgtaagggcaattttcaacaaaaagtcccgtgaagcgctaaaggacgaagacgaagacgaagatgatagtacgacaaaagaaccatgaaacatgacacctccataacgtttacctatactaaatatatcttattttttggattcttggtacataaatatgcactgtttgttatcacgcgaac

SEQ ID NO: 63 - DNA, 713 bp, Zea mays
cggagacacacattgccactgcgatggccgcccaccaggactcggcggcagcggggggcaggcctcctcgtcgtcctcgcgtcctcctggcagcctccggcagcgtggccgccatcaagttcgaggtcctctgccgcagcgtcgccgagtgggcggatgtccaggcggtggcgaccgcgtccgcgctggaattcatcgatgtggcctccttccccggcggcgtccctctctacaccgacgaccaggagtggtctagctggaagcgggtcggcgacaaggtcctgcacatcgagctgcgccggtgggccgacgtcctggtcatcgcgccgctatcggccaacaccctcgcaaaggtcgccggcgggctgtgcgacaacctcctcacctgcgtcgtgcgcgcctgggactacagcaagcccgtttacgtcgcgccggccatgaacaccttcatgtgggacaaccccttaccgcgcgccacctcgccgtcctgcgcgacctcggcatgtccgtcgtcccgccggtcaatggcgcgatggcggagccgtcggagatctgcaagaccctcatgctcttcttcggtccgcaacatctttagcagtcgccaagctcctcagttctttgctcctttatgtatgatgagatgtgtcccttgcttgacctagcatagcaatcttgccccaaaccacggggtaraattagatggcaattgttcc

SEQ ID NO: 64 - DNA, 1382 bp, Zea mays
ttttttttttttttttttttttttttttgatccaattgcttcattcggggtagtaattttacaaagcccagttatggggatacattggtttcaaaaaaaaaaactcgaaattctcccgcctatccaccttgaattggattggatttgcttcgagcagtcagtcttgccgaagtttttaggagttctccgacctcgtagtcaatcactcagtctcggagacacacattgccactgcgatggccgcccaccaggactcggcggcatcggggagcgggcctcctcgttgtcctcgcgtcctcctggcagcctccggcagcgtggccgccatcaagttcgaggtcctctgccgcagcgtcgccgagtgggcggatgtccacgcggtggcgaccgcgtccgcgctggaattcatcgacgtggcctccttccccggcggcgtccctctctacaccgacgaccaggagtggtctagctggaagcgggtcggcgacaaggtcctgcacatcgagctgcgccggtgggccgacgtcctggtcatcgcgccgctctcggccaacaccctcgcaaaggtacgccgtacgcacgccagctggtcatcgcgctcgccctcaccggtcgccgctgacaactctgcctgctgccaggtcgccggcgggctgtgcgacaacctcctcacctgcgtcgtgcgcgcctgggactacagcaagcccgtttacgtcgcgccggccatgaacaccttcatgtggggcaaccccttcacggcgcgccacctcgccgtcctgcgcgacctcggcatgtccgtcgtcccgccggtcaatggcgcgatggcggagccgtcggagatctgcaagaccctcatgctcttcttcggtccgcaacatctttagcagtcgccaagctcctcagttctttgctcctttatgtatgatgagatgtgtcccttgcttgacctagcatagcaatatggcagtggagcgcttctcgtctttcatttccccgtacagatcgtcaagcaccctgaaaacctcctcagcttcagacggcggcgcgctccaggccgtgaaggcgaacaccttgttcctcacttcaatccagctctgccccggattcttcctcaaccctgcctccttcatcgtcatcctcaccctcttggagtcgtcccacatcccacacgcggcgtacaggtttgtgatcagcgtgcggttgccggtggttgccgtctcagcctgcagaactttggccatggcagcttcggccagtgctgcatccccgtgaatcctgcaggagttgagcagcgctccccacacgcacaggtcaggcttcatcggcatcgtatcaatgagctcacacgcgcccctcagcaggccagcacgccccaggagccc

SEQ ID NO: 65 - DNA, 866 bp, Zea mays
gggcgttcctctcccgtgtggattctccccacctccgccgccgtttccccgcgtgctttctctctctctctcgatctcgagcgacgactcggttacagccgccgtcctacgccaggtcccaggtcttcgtcgggcccgtctccggcaacgagcaccaacaagatttttgtgtgtaaagatttgcgagcaccattcactttttcatcagtgtgaaattaaaacacttcaagcatgagctctcaccgtgtgaagtggaatgaggacaatttgtatgaaattgagtcaaacaaaccggtgaggcagaagataacagagccaaagacaccatatcacccaatgatagatgatgatggatcattgtcgccaacacgtcctttcgacaaatgtcttgatgagactgtccaggctgaagctatcttaacagccttaaatggtgtggcttcttcaagcattagcatttcaaaggatgatggttggggatcgtcagatgatgatacagatgccatagatcaagatgctgaccctgaagctgacacgacaaggttgagtttcaaggagcatcgccgtgcccactacgatgagtaccgcaaggttaaggagctgatgaggactggatcccttactgctgaggaggccgatgaggataacagagctgccaccagctccgaagacaaaggtgtggggaaaggagggccgaatgataacatgaagccctcgcctcaaacatgaggagttcatatgaaggttctgattcctctgttatttattgtatcattgtatgcaatacagttgttactcttgttttgttttgagatgctggtgtgccaaaatggatttgatgaccgataattttattggtgttggct

SEQ ID NO: 66 - DNA, 901 bp, Zea mays
attcggctcgagctgcaatttctttccaagttgatcgagcgacttcaggattgccttgcatacttttggtgtttgaagagctaatctgtctaccaaaatgaagggacgtgtaaggtgggatgaggctaatattggagaaattgaggcaaacaaacctgtgaggcagaaaattactgagcctaagactccatatcatcctatgattgatgatgacagttctctatctcctgtacgaggaagttttgatgcatgtattgataatgaaaatcgtgctgaagcaatatggagtgctctgaatgatgtagcctccagtagcagaagaggcactggacaatctggtggttggacatcatctgaggatgagccagaagcaatggagcaagatgatgatgattctgaaacagataggaacttgagttttaaagagcacagaaaggcccactatgatgaatttcttaaagtcaaagagctgcaagagacgggttctcttgaggatgaaagtgacgaggatcataattctcaacccagtaaggcggagaaatgtgagtcgtcttcactgagtcatagtgtaaaagagatggtcattgagggtaagaagtcttcaacgcctccagctaatggttcttagacagtgatcaacaaataaaatccactgtcttttcattagtttcattttgtgtattgaagaaaactaaatgattcactgtattgtatcatttgtatgtaaatagtttctttcttcatcatgcttattatgatccgttcacactttggttgtattctggcaaattggtttatgttcggcatcttcgaggagtttgcttgtggcttttataagtaattaaggttggatgcttaaagggagcaaatatatcccaaactggaaaaaaaaaaaaaaagg

SEQ ID NO: 67 - DNA, 401 bp, Synechocystis PCC6803
accgcaaacggactcagcagtggtctgtaaactatatttatgaggaacaaacaatggcaaaacgtcgtaatttaaagaaggaaaaagctgaacgtaatcgtgcttatgcccgtcagtttcgctccgccagtcgcacccaaaaccgccgctattccggtggccaaagacaacaaggtgactccaatggctccagcaataacggtgccgccagcgacgtttaatctatttttagcgctcctaagggtggctaaaactttgcataaaaaacggcgatcggtgggtttcggcccgccgtttgttgtctggggtttttggagactggggctagtagtaaattttccttgccatggttgagttagaccggagtcgggtaatccattggctccaagaaaatgtttccc

SEQ ID NO: 68 - DNA, 501 bp, Synechocystis PCC6803
atctcaaaatctgtactgaaagccctgtctgagaacggcgatcgcttctgtcggctactaattccgcttgtgggccccatgaaaaagcaataggagaaatttacgtctgctggatttaggctcccagagggaaaacattatctgccaacgccgggaaaaacgttaaaatcacaaattgtaactgttgttacttaaaggtaaccaccgttgtgttttttgcaatctaagggaattgaaaataatgtttaaacccagcttacttttgtctttgcttgttgtgggctgtttgctaacggttaccggttgcggtggtggcaatcagagggaggaaggtcaacccactcaacagaacatcgaacagcaagaaaataacaacgggaatgccaataccaatgatgatgataatgacaataacgacgacgatgaggaagatgacaacaaagatggagatgattaaggcggtttgattccaactaccccagtgaagattcttttcattag

SEQ ID NO: 69 - DNA, 988 bp, Agrobacterium tumefaciens
tgcgcttgcgctctaccgcgaggcgttctgacccatttcttacagcgatatcttcagttccaagggaggaaaacgagtgaccgatatcagactttacatgcttcagtcgggtacgctgaaatgcaaggtacacaacattaagatgaaccaggggaacggtgcagactatgagatccccgttccgtttttcctgattacccatccggccgggcacaccgtgatcgacggcggcaacgcgattgaagttgcaacagatccgcgtggccattggggcggcatctgcgatgtctattggccagtactggacaaggaccagggctgcgttgaccagatcaaggcgcttggtttcgatccggccgatgtcaaatatgttgtgcagtcgcacctgcatctcgatcataccggcgccatcggtcgcttccccaacgcaacccacatcgtgcagcgctctgaatatgaatatgcctttacgcccgactggtttgctggcggcggctatatccgcaaggacttcgacaagccgggtctgaagtggcagttcctcaacggtgcgcaggacgattattacgatgtttacggcgacggcacgctcaccacgatcttcacgcccggtcatgcgcccggccaccagtccttcctggtgcgcctgccaaacagcaaaccgcttctcctgacgatcgatgctgcctacacactggaccactgggaagagaaggctttgcctggcttccttgcctcgaccgttgacacggtccgttctgttcagaagctccgcacctatgccgaaaagcatgatgcgacagtcgtcaccggccatgaccctgacgcctgggcgaacttcaagaaggctcccgaattttacgcgtaaatagaacgcgcaagtcaacggccagatacggcgaggttgcatgcaatctcgccgatttttatcatatgagccaagggcaccgagccgagcgggaccgtgtatttcggcgcatcgaccttt

SEQ ID NO: 70 - DNA, 1500 bp, Xylella fastidiosa
atttcctttccatttatggaattatggatatggtaaaaatcctttttaattctcgagataatgaaaaagttgtttctgttcatatattatgtcatacgggttcaaggcagttctgagtactgagtggttggatgtttctttcagatgattttcacttaatgataaaccgaggatcatgtttttataaggaaataaaataaaaaagcatgaggttaatgaatgcaaagaaaaatgtagtttctgagttgggttggtttgatgaaatacatgaattcggtgtacagtacgacattaccagttaatgagaatattcactctttataatagatagagttttattcatttcaaaaaggaagaagccataatgatcacagtcacgccgttccagactggcacggtccgcatcaagacggctcaacaggcggggcaagacagtaagagtggtatcggtcgcaagcttgatatctttcgtgatccaaactggaccgaagtgctgcccattttttgtttcttgattgaacatccagaaggtcgcttccttgtggatacaggtgacacgtggcgcaactctatcccgggatatctgccacgctggaatccgtttctcactaagcaagtgatcgtcaaagtcgcgttgcacgaagagatcggcccgcagctattggcgaagaatatcgatccgtcgcgtgatgtcgaggccgttattctcacacatatgcaccatgatcacgctggtggcctcgatcacttcccacatactcgtatcatagtgacgaaggagaactatgatgcctctcgcggattctttggtagggttgcaggctgtctgcctcagcattggccaatctggttgaagccagagttgatcgaaccgactggacctgctgtcggtccgttcgcatcctcctatccaattacccgtgatggccgcattgtgcttgtaccaaccccaggccacgtcaaggggcatgtttccgtattggttcgtaacgatgatctgtcgatctttattgctggggatgcgacgtacgccgaggatattctacgttccgggaaggtagacggtgtgaccttcgatcctgtgctgtcgaaagatacccttcgtaggatcaccgagtacgcaacatcgacaccaacggtcatcatgccatcccatgatcctgatggcccagcacgtttggtggttcgtcaaacattcatttgaccaagcgatgccggctcacatatggtgtattagtttgttgtatttcctgcagcagtagctttgtccatgatcgctagtggggctgtttgctcgcttcctaatgaagtattcgaatgcatcgtgcgatagaaggttcgtggctgaggcttggaagaacgcgattacgtctagtgagcagctcgcagacttataccctgcgtatctaagcttcctggctcgctgatgagcggttatttgcgatggcaagccgtgtaggtggtacgccgaggcagatatcggtggttgtgtccggtttc

SEQ ID NO: 71 - DNA, 1167 bp, Xanthomonas campestris
cgagcaccggccgcgcccgcctggcaactgcgcattagttttgattgctgctcttggcacgcacacacagccgtcaaagcagtgtgtgcgtgacggccgccgtcgccgcaccgctcaccgatgagcgacgacgccgttgcaatgctggcccgccaagcgcggagcgtgccgatgcgtgtgcaccacctcaactgcatctccacctgcccgctgggcggccacctgatggatggacgcacgcacggcgtgctcgagcgtggccacctgagctgccactgcctgttggtggaaaccaatgccggtctggtcttgatcgacaccggctttgggctgcgcgatgtcgccgagccacgcgcgcggcttagtgcgttctttctggcgctggtgaaaccggatctgcgcgaagacatgacggcgatccggcagatccagcggttgggcttcgatccgcgcgatgtgcggcatatcgtgctcacgcatctggatttcgaccatgctggcgggctggatgattttccgcatgcgcgcgtgcatctgatgacgcgtgagcgtgatgccgcgctggcgcaacacacctggatggaccggcaacgctttcgcccgcagcaatggtccacgcgtgggcaatggcgtacctacgacagtacctccggcgcggcctggatgggcctggagtgcgtgcacgatttgcacgggctgccgccagagatcctgctggtgccgctccccggccacacgttcgggcatgccgccgttgcggtgcgcacccctgagcgttggttgctgctcgccggcgatgcgtatttctatcaccgcgaaatggacccgcagccttattgcacgcccgggctgcgtttctatcaatggatgctggaaaaggaccgcactgcaaggctgcataaccagcaacggttgcgcgcactgcggcaacagcacggtgcggaggtggaggtgttttgttcgcacgatgtcgtggaattcgaacgcgttgccgggctgcccgcacgcttgcctgcaggcgcgttgcaacacgcgcccacggcgtgagcacgtgtgcttcacttcgccagaacgtgccgcagcgcgatcatgcgccaccagtgccgcagcagcgaggcggtgcgctacaggagaagcacgatgcagcagattgaagtgggccagatg

SEQ ID NO: 72 - DNA, 608 bp, Zea mays
ggctcgagcgtttaccgccgccgacttctgattctaccaccacccgcctcctctcgagttcgatctgtttgctcccccagacatgtcgggccgcggcaagggaggcaagggcctgggtaagggcggcgcgaaacgccaccgcaaggtgctccgcgacaacatccagggcatcacgaagccggccatccggaggctggctcgcaggggcggcgtgaagcgcatctccgggctcatctacgaggagacccgcggcgtgctcaagatctttctcgagaacgtcatccgcgacgccgtcacctacacggagcacgcccggcgcaagaccgtcacagccatggacgtcgtctacgcgctcaagcgccagggccgcaccctttacggcttcggcggctagggcgctaggctaggccatgctcgacccgccccccactctccgctctggcgtcgtcactggttccttgacccctgtgcgggtcggtcggtggtgctagggtcagcagttgtctggtgtctgtagcctctctggctatccgttctttggtgtgaaatggaattccaatcgtgtgggaatggatctctgttcgattgttcaaaaaaaaaaaaaaagg

SEQ ID NO: 73 - DNA, 775 bp, Zea mays
ctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggccttaccgcttcagccgtgccagatgccaatgatgatgccaggtatgatgccaccgatgacaatgatgccgatgccgaatatgatgccatcgatgatggtgccgactatgatgtcaccaataacgatagctagtatgatgccaccgatgatgatgccaaacatggtttcaccaatgatgatgccgagtatgatgccttcgacgatgacgccgagtatgatgccaccgataatgatgccaagtatgataccaccgatgatgatgccgagcatggtgtcatcaatgataatgccaaacatgatgacagtgccacaatgttactctgattccatctcgcacattatacaacaacaacaattaccattcatgttcagccccacagccatggcgatctcacccatgtttttacagcagccctttgttggtgctgcattctagatataagcatttgtgttgtacccaataatgaagtcggcatgccatcgcatgcgactcattgtttaggaataaaacaagctaataatgacttttctctcattataaaaaaaa

SEQ ID NO: 74 - DNA, 2004 bp, Zea mays
acatgagttcccgttttgctcccgagttctctctcacgtccatccctctctctcgtctcgttctttagcagggccggctggagcgcccactcctccctccagcccggccccagccgcgccgccgcgccggtcgtagacccaacgcccgccgcccagcccagcgcgccctccggccgtgaggcggagaggatcgggcgggcctcggggcgagcgccacgcgtagacggcggttgaggagcctgagaaaacaacggtcctccttcaagatcctgatccctacgcgcaggcgtaggagattgtattccgtctgattaatcggcggagagcaagcgggtgttgcggctgcgcgagcatggcgggcgaggaggctgcggagggcagcggaaccaggaggcacatggatctaaacctgtatctcggcctccctccattgccgcggcctccagtctggctggacccgacgttgatgcccaacttgaccggtgctgcgccagaatcctcaataactggtgagcctgaggaatcgttggccctgggggcggcagcctattctccgtcgaatgcactttccaccccggaggagcacccaatgcttgatcccatagtttattcctggctcgacggcaacaggaccgatggtgaagaggacactgatgctcctgagccggggccagtggatggtgccaatgtctctaggtcgcagcttgtggtagctgccacaggattggaaggggatgatgatcttcctctagtaaggtttgtgcgccctagccagatggttgttgctggtggaatggagacggtgaacacaagtatacttcagcagtccattcaaagggctgctgcaattgaggccaggactcctgaactccgctttcagagggtgatacagattagccagcagcatagaattgtgaggccagcatcagtgaaccgcagtcaaggggcagctagtacagatgcggataggcttgtctgggcaatccagcgcactcataactctttagaagcaacaaggcggcaaaaactagatgacaacaacttgtgtggaaacggttctgctaagaaggatgagtcctgtgactgcaactccagctttgagtgcaatatctgtcttgacccagctaaacagcctgtggttacaccctgcggtcacctcttctgttggccatgcttgtaccagtggcttcatgcacattcaccccactctgagtgccctgtatgcaagggtgaggtgctagaactgaatgtcactccgatatatggaagaggcggtgaagaagggaattccaccaaccctgacttcccacctaggccacgagcaaacagaagggagagcctgaggcaacagctgcaaatgacagacacaagaggaattgcaacagtggtgaggcagttgatacaaaaccagggtataattagcgttctcccaagcccaacagggatcgagatgtcggtggttcctgcaggccggcaaagggctagggctcggagacagcaaaggcaggataataatgcatcatcttccatacacgttgtagcgcagaatatgggcaatgttgcccctgagagcagcaaccaaatccagttgtcacattctaacggtgacaatgctgcacagatggttcttgcagctcctcagcagtcatcatctgtcgaacagctgtcaacttctagcaccacagctgttatattgggcgagcctgggtcaagtaggcggtcaaggccttcggagtctccaaccataagaagaacgaggaggaggccacagtaggtactcgagtgttgtcactcccttcagtaaaatctacagaccatgccccagtgatagttattaccatgattatctccaataacatctcaaggttaataatgtagaaatgtatatgccatcactggtttctgcctttctcttacattccatgtatcatctattatgcaaaacgagtcgaaatatcagttccagtatctatgataatcttgacctttgtatactgggaatat

SEQ ID NO: 75 - DNA, 1527 bp, Zea mays
ccacgcgtccgcggacgcgtgggggagaaagataggagtcaattaatttgcctgttctgcttgctgctgaccttgtgagtgagccgccggtcttccccttcctcgccgaggggaaataataaggcagccacagccagggccgccccgaggaagaagatgagcggaggaggcgtggacggagctccggtcgccgagttccggcagacggtgacgcacggcggccggttcctgcagtacaacatcttcggcaacctgttcgagatcacgcacaagtaccagccccccatcatgcccatcggccgcggcgcctacgggatcgtctgctcggtgatgaactccgagacgaaggagatggtggccatcaagaagatcgccaacgccttcgacaaccacatggacgccaagcgcacgctccgggagatcaagctgctgaggcacctcgaccacgagaacatcatcggcatcagggacgtgatcccgccgcccgtcccgcaggcgttcaacgacgtgtacatcgggacggagctgatggacacggacctgcaccacatcatccggtccaaccaggagctctcggaggagcactcccagtacttcatgtaccagatcctccgcgggctcaagtacatccactccgccaacgtgatccaccgcgacctcaagcccagcaacctgctggtgaacgccaactgcgacctcaagatctgcgacttcgggctggcgcgcccgtcctccgagagcgacatgatgacggagtacgtggtcacgcgctggtaccgcgcgcccgagctgctgctcaactccaccgactactcggcggccatcgacgtctggtccgtcggctgcatcttcatggagctcatcaaccgccagccgctcttccccggacgcgaccacatgcaccagatgcgcctcataaccgaggtgatcgggacgcccacggacgatgagctcgggttcatccggaacgaggacgcgcggaagtacatgcgccacctcccgcagttcccgcgccggccgttcgtcagcctgttcccgcggatgcagcccgtcgcgctggacctcatcgagcggatgctcaccttcaacccgctgcagaggatcacagtggaagaggcgctggagcacccgtacctggaacggctacacgacgtcgccgacgagcccatctgcacggacccgttctcgttcgacttcgagcagcaggctctgacggaagaccaaatgaagcagctgatattcaacgaggccatcgaactcaaccccaacttccgatactagctagctagctagttcggacacacatcttaattatacgtatgtatgattcctcgtacgtggtttgtaaatagaagatcgagccggccgccggtgttattagactgaacgttgcatttgtttgttcgttgacgttcgcgctcgcaggtttcaggctgtgtagtctgctgcaggtttcaggtgttcgtgtaatgagctgtaccaagaataaaatgctttggactaaaaaaaaaaaaaaaaaaaaaaaag

SEQ ID NO: 76 - DNA, 1687 bp, Zea mays
caaaactcgcagcaacgaattgggcatattccccccacctgcaccccccacttttggcactttcccttccggccccctctcctcggcgcgatctaaatccggtccggcgatggacggcggggggcagcccccggacacggagatgacagacgccggcgcgggcggcggggggcagccttcgccaccgcagcagccggcgggcggggccgggatgatggagaacatccacgcgacgctcagccacggtggccgcttcatccagtacaacatcttcggcaacgtgttcgaggtcacctccaagtacaagccccccatcctccccatcggcaagggcgcctacggcatcgtctgctcggcgctcaactccgagacggcagagcaggtggccatcaagaagatcgccaacgccttcgacaacaagatcgatgccaagcgcacgctccgcgagatcaaactgctccgccacatggaccacgagaatattgttgcaataagagatatcatacctcctccattgagggaggcattcaatgatgtgtatattgcctatgaattgatggatactgatctgcatcaaattattcgttcaaatcaagctttgtcagaggagcactgtcagtattttctttatcaaattcttcgtggcttgaagtatatacattcagcaaatgttcttcaccgtgatttgaagcctagcaatcttcttttgaatgcaaactgtgacctcaagatatgtgattttgggcttgctcgcaccacctcagaaactgattttatgactgaatatgttgtcacaagatggtatagagcaccagagcttttattgaactcctctgaatatactgctgccattgatgtgtggtctgtgggctgtatatttatggaactgatggaccgaaaacccttgtttcctggaagagaccatgtccatcagctacgtctactaatggagctcattggaacaccgaatgaggctgatcttgattttgtaaatgaaaatgcaagaagatatatccgccaacttccctgtcatgctagacagtccttccctgaaaaatttccacatgtacaacctttagcaattgacctagtggaaaagatgctaacttttgatcctagacagagaataactgttgaaggcgcacttgcacacccttacttggcatcacttcatgacataagtgatgagccagtctgctcaatgcccttcagcttcgacttcgagcagcatgcattatctgaagaacagatgaaggatctgatctaccaagaggctcttgcattcaacccagattaccagtagccaaagttcggttccagccggtgattgcgttcattgacatggagatttttatcccacctgatgtcactgcaaaaagtcgccaactccgattgctagctgtaaataattgccttccccgaagacccccccattccttccttgattaaaaaaagcaggagacggtggccattcaagggtagaaaagagcgagcttgtgaaggtcaaatttctgcgcagctatggattcttgtgcttacaatatgttgtttttaatcaggttttcctttctttttcttcttaagtacttctcggtgttgtctgtaagagaggtagctcatgaacgatggctgcctgaattcagtggctgtcgtcaaagtgaacagttctagtcgacttaaaaaaaaa

SEQ ID NO: 77 - DNA, 1390 bp, Zea mays
ccgacggccgtgggggcatcgacggccgggcgacgcgacgcgatgtgaccatgacccgtcagtcagcagtacaaaatggcgatgatggtggatcctccgaatggaatcgggaaccaaggaaagcattactactctatgtggcagaccttatttgagatagacaccaaatatgtgccgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcctctcgtaagtatgtacccacatgcgcaccctcttgccattgatctgttgcagaagatgctcatcttcgaccccaccaaaaggatcagtgtcaccgaagctctcgagcacccttacatgtcccctctgtatgatccaagcgcaaatcccccagcccaagtgcccatcgatctggatatagacgaaaacatcagctcagagatgatccgggaaatgatgtggcaggagatgcttcactaccaccctgaagttgccacagcaataagcatgtcatgagagattccacagcccccaggacatcagcgggggctcacctcttctttttttgtctttgataaaagcctactgcgagtagccgattattgcggcacctagctgttatagtacacttaatgtctgcttggaaccaattatggcgcctagctgttgtagtacccttaatgtctgcttggacaaaaaaaaaaaaaaaaaaaaaaaa

SEQ ID NO: 78 - DNA, 2708 bp, Zea mays
ccacgcgtccgcggacgcgtgggttttaacgccacctcgcgacgcggcccccaacccccaccgctgcggtgctactgctaccgtgctacaccatcaggaatcggacgcgggacgctacaccaccaccacagctccccacctccaccctcgccgcgagttgctcagtcgcagactcgcagcgagcgaggcgggggcctcactcagcgcggggcgaggcgagcgtcccgggtgggcagcgtcgcggtcgcgggctcgatcgggttgggacggggaggtagggaggaggggccagggatctccactctcgtccgtgcgggagcgcgggcgtcgcatgcggcggcgcgccggggcaaatgctggtagcctcacgggcggaggagcgctcacgctgaggcggcggccggggagcgatgcaggcgccggagcagcagccgcagcagcagcagcagcggaggaagggttcgtcagagatggacttcttcagtgaatacggcgatgcgaacagatacaaaatccaagaggtcattggcaaaggaagttatggcgttgtttgctcagctgttgaccaacatactggtgacaaggtggcaatcaagaaaatacacaatatctttgagcacttatctgatgctgcccggatcctacgtgagatcaaactgcttcggctattacgccatcctgatatagttgagatcaagcatataatgctgcctccatcaaggagggacttcaaagatatctatgttgtatttgagctgatggatacagacctccaccaagtcatcaaggcaaatgatgatttaacccgagagcatcatcaattctttctctatcagatgctccgtgcactgaaatacattcataccgctaatgtttatcatcgtgatttgaagccaaagaatatattggctaatgctaactgtaaacttaaaatatgtgattttggattggcaagagtggcattcaatgacactcctacaacagtattctggacggattatgttgctacaagatggtatagggcccctgaactgtgtgggtctttcttttccaagtattcgccagctattgacatatggagtatcggttgcatttttgcggagatcttaactgggaagcctttatttcctggaaaaaatgtggtccaccagttagatttgatgactgatctcttgggtactccatcacttgatacagtttccaggattcggaatgagaaggcaaggaggtacttgagtagcatgaggaaaaaacagccagtaccatttactgaaaagtttcctaaagcagatcctgctgcactcaaacttttgcagaggcttttggcatttgatcccaaggataggccaactgctgaagaggcattggctgatccgtattttaaaggcctcgcaaaagtagagagagaaccatcatgccagccaataacaaaaatggagttcgagtttgagcgaaaaaaggcgaccaaagaggatgtcaaggaacttatattcagggagatattggagtatcatcctcaacttctcaaggattacatgaatgggactgagaaaacaaactttctatatcctagtgctgttgaccatttcaggaggcaatttgcaaacttggaggaaaatggaggaaagagtggggcacacgccgcttcatcagacaggaagcatgtttcgctcccaaggacaaccacagttcattctaatccaatccctccaaatggaacctcccaggttcctcaaaagattcccacaggtagaccaggaagagtggttggtccagtaataccatttgagaacgcagctgcagttgatccatacagccaacgtagggtctcaaggaatccagtacttcctccaaccacgtcgaacatgtcagcctatgcctaccaccggaagtcagacaactcagacagagagctccaacaggagctggaaaaggaccgcatgcagtaccagccagcacagcggttcatggacgccaaggtagtatcacagatgtcccctgacttgaggtcttcctactacataccaaaaggtgtcccaaaggctgatcccgcagatagaaccgctctgcattctagcatgattcatgggatcgcccctttcagtggcattgcagctgttggaggtggctacaacaaggtcaatgcagttcagtatggagtttctaggatgtactagttctagttgcattggccatctccgaattcctcagctgatgagttgaagtaataacatggcgaagaccagatgtaggtaccgaagaactgccataccggctctgagccaaagatagaaaacatggaatacggatctcggatcgaggacgtgtccgtcagattgaaaacagatactgggcagcagtcatggttctgtccattggacctagcttttcgggaagcaatgccatcgccccgcggaaacggtaaaataaaaggagaaaaaaaaatgcagtactgtcagttgattgctgcttataaagaagcaaagggggcagagacgacgatttttacaggtaaaattatgtactttgcaaggagggaaacatgtgggaataagtagtgagcctacgtttagctctgtatataaagtgacttgattttatatgtactattacggctggtgaaacacgcttctttaattcaaagctatggagttttggcctaaataccataggcagctcagattgataaaaaaaaaaaaaaaaaaaag

SEQ ID NO: 79 - DNA, 2170 bp, Zea mays
ccacgcgtccggagtagcccattttcctggaggcggcgacggcagcggcccagcccacctctgccgctgtgcttcgcgtgggccgtgcaactcgccggagacggaagcgacgtcggcgagaaccgcgctgccgttgccgtcgaggcgatatggccctaccctcgtcgacggagacacggagtccgcatccgcctccgcctccggggcgctcgtcgtggtcggcgccgcgtgatcccacgggggtctagaatccgggcctcgtcttcatcacccgccacccaccggcgtccgcaagatgcgcgagatggcaccgccgccacaagcctctcatccggattggattggttccggctgttgcttgctccaggaagaacactggacatggacttcttcacggaatatggggaggcgagtcagtatcaaatccaagaggtcattggtaagggaagttatggagtagttgctgctgcaattgatagtcacactggggagcgggttgcgatcaagaagataaatgatatttttggtaatgtctcggatgctgctcgcattttgcgggaaatcaagcttcttcgtctgcttcgtcacccaaacatagtccagattaagcacattatgttgccccctacccgaagggagttcaaagatatctatgttgtttttgagctcatggagtctgacctgcatcaagtgatcaaagcaaatgataacctgactccagagcatcaccgctttttcctgtatcaacttatttgtgctctcaagtacatgcattcagcccatgtatttcatcgtgatttaaagcccaggaacatactggccaattcagacagcaaactaaagatctgcgactttggacttgcacgtgcatcatttaacgactctctttcagctatctattggacagattatgtcgcaacaaggtggtaccgggctcctgaattatgtggctcctttttctccagttacacccctgcaattgatatttggagtatagggtgcatttttgctgaagttctcaccggaacaccattgtttcctgggaggaatgttgtgcaccaattagacttaataacagatctccttggaacaccatcgtttagatccttatcccagattcacagtgataaggccagggaatatttgcttggcatgccgaggaagcgccctattccattttctcataagttccataatgccgatcctctggctctacggttgctagagcgtttacttgcatttgacccgaaagatcgacctactgctgaagaggctttagctgatccatacttcagtggcctttctaaattggaacttgagccttcagcacaaccaatttcgaaggttgactttgaattcgagggaaggaaactaacaaaggctggtgtgagagaaatgatatatcgggagattttggagtaccacccccagatgcttcaggagtacatcgaaggtggagatcagattcacttcctatacccaagtggggtcgatcgcttccagcgacagtttgctcatctcgaggagaactacaggagaggagtagcaagcaccccgccgcgaaggcagcccacatctctgccgagagagcgagtctgctcatcagaagatggccacagtcaggactctgacagcgaagagcaaagagcagcatcctacgttgcccgaacaaccataagccctccaagatcacaagaggagggcggcaagctccagcctgcctaccagagcgccgccgccgccgcagactcctgcgccaagagctatctgaagggtgccgctagtatcagtagtgcttccaggcgtaccatcaagggggataatggccgaaaggagaaggaatctccgaggctgtgaaagaggtggcgcaggctcgtgacctgttaggcaaaagaggtagcaatggcgccaatgcgactgcaacgtgggatgtcttagtcatcatgcatccaacaacgcaggggggcagtacaagtatgcaggtcatcctagctaggtcgcccaaattaaagcagcctgcttggaggaattagatttgtgtactgttgttaagtttttttttttttgaattcaactgctagattctggcagatctgtcaaccgcactctccttggtttcccaaaatttactggtttgaacaagtttattaaaaaaaaaaaaaaaaaaaag

SEQ ID NO: 80 - DNA, 1555 bp, Zea mays
ggggcggcgtggggcgaggagtggaggacaccgatccccgccggagagcgcgtccatcccaaatggcgactgcagcttcgcccgccgctgcctttccccacatcctctccctctcctcctaatcccctcccaatcccccccccccctctctctctcttcctcgccagctggttcgttccgcacccgccgccgcattgggtgccgaggagggacgcaatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcaggttacatgatgttgtccacagcgagaagcggatatacctcgtcttcgagtacctggatctggacctcaagaagttcatggactcttgcccggagtttgctaagaatcccactttgattaagtcatacctctaccagatactccgtggcgttgcgtactgccattctcatagagttcttcaccgagatttgaaacctcagaacttgttgatagatcggcgtaataatgcactgaagcttgcagactttggtttagccagggcatttggaattcctgtccgtacatttactcatgaggtagtgacattatggtacagagctccagaaattcttcttggagcgagacagtattccacaccagttgacgtgtggtctgtgggctgtatctttgcggaaatggtgaaccaaaagccactattccctggtgattctgagatcgacgaactgttcaagatattcagggtgctaggtacaccgaatgaacaaagttggcctggagtcagttgtttgcctgacttcaagactgctttccccaggtggcaatctcaggacctggcaataatagtcccaaatcttgaacctgctggcttggaccttctctctaagatgcttcggtatgagccaagcaaaagaatcacagctaggcaagcacttgagcacgagtacttcaaggaccttgagatggtacagtgacctgctaaatgtgcttcgcgttgctttggcatttgtaattgtctgagctgagtcgctcattcctttttatgggcgtctgtactctctcattctctctgcatttttgtcgttcagctggatattttgaatctggtgtgttttgagatgtattaaggaatatcaaatagattaccgccttggtctctatttactgaaagtaaatatcctccatgtttatttcccccgaagcagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccgctttaagggaccaaattttacgtccccgggaatgcaaggtaatagttttttttttgggcccccaaatttaatttaatgggcggggttttaaaaacgggggga

SEQ ID NO: 81 - DNA, 1721 bp, Glycine max
cactttgtcctccaaactcaagtgtcggaaagtttgcttcttttccactctgaatcaccctatttattttgggtctctcatctttcttcttccttccaagttgtttttggtgttggtgttggtgttgaattgagttgagaagaaaagaagaggtcatagacacacacacaagacatgtctgctgttgagtcagctgaacacaacaacatcagaggagtaccaactcatggtggacgctatgttcagtacaatatctatggcaatctcttcgaagtttccagaaagtatgtccctcctattcgccctgtcggtagaggtgcttatggtattgtttgcgctgctgtaaatgcagagacaggcgaggaagttgccattaagaagattggcaatgcattcgacaacagaatagatgccaaaaggaccttacgggaaattaaacttcttcggcacatggatcatgcaaatattatgtccattaaagatattatacgtcctccacagaaggaaaacttcaatgatgtgtaccttgtttctgagttaatggacacagatctgcatcaaataattcgttccaatcagcaattgactgatgatcattgtcggtattttctgtatcaattgttacgagggctcaaatatgtacattcagcaaatgttttgcaccgagatctaaagcctagtaatttgctattgaatgccaattgtgaccttaagattgcggactttggtcttgctagaaccacatctgaaactgactttatgactgagtatgtggtcactagatggtaccgagctcccgaattgcttcttaattgttcagaatatacagcagccattgatatatggtctgttggttgcatacttggtgaaatcataacaagacaaccgctctttcctggcaaagattatgttcatcagctgagacttatcacagagctgataggttcgccggatgatgccagccttggatttctacgaagtgataatgctcgtagatacgtaaaacagcttccgcagtatccaaaacaaaacttttctgctagatttcccaccatgtctcctggtgcggttgacttgctagagaagatgctcatctttgatccaaacaggcgtattacagttgacgaggcgttgagccacccatacatgtcacctctccatgacatcaatgaggaacctgtttgcaccagacctttcagttttgactttgagcaaccatcattcactgaagaagacatcaaggaactcatctggagagaatctgtgaagttcaatcctgcaaccatatatgtttagtgaaatatctgatgactaatatatacattttatgaccactacttggcaagttgcagcgcacagaagatatgaaaacgtattggagatactgagattcactgagtttgttgaaggtttctttcgttttagtctcatctcagatacttggataatcatattgttgagatgtactgaggaaagaaaggatcaaaatatgtttcagcagaatatcctaaagctccaactccttgttgtacttctatccttctttttagattcaaggtccatagtttagtgcattgaactgttcttgccagtttttcctatcctttacatcaagaaaaattcacaagaaaacttttaatttgtggggacagacagtatctcatattcccattgtatgacatttaaattaaattaaatgtaatggtttgttagagtaaaaa

SEQ ID NO: 82 - DNA, 1929 bp, Glycine max
tgatgatgcaagaaagaaacaaagagaagggaaatatcaggagctagtgctaggtgcgagtactggagcaaaacgcgggtgtgtgtgactttcgttggagagagatgcagttccattcagaaactccaaacaaacatccctcgcgacaaccttaggaatctcgatcgccgaaaaaacctatgcagccccgaacacacacactctgcattccaacttgtttaaatcatgcctctcgattcacccttctctctcaataaatcttttggcctatgaaatcagattcttcgccaccgccacagtcataataaagttttatttttccaaataaagggaatggcgactcctgttgagcctcctaacgggatcagaactgaagggaagcattattattccatgtggcaaaccctgtttgagtttgattcaaaatacgtgcccatcaagccaattggccgcggagcatatgggattgtgtgctcttctgtgaatagagagacaaatgagaaggttgccatcaagaagatacagaatgcctttgaaaaccgggttgatgcactgaggactttgcgcgaactcaagcttcttcgccaccttcaccatgagaatgtgattgctttgaaggatatcatgatgcctgttcataggaatagtttcaaggatgtctatctagtttatgaactcatggacacggatttgcatcagattattaagtcttctcaagctttgtctaatgatcactgccagtatttcctctttcagttgctccgtggcttgaaatatcttcactcagctaacatccttcatcgtgacttgaaacctgggaatcttctaattaatgcaaattgtgacctaaaaatatgcgattttgggttagcacgtactaactgcagcaagaaccagttcatgaccgagtatgttgtcactcggtggtatagggcaccagagctcctactctgctgtgacaactatgggacatctattgatgtttggtcagttggatgcatctttgcagagcttcttggccgaaaaccgattttccctggttcagagtgtctcaaccagctgaagttgattatcaatatccttggtagtcagagggaggaggatattgaattcattgataatccaaaggcaaagaagtatatcaaatcacttccttattctcctggaagccccttttcgcgactttatcctaatgcgcatccattagcaattgatcttcttgcaaagatgcttgtttttgatccaaccaagaggattagtgtcactgaagcacttcaacacccttacatggcccctctgtatgatcctaactgtgaccctccagctgtcattccaattgatcttgacattgatgaggatctaggggaagagatgataagggagatgatgtggaaagaaatgcttcattaccatcccgaatctgcgatggagaatgcagggttgtgctaatgatatttacttcttttcacggttatgttcccttttgttggtgccaggatagttctaatatcataacttgcttcaaataattaggagggctttgtcatcagtgagctcattatatgttcctgttttctatttattgaaagcagagagaaacagcaaaatattatcttaaaaaaaattgtgttattgctgatgatgcattatagtctttaactgccatgttgagagattgattttttactgaactctgtattgtagttgcctcgttttgctgtacataaacatgttcctgtgtctttcataaaccattttgtaaattaagtctaatgtttatcaatagtgtgttaatgtttgaactttgaagttattttattttatttttttcctgcaagcggaacataaaaaaaaaaaaaaaaaaaaaaaaaaaaaaaaaaaaaaaaaaaaaaaaaaaaaaaaaaaaaaaaaaaaaaaaaaaaagggggg

SEQ ID NO: 83 - DNA, 1754 bp, Zea mays
gaattcccgggtcgacccacgcgtccggtctctactcctcttcctcctctctctactctccaagttctcttctccgtcgaccgctctacacgtctcttgtcgacctggacaccgaggtggaagaaggaagcagtcagcagatggatccatggatcagcagccagccttctctgagccttgacctgcgcgtcggcctgccgccgctcagcctccaccaccaggcgccggtggccgtcgccttgcccaggcccaagctgctcgtcgaggagaacttcctcctgccgcctccaaagaaagaaccagaggtacgcatatatacactacactccgatcctatgtgcgacgcaagcatgcacccaccccacctggactggacggagacggcgggcgtgacgacgagcaaagactctaacggactgtccccttgatttgatcccaggtcgcggctctcgagacggagctgcagcggatgggcgaggagaaccggcgcctggcggaggcgctggccgaggtggcctccaagtacgaggcgctgcgggggcagtacacggagatggtggccgcggcggccacggcctgcgggaaccacccgtcgtccacgtcggagggcgggtccgtgtcgccgtcgcggaagcgcaagagcgagagcacggacaccgcgccgcccgcgcagcagctactgcaccagcactacccggcggtggcgccggaccagacggagtgcacctcgggcgagccgtgcaagcgcatccgggaggcggagtgcaagcccagggtgtcgaagctgcacgtgcacgccgacccggccgacctcagcctggtggtcaaggacgggtaccagtggcgcaagtacgggcagaaggttaccaaggacaacccctgcccgcgggcctacttccgctgctccttcgccccggcctgcccagtcaagaagaaggtgcagcgcagcgccgacgaccccaccatcctggtcgccacgtacgagggcgaccacaaccacggccagcccccgccacaggcgcaggcgccgcacgacggctccagccctggcgccagcaagaagccgccgtcgccgccgaggccggtcgccgccgctccggcgccgctccaccaccagcaggtccagcagcaccagcagcagcaggcggttggcgcggtgaaatgcgagccgcccgtggccgcggcggcgtcggagctcatccggcggaacctcgcggagcagatggccatgacgctgacgcgggaccccagcttcaaggcggcgttcgtcaccgcgctgtccggccggctcttcgagatgtcgccgaccaaggactgacggaacggatcggatggattgggagattggcatcgcaggagattctggatcagattgtcttcgagcgcacgccgcaatggtcaactgcgcagcgctggcttggctgtcagagcgaaacagcggtaacagagcaagacacgaggggtctgcactctgcagttgtgcaggaggaggaacagacacaaggggaggacggcgcgcggccggacatggcgtggaacagagatcgtcgtcaccgccggcgggggtgtggtcgacgacgcgacatgcgaaacactacgtgctagctagcataggaaaaaacaacatgaaatcgtacaaccaaccaatccctcgcactgttttagttgttagctgtaggcgaaactgttcatccaattgatcaaatgaaacttattttttccctaaaaaaaaaaaaaaaaaaaagggcggccgc

SEQ ID NO: 84 - DNA, 1561 bp, Glycine max
gaattcccgggtcgacccacgcgtccgcaattgcaacatactaagtgggttggctggtttagatctgagcaacagcttttaattttctacttgcttgaattttattggaagccatggattgttcatcatggattaacacttccttggatctcaacattaatccccgcagagttcatgaagaagttcccaaggaggtagaaagcgagcttttctctttgggaatgaccaagtttaacgtggaagaagagtctactagtgacttggaggaggaactgaagcgggtgactgcagaaaacaagaagttggccgaaatgctctcagtggtgtgtgagaactacaacactttgagaaaccatttgatggaatgcatgaggaaaaatggtgaaaaggaggtcagcccaacatcaaagaaaagaaagtctgaaagcagcaacaacaatagtaatttgatgggaactaacaatggaaactcagagagcagttctactgatgaagaatcttgcaagaaaccaagggaagaaatcatcaaagcaaaaatttcaagagtttatgtcaggactgaagcatctgatactagccttattgttaaagatggataccaatggaggaaatatgggcaaaaggtgaccagagataacccttgtcctagagcatatttcaagtgctcttttgctcctagctgccctgtcaaaaagaaggtgcaaagaagtgtggatgatcaatctgttctggttgctacttatgaaggggagcacaatcatcctcagttttcttcccagatggaagcaacatcaggttctggccgtagtgtgacccttggttcagtgccctgtaccgcatctctcagcacttcaacaccaacacttgttacccttgacttgacaaaatctcagggaagcaacgattccaagagcacaaagcctaaaggagattcacctaaagtacctcaggttttggtggaacagatggctacttctttgaccacggatcctaattttagagcagcacttgttgctgccatctcaggaagattgttgcacaataattaaatggaattttggtgaagtgttgctaatttagtgtcaattgtttaagtattccataaaatagagatcattctttagagcaaggggtctctctatgtaaatacaacatggaaggctgggacatatttgatcctttaaagtggaaataaagttccactaaggatgacatgttgagctgattaaacaacagaaaatcaagctctgcaccaccctctgcctcatcatgatggtaaagatttagcaagtcttttttggctaatatatctaggatacctcaaattaaatttcatagtaggttgtagcacacattctcggaaagatctttcataaagtgcatctctacggcaatttaatttctcccttttcttctctcactactctctctggcaagccaactctatatctagtcctagttttagaatttcatttcagaaattatattatacattgatcaagtattataagtgatggaatgtaactcaaaacatggaaaaaaaaaaaaaaagggcggccgc

SEQ ID NO: 85 - DNA, 3772 bp, Zea mays
cctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcgtcggtttccagggccatctgcgttcagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccaaaaagagggtgttccacttcggcaagggcaagagcgagggcaacaagaccatgaaggaactgctgggcggcaagggcgcgaacctggcggagatggcgagcatcgggctgtcggtgccgccggggttcacggtgtcgacggaggcgtgccagcagtaccaggacgccgggtgcgccctccccgcggggctctgggccgagatcgtcgacggcctgcagtgggtggaggagtacatgggcgccaccctgggcgatccgcagcgcccgctcctgctctccgtccgctccggcgccgccgtgtccatgcccggcatgatggacacggtgctcaacctggggctcaacgacgaagtggccgccgggctggcggccaagagcggggagcgcttcgcctacgactccttccgccgcttcctcgacatgttcggcaacgtcgtcatggacatcccccgctcactgttcgaagagaagcttgagcacatgaaggaatccaaggggctgaagaacgacaccgacctcacggcctctgacctcaaagagctcgtgggtcagtacaaggaggtctacctctcagccaagggagagccattcccctcagaccccaagaagcagctggagctagcagtgctggctgtgttcaactcgtgggagagccccagggccaagaagtacaggagcatcaaccagatcactggcctcaggggcaccgccgtgaacgtgcagtgcatggtgttcggcaacatggggaacacttctggcaccggcgtgctcttcactaggaaccccaacaccggagagaagaagctgtatggcgagttcctggtgaacgctcagggtgaggatgtggttgccggaataagaaccccagaggaccttgacgccatgaagaacctcatgccacaggcctacgacgagcttgttgagaactgcaacatcctggagagccactataaggaaatgcaggatatcgagttcactgtccaggaaaacaggctgtggatgttgcagtgcaggacagggaaacgtacgggcaaaagtgccgtgaagatcgccgtggacatggttaacgagggccttgttgagccccgctcagcgatcaagatggtagagccaggccacctggaccagcttctccatcctcagtttgagaacccgtcggcgtacaaggatcaagtcattgccactggtctgccagcctcacctggggctgctgtgggccaggttgtgttcactgctgaggatgctgaagcatggcattcccaagggaaagctgctattctggtaagggcggagaccagccctgaggacgttggtggcatgcacgctgctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtggggaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgaggggggagttttaaagaggaaaagatattttttaagaggtattataaattagaaagttgtatatgagggggtaataaaaataaagtaaaaggattgaagtatatattagttagaaatttagaaaaatagttagagtgttagtatttttttgtgttgtttgtgtaagtattgtatattttttgtaatggttggtgtagaataaaaatatttttgtaattaagaccggaataatacgagtaggtgtgaagatgttggggggggggatggggatggggtagcattgtgataaagagtgttttataatgaatattaaagatagtatttaattataattcttatggtaggataagtagtgatattaagactaattaaataagtagcgggaacagtatcagtaagcacgatacgcacatacccc

SEQ ID NO: 86 - DNA, 2802 bp, Saccharomyces cerevisiae
tgctaagtcgaggcaatctcgcggcgcgactactttgaagcctttttttagttcttttttatgatcaaaatgtttatataattacccagattatcaacccacttcgatgatgggccgcacctgacagaaaaaaatgaatcaactggctactaaagatggtacaaaagttcactttattcagatatagaattgctgaatcgctgcttaccgccatacgcttgactacttttacacccgtacaccacacatacaaccgtacgactacttttcatgcaacagcgtgcgtttcgacatgtcttacacacgagtagatcatcccactggaaaaatggcttgtcacctgaggcagattttggcaagcccactgtttttcgcaaattatgtactacatgcagccattcactacccttcgagcgacatacgcggcgacatcctgtagagcaatgttgtccttaccaagacgtcttgatgaaggataagcatacgcgaagagatttcctctcggagagcctgcagggagcggcgcacctcgccagcggagttatcacacgtaatggtactgagtgagagaccccgcccgacaccgcacggccatttgcagaaagaaaaacaaagtccactacggctaattactgcagaatgcttttttttctttttttttgtggttggtatgttcccttctaacaggattcttccttcggtagatccttgaggggtttaaggggttttctgtttgcgtaatggcgtaattgccagctatatataacattatcatcacatatatatccttatacgtagcttgcccttatatatatattgatatgcggatattcgttgaatgtagttcagtcgtaatcgctacttattggtaatcatagcaattgaatgcttctatattcctttcttactttttttaattgcgcattataaaaaacttgaaggtgcatatttccgattagggccatcaatagtgaccataattatcggtacattaatacgtcatgccattgaatgaaaaatacgagaggcctccgcaacctcctccagcatatgatcccaaccataggccgcccagttcttccgagaactctgccgcggcgaatgtcaacgatggccagacgccgtaccattttagacaggatcaatattacaatctaaattccaaaacgagtggggctcctatagggagcttcgacgaggcctttcctactgaaaatgacaacaagcccaggtggaacgattggccatttaccatttttttcctatgcacggtaggcggattcatcgccattgctgccataaccttaagagcgtggtcccaaacctatagcagtacgggttccggaatatacgatggtgtgaatactggtacgctgaacaccaatgctgccatcctgctagttttcgtgtgcattattgccctagtattctccgttttgggcctcacactttgtcgaatttttccgaagcagtttatatattgcggtatggtcatcaacctagtggcttctcttgggactgccatcatgtacatgtctttgaggtactggtctgcaggtattgtgtttttagtcttcacgttcatgaccgcgtggtgctactggggtatgaggtctagaattcccctttctgtggcggtattgaaagtcgtcgtcgatgccatgaagaaatgcccacagatcttctttgtttcatttgttggagcgctagttgctagtgcgtttgggtttctcttctcagcagtcattgtggctacgtacataaagtacgatcctaatagctcgaatggcggctgtgacgtttctggtggcagctgttcgcattccaaattgattggtgttttggttgtggtttttttctgcggctattatatctctgaagtaataagaaacgtcatacattgtgttatttctggcgtctttggcagctggtattatatgtcaaagtctgaccaaggaatgccaaggtggcccgcatttggagcattgaagagagccatgacttactcgttcggttccatttgctttgggtccttgctagtcgctttgatcgacctgttgagacaaatattgcaaatgatcagacacgatgttacctccagcggtggcggtcaaattgccatccagattttgtttatggtgtttgactggattatcggctttctgaagtggctcgccgagtatttcaatcattatgcatactcgttcatcgctctttatggtaaaccgtatttaagagcggccaaagaaacctggtatatgttaagagaaaagggaatggacgccctaatcaatgataatttaattaacattgcactgggtctattttcaatgtttgctagttatatgaccgctttgttcacgttcttgtatctaaggtttacctcgcctcaatacaattcgaacggcgcttacaacggcgccctaatggcattctcatttgttattgctttacagatttgcaacattgcaacagaagccattagatccggtactgcaactttctttgttgctcttggtaatgacccggaggtcttccatcattcttaccctcataggtttgatgagatttttagggcatatcctgatgtactcagaaaattgagtcaccagaatgtgtgaagagatgtttatcatatgtcactatttctccttgttcttcttaacaattctatatttaattacaatattttaatacttaattttttctacttcaattacctttaagttctatctttattaaattgtttattttgtttttatacattctgtgcagattaacaatatgctatttattaaatga

SEQ ID NO: 87 - DNA, 2475 bp, Saccharomyces cerevisiae
actggttgaagtcacattacatataactacttattttatctaagtcctatatagttctgttattcactagtttgtatattgtacctctaatttatcttataatttcgtcagtaatgacttataattggctttattttcttctcttttttttcacatgcgcagaacctatataacgaaaaaaaaaaaaatgaaaactgaagataagcggccttgacttctctaaactgccgatatttcaacgaaagttagccaacttatttataaaagccttgaataccaacaattggaaagaaggtgtctgtgcttatcatatatagcttgcataaagaaaaattataatatcttcgaacttccatagaaagaatatctttcagtgttaactggctcatttactcagaaattagtattttgaagaacgatgagtattcggaatgataatgcttccggtggctatatgcagccggatcaatcttcgaacgcttctatgcacaaaagagacttaagagttgaggaggaaataaagccattggatgatatggatagcaagggtgctgtagcagcagatggtgaagttcatctaagaaagtcattttcgttgtggtcaattcttggtgttggattcggtttgactaattcctggttcggtatttctacatcgatggttgcaggtatatcttctggtggacccatgatgattgtttacggtataattattgttgccctgatttctatttgcattggtacctcgttgggtgaattatcttccgcatatccgcacgccggtggtcagttttggtggtctttgaagcttgcccctcctaagtacaaaagatttgcggcctacatgtgcggttcatttgcttacgcaggatccgtgttcacaagtgcttcaactacgttatccgttgctaccgaagtggttggtatgtacgctctgacgcaccctgaattcatcccaaagagatggcatatattcgtttgctttgaattgttgcatttgttcttgatgtttttcaactgttacggtaaatccttacctatcatttcatcttcctctctatacatttccctactatcctttttcacaattacaattactgtattggcatgttctcatggaaagttcaacgatgcaaagtttgtttttgccacatttaataatgaaacaggttggaagaacggcggtatcgcctttattgtcggtttgattaacccagcttggtcattttcgtgccttgactgtgcaacccatatggcgtttgaagttgaaaaaccagaaagagttattcccattgctatcatgggaacagtcgccattgggtttgtcacttccttttgttatgttatcgctatgttcttctctatacaagatctggacgctgtcttgtcttctacaacaggcgccccaatcttggacatttataatcaggcattgggtaataaatcaggtgcgattttcctgggttgcttgattctatttacctcttttggttgcgtcattgcttgtcacacttggcaggcaaggttatgttggtcatttgccagggacaatggtcttccattatcccgtttatggtcgcaagttaacccacacactggtgtacctttgaacgctcatttaatgtcatgcgcttggataaccctcattggcctactttatttggcttccagtacggcttttcagtccttaattacaggttgtattgcatttttattgttatcctacatcattccggttatatgtttacttgctaaaaagcgtaacatagctcatggtccattctggcttggaaaatttggatttttttcaaacattgttcttttgggttggactgtcttttctgtggtctttttttcctttccaccagttttacctgtgacaaaggataacatgaactatgtttgtgtagttattgttggttatactgcgtattcgattctttactggaaatacaagggtaagaaggaattccacgctttagaagaatctgagaacgaacaggctgaatatagtaataacttcgataccattgaagatagtcgagaattttccgttgcggcctctgacgttgaactcgaaaatgaacacgtaccgtggggaaagaagtgaatttatagtgttgatcagtcgaccgttatttattttaagtatattatttgcatagaagtaataaaagtgaattttttttaatggtttgttaagccattttagacgagggactaagatatttcaacctaaatatccctcaggctttgcgctcttgaaagcgatgtgactgtaattcaaatttcttgaaatatttttgcgggaaaaagatgaaaaatttttcacctcatcgcataagaagcaaataaaaaaaaaatattaataatagataggcaacaatatagcagctcagagatatagcttaacttcattttacagccttttaacgaaagcataagtattaacagtttgatatataggggattaaa

SEQ ID NO: 88 - DNA, 851 bp, Xylella fastidiosa
cgtcccctgtttctgggaagcgatcgcacttgcgcgtagtgaagtaataacaggcagttgaggacgatgacccaatcccgttggcgtttggatggccgtacggctttgatcacgggggctagtacaggtatcggtctggctgttgctcgtgagttgttgggcctgggtgccgatgtgctgttggtagcgcgtaatgctgatttgctggggcgagtacgcgatgaactggcagaggaattccctgagcgtgagttacatggattggctgctgatgttgctgacgatgtggaccgccgtgcgattctggattgggtcgaagattgcagtaatggtttgcatgtgttgatcaacaatgctggtggtaatgtgacgcgtgcagcgcttgaatatacagaagacgagtggcgtgagattttcgagatcaatctgttctctgcgttcgagttgtgtcgttacacgcagccgttgctggcgtgtcatgcaagtacggcgattgtcaatattggcagtgtatctggcttgacgcatgtgcgcagtggagtgccgtatgggatgagcaaggcggcgttgcaccaaatgacccgcaatttggctgtggaatgggctgaggatgggatccgtgtcaatgcggtagcgccttggtatatccgtacgcgtcgtacgtcggagccgctctctgatgtgtactattacgagcaagtcattgaacgtacgccgatgcgccgcattggagagccggaggaagtagctgcggcagtggcatttctttgtttgccagcgtccagttatgtgaccggcgaatgtattgcggtggatggcggttttatgcgctatggtttctgattaaaggc

SEQ ID NO: 89 - DNA, 1161 bp, Zea mays
ggccggcaccgctgctagcttgctagcatacttcccctacacgcgcgcgcaaccgcaagcagtcgatcgtcgcatggcgccaggaggcagcggcgagcggtggagcctggccggcgcgacagcgctggtcaccggtggcagcaaggggatcgggcaagccgtcgtggaggagctggccaggctcggcgcgcgcgtgcacacgtgcgcccgcagcgcggcggacctggaggagtgccgccggcggtgggccgagaaggggctccgcgtcaccgtctccgtgtgcgacgtcgccgtgcgcgccgaccgggagaggctcgtcctggacacggtcagcgcggccttcgacggcaagctcgatatcctggtcaacaacgctgcgctgctgctgctcaagccggcggcggagtgggcggcggaggactacgcgcggatcatggcgaccaacctggagtcgtgcttgcacatctcccagctcgcgcacccgctgctcctcaacgcctccgtcgccggaggggcgagcatcgtcaacgtctcctccatcgccagcgtccttggcttcccgcaggaagttatgtacagcgtcaccaaaggaggactgaatcagatgacgagaagtctagctgtggagtgggcctgcgataggatccgtgtgaactgcgtcgcgccgggcgtgatcatgacggacatgggtaaagagctaccggcggcgttggtggagcaggagcggtcacgcatcccgctgcggcggaccggcgagccggaggaggtggcgtccctggtgtcgttcctctgcatgccggcggcgtcctacgtcaccgggcaggtcatcttcgtcgacggcggccggaccattagtggcgcctgatcgacgacgacggccagctatatattctctattctactgtatttgaatttgttttcgttcttgatcggccatgtatcaccgtcagacgtcagcggcaataatccggccgccgtcagctagcgccatgcaagctgcccgatcatgcaaggtgcagacactgtcgttgcctgcagttctgttcctttttctactatggtttcttgtattcactgcccactggtgatgtttctgtgataacgacttcgacagaggggatacattttaaaaaaaaaaaaaaaaaaaaaaaaaaaaaaaaa

SEQ ID NO: 90 - DNA, 1189 bp, Glycine max
attcggctcgagcggatatctcaaaggtttatccttcagtgaagagaaatggcagctgaggcaaattttgatagcaaaagcagcaggtggtctttgcaggggatgacagctctcgttaccggtggttccaaaggaatcggatatgctatcgtggaggagttggcacaacttggagccactgtacacacttgcgctcgcaacgaagctgaactcaataaatccttaaatgaatggaacacaaaaggatacagagtaactggttcggtccgtgacgtggcgtctcgtgcagaaagacaagacctcatagctagagtctcaaatgagtttaatggcaaactcaatatccttgtaaacaatgtgggaacaaacatacagaaagagaccctggatttcacagaggaagatttcacatttctggtgaatacgaatcttgaatcttgtttccacctaagccagcttgcacatcctctcctaaaagcttcagaagctgcaaacatcattctcatatcctccattgctggtgtggtagcttcaaatatagtatccgttgtgtatggtgcaacaaaaggagcaatgaaccaaatgacaaaacatttggcatgtgaatgggccaaagacaatataaggactaattgcgttgcaccagggccaattagaacccctcttggtgacaagcactttaaagaggaaaaacttaataatagtctgattgcgcgaacccctcttggacggattggagaggcagaggaggtttcttcgttggtggcattcctctgcttacctgcagcatcttacataacaggacaaaccatttgtgttgatggcggcttcaccgtgaacggtctctacataagctaggcttattgtgacagtttcaatgttttgtttagtctgttacactctacttgtattagtttctctttaagttgtggagagtggagaccctatatctgtttttaaggacgtgataataacagtactcagtgataagtttgtttttcttgttttgatttagtcacatgtcccatgattctaggagcagtataatcgtgggcagtttatcctatttcccgttggttgtaaggctttcaataataataataataatagccatgtttgcttttcaaaaaaaaaaaaaaaaaaaaaaaaaaaaaaaaaaaaaaaaaaaaaaaaaaaaaaaaaaaaaggg

SEQ ID NO: 91 - DNA, 1033 bp, Glycine max
attcggctcgagaagcaaacaacaatggcgaaccctgaaggcagtagcagaggctctagatggtcccttaagggaaccactgctctcgttactggaggaacgcgtggaattgggcacgctgtggtggaggaactagcggagtttggtgccacagtgtacacttgttcgaggaatgaagaagagctgaatgcatgcttgaaggagtggaaagagaagggattttcggtttctgggttggtttgtgatgcgtcttctccaccccatagagagaacctcattcaacaagtggcctctgctttcaacggcaagctcaacatacttgtaaacaatgttggaacaaatgtgaggaagccgacaattgagtatacagccgaagaatattcaaaattgatggcaactaacttggactccacataccatttgtgccaacttgcatatcctcttcttaaagcatctggaaatggaagtattgtgtccatttcctctgttgcaagtcagacaagcgtaggttctggagccatttacgcagcaactaaagctgctattgatcagcttaccaaatattttgcttgtgaatgggcaaaagacaatataaggagcaacggtgttgcaccctggtataccataacttcacttgtggaacctttgcttgcgaacaaacagcttgttagtgagataatatctcgaacgccgataaagcggatggcagaaacacatgaagtttcatccttggtgactttcctttgcctgccagcagcatcctacatcactggacagattgtttcagttgatggaggattcactgctaatggatttcaacccagcatgagaatttcttaaagcaaaatggccatttttattgttggattgtgtgaacaaagtggtggccacttgagttttggaccatctatgatcaacttgttttgattggtcaataaattattttagtattttagaaatttgcattgtcattttcaacggctatcattgtgagatgatgggtgctcttggaacaaaaaaaaaaaaaaaaagg

SEQ ID NO: 92 - DNA, 901 bp, Emericella nidulans
cattgggcacttacaagataaactcttaaattgataccttgaaaataaaaaatccgcaaaattacaaatgagtgatgcctacggtgggctaagtctacgctggacactgagaggaaagaaagcactgattacaggtgctaccaaaggcattggactagctgttgccaatgagttcttatctctaggtgcagaagtcataattgtggcacggaattctcaagatgttgaccaacaactaattatctggcgagaattaggattacctgcttatggaattacggcagatgttgcaactgctgaggggcgacaagccatttttgagcaggttggcaaaacctgggataaattagacatcctggttaataatgtgggaaccaatatcagcaaaaaagtactagactacacggctgctgaatatcagttcatcatccagacgaaccagatatcaatttttgagatgtgccgtctgttttaccctctactgcaaaatagggaaaatagcagcattgtgaatataagttctgtggcgggtttagtctcaaaccgtacaggcgctccttatggtatgactaaagcggctataaatcaattgacgcgatcgctatcagttgaatgggcttgcgatcaaattagggtaaataccgtagcaccttgggctattcgcactcctctaaccgagtctgtactcgataaccaagattttctcaaattagttctgtcccaaacacctatgggaagagttggtcaaccagaagaagtagcgggtttagtagcatttctttgtatgcctgcggcatctttcatcactggacaatgtatcactgtcgatggtggttttttggctttcggtttttaagtctcaaagccagatccatccacgaggtagaagaaactacttaca

SEQ ID NO: 93 - DNA, 743 bp, Zea mays
ccacgcgtccggcagcttcggctcgttgcaagtgctggcgcctgcaggctgcagttccagtgatatacaggactggcatcatttgcagctgcagctcacgtcttggcgagtgtcaaaacccaggagagagagcccaagcaagcgatggcgcgtatcggcgcgagtcatctactcctcgtcgtcttgctgctctctgcggtcctgagctccggctcggctcgggttcccagagaacgaccggacgcgatgctgccggccggtcagacggcggcaatggccgagatgaccgtgcccggcgaagggcagagcagtgggccggcgtttggagtggcggcgcacgagtccaagcgcctgagccccggaggccccgaccctcaacaccattagctgatggtagtaaccgtgatgagttattagctcgtgtgctgcatgcctctggaagacggtttcttatgtatcgtacgtcgcctcgtcggatgagatagagagttgttgtggagatcatcatcaacaagcatgacatctccctaagcgttctttcagatactatatatccctatctgttcatgtttgttcggttgtaagcgtttcctttgtttttgttgtgcttgtgtgcgtttttcactagacgttgggatcataatttttgtatctattcgatatattgattatgatttaataaaatcttttctttattcagaaaaaaaaaaaaaaaaaaaaaaaaaaaaaaaaaaaaaaaaaag

SEQ ID NO: 94 - DNA, 507 bp, Zea mays
gcagtacacttctcatcagccatgaagctcgtcctgtgcttctgcatctgtgtcgttctcgtcatcgcctcgtcgccggtcacgctctctgatagccgccctgcgatggggcgacgctggctgcgagacgaagttgtcattgccaggggccctgaaggcaacacgacctctgcctggtcggaggaggcgccggggatgataccgtacgacgggtcgaagaggctcagccccggtggtcccaacccgcagcatcactaatcgtcgtccgatcttgttggcaagtgccactgcggacatcttgctacgggaatctgtggttgattactacactttggttctgatcagcttttcttttctgtcctttctgatcagcttttcttttctgtcaaggccgtttgatcaaggagtaaacgtaacaaattattgccacgatttttctgaatgtatccaagtcatgtgagtgataataatgatatgctgtcattaactaaactaaagagtcgttgc

SEQ ID NO: 95 - DNA, 423 bp, Triticum aestivum
ttcaggcattgagaaatcgagcgtcaatctgctgatcactcgcatttgcgttgagcagatcacttgctgtgtagattgcaggtacaggttcctgagcttgcatgcgcatggccaaggcttgcctactccgcggtgtggggctggtggtgtgcgcactcctgcttctctcgccctctttcatggcggctgaggcaactggccggaaatgggatcacgggagagaggccacggtggccgtgatgccgatggcgggagggcgttttgcgaggaaggtgttgcgggaggagatggtccaggcagacggcgacgtcgacattgccggctctaagaggaaaagccccggtggcccagaccctcagcatcattaactgatgtcgaggtctcctcgcatgcatatttctctacaaaggcagcatatacatg

SEQ ID NO: 96 - DNA, 732 bp, Zea mays
gaaactcctcctcctcctcctcctccaccaccacctcgccttctcttctttttgtcttgcgtcgcagcatggtgaggaaccccctaaaagccaggccgacgctggtgctcatcagccttcttctaatggcggacctggcaaccgttggctatagccgaagagttgcagaactgggtgcgttagccgtgagcgacagcggcggcggtggcggtggctcgccgccgggcaaaggctgctgcttgcccaaccagtcatcttcttcagcgtcagggcgacacctcggtgacgattgttgcaagcaaatgcgtattgtgtccaagaggctggtgccccaggggccaaaccctctgcacaactgaccagctccgggctccaggtctgcacttgcatgcatcgagagataggcagaggctttttcctttttgtaacgcagccatgcagagtgattagtggagctgcaggtcttcctcttccatgaggtcatgtaaattataggcctacagcttagtttgccgctagctcatacgctctctctgtcacacacttttgtcacttttgattgagagccgctcttcatcggtgacggtgagagactgaaactttgtaataatggatggtcgagggcaaaactcttgcataggctggaattctattttcctttatctagaaactgccttttgatgatgagaatttttactgggacctgtggttctgaaaaaaaaaaaaaaaaaa

SEQ ID NO: 97 - DNA, 595 bp, Zea mays
caccttggacatatatatggaaaatagcttcacagtctagattccatggcatcaaggatggggatggtggctattctgtccttgtttgtttgtgctcttgttgcttcaacatctgtcaatgctaatgtgtggcagactgatgaggatgctttttatagtacaaataaactgggagtcaatggcaacatggagatggcacaacaacaaggtggatttattggccatcgcccaagacttgcattattcaatagggcatcaaaacaactggaccgtgaaaaaagacctgtgcctagcgggccagaccccatacatcacagcatcccatcacatgctcctcagcatccaccatcatatggcaaagctccttatgaagatgacaagagcatagcatctcctggtctgtccaacccgataggtcctccaccatttttagatagatactagttcatgcaaaagtagtgagtatttatgcacctatgccaatgaataacctctaattacctacatgtattggcctggtgtttggtaacatgaagcaataactttctcttatcgaaaaaaaaaaaaaaaaaaaaaaaaaaaaaaaaaaaaaaaa

SEQ ID NO: 98 - DNA, 1700 bp, Zea mays
tcgtcctcctccgtcgggccggaggagcgtctctttgtcggcgcagcgtgcagagcaccgcagattcagagacacgatgatgtcgcgacagtgtgcaaaccgcatctttcttaccggaggttccagcttcctccatggcctcaaatctagagttgcatccagtaggagtcacggcaccgtcagactcaactggcgctgcgtgagaactaatctctggagggccgagcgccttggtgtcaaggctactccgtctgagcatatcattgcagtactgcaagcgtcagatattttcagtggcatcaggaaatggagcaagttgcaattggtcgccatgacaggggtgatggcatgtgtagttctggtagtcccttcttctgatgcagtcgatgctctcaagacatgcacttgcctgctaaaggaatgcagaatagagctggctaaatgcatagcgaacccatcctgtgcagcaaacgtagcatgcttgaacacgtgcaacaatcgacctgatgaaactgaatgtcagataaaatgcggagacctgtttgagaacagtgtagtcgatgaattcaatgattgtgctgtttcacgcaagaaatgtgttccaaaaaaatccgacgtcggcgagttccccgtccccgatccatcttcgctggttaagagcttcaacatggcagattttaatggcaaatggtacatttcaagtggcttaaacccgacgtttgacacattcgattgtcagcttcacgagtttcatgtcgagggagacaaattgatcgcgaacatcacatggagagtccgcaccccagactctggcttctttaccaggtcaaccgtgcagcgttttgtgcaggacccatcgcagcccggcatactctacaaccatgacaatgagttcctgcactatcaagatgactggtacattatctcatccaaggttgagaacaaggatgacgactacatatttgtgtactatcgtgggcgaaatgacgcatgggatggttatggtggttctgtattgtacacaagaagtaaaactgtacctgaaacaataataccggagctggaaagagctgcaaagagcgtaggtcgggacttctcgacgttcatcatgaccgacaacacctgtggtcctgagcctcctcttgtggagagaatcgagaaaactgtggtggaaggagagaagaccatcgtcagggaggtgaaggagatcgaggaggaggttgaggagctggagaaggaggaggcgtcactgtttcagaagctggcagaaggtctcatggaggtgaaacaggatttcatgaacttcttgcaggggctgagcaaggaggagatggagctgttggatcagctcaacatggaagcgactgaagttgagcaagtcttcagccgtgcactaccgttgaggaagctaaggtagctgcagagcaaaggacttggagaaaacaagccatcaagtactggccgaaacggattctatttgccacagcagtacccacagtagagattgttgaacagatacaacaaacatttttaattttcttttctttttcttttcttttcttttcttttctttgtttacccttttctgtggtcaaaacacatgcctacgttagccctatttgtaaagcatcaagagacaacgtaactttttcttgccaaacagagaaaaaaaacaagtgtacttaagactaaaaaaaaaa

SEQ ID NO: 99 - DNA, 1289 bp, Oryza sativa
ggcaatcgctccacttgtcgcctatatacgccttggcctctcggcgtccgatgctagtggtagtggcccgcaaatcctcctcctccgctcgcgtcgccgcccaccaaacccgatcccaccgcgccgcgatgccggccggccagccgcacgcgcacgagcccgacggcggcggcgcgagccaccgccggccccagtcgccgccgtcgctccccgcggaggtggtcccggcgttcgcgccgccggagtcggaggacgaggagtcctgggtctggtcccagatcaaggccgaggcgcgccgcgacgccgacgccgagccggcgctcgcgtccttcctctacgccaccgtgctctcccacccctccctcccgcgctccatctccttccacctcgccaacaagctctgctcctccaccctcctctccacgctcctctacgacctcttcctggcttccttcaccgcgcacccctccctccgcgccgccgtcgtcgccgacctcctcgccgcccgctcccgcgacccggcctgcgtcggcttctcccagtgcctcctcaacttcaagggcttcctcgccatccaggcgcaccgcgtgtcgcacgtcctctgggcgcagcagcgacgcccccttgccctcgccctccagtcccgcgtcgccgacgtcttcgccgtcgacatccaccccgcggccgtcgtcggcaagggcatcctcctcgaccacgccaccggcgtcgtcatcggcgagaccgccgtcgtcggcgacaacgtctccatcctccaccacgttacactgggtggcacaggcaaggctgtcggtgaccggcaccccaagattggggatggtgttctgattggcgccggggcgacgattcttggcaacgtcaagattggagccggggccaagattggtgccgggtcagtggtgctgatagatgtgccggcgaggaacacggcggtggggaatccagccaggttgattggcaggaagaacggtgaggttgagaaggatgaggacatgcccggggaatccatggatcacacatccttcattcgacagtggtcggactacaccatttgagggcgacgcgccgaggtctatttctcttcctctctgtataatccgtagtgttgatatgccaaaaactgatgtacttgtcgtgctttgggtaatctgtactgtagtgttgtatcatcagccgttttatcagtcgaatgcccatgctcatgtactgataactggtgattgatgaaatgatgagtcaaataaaagttgtataacttttgattttaaaaa

SEQ ID NO: 100 - DNA, 1696 bp, Oryza sativa
ttcgctctcgtccccttccctctcctctctcgctcgctcctcttccgcggcgcgcgcgccggcgactcgccgcgtcgggccggccgacaaccgccgcgagggagaagccccctccccttggggggcacccatgacgtcgtgcgggtgcctggtgctcgagaaggtggaggaccacggcggcgaggcggcggggagggggagagggaggctcgcgcagggtggcggcggcggcggcggtggctgcggatcgtgcgcgggggagtggaggagccggtcggagaccatgttccccatctacgtgatggggagctcgcgggccagctccgccgcggcggcgcggggcatagtcgacgccgccggggaccccatatgggaggccgtcaagtcggaggccaagtctgaggcagagaaggaacctattttaagtagcttcttgtacgccagcgtactatctcatgactgtctcgagagggcgttgagtttcgtccttgcaaacaggctcgaagatccaacattgcttgcaactcagttaatagacattttcaatgatgttatgatgaacaacaaagatatacgccgttctattcgccttgatgctcaggcctttaaagacagagatcctgcctgtgcacaatacagttgggcattgttgtacctcaagggttaccattccgtgcaatcctataggatagctcatgtattatggaatcaaggtcgtaaagttctggcattggcactgcagagccgtatcagtgaggtttttgcagtggatatacacccagcggccagaattggagagggaatattgttggatcatggaacgggtctagttattggtgaaactgccattgttggaaactgggtttcattaatgcagggtgttacacttggtggtactggcaaggaaaatggagatagacaccccaagattggtcagggggctcttcttggagctggtgctactatcctcggcaacataaacgtaggcgaaggtgccatgattgctgctggttcccttgttttaaaggatgtacctccccacagtatggcagtaggaaaccctgcaaaggtagttgggtataaagataaggaagacccttctttaactatgaaacatgatgccagaagagattattttgagcatgttgccgttagtttttcagatgacaaagctaatggaagtgttgtgaagtaaaaaaaggttcgatgatgtttggctggcagttcaaaggaatagcatatgtttcgacatttcttcccagaggacagcactgggtatctgattatgcaagggtgcttctcttttttgcccaggtacccatggtcctgaagctccccagttatattttctcgtggcctttggaccgctgtaataatgtgatgtttatttttctggttactttgtaaggactatgtactggtagtggagaccagtacatagttgctactggtagtagagaccagcagcaactatgtacttcagaatacaagctttcttttttgaatcccagtagcatcagcgtagtgcttaagacttagtgcaagctttcttttctgaatcagtagcgtgaagtatattctacagtactagcctattaggtaaagatgtttttcttttgatgtactaacccatcagaaaaaaaatgttacatctggatgggataataaaaaaggaggcaattgttaaattcaaaaa

SEQ ID NO: 101 - DNA, 2078 bp, Zea mays
tcgctcgttttggaattaactttatgctaacagaatctaggtgtcattaagctagattaagcttgctgcttgacttagtagtgtaaatctgtaaagaaaattacctggtttgggtttagtctctataaaagaaatggaacagaggaatgttctggcattgggtgaacatgttctaaaagctactgtttggaagcggaagcataagactgctatggagcaccctgaaggcaatgatgtgatggtgttctctcagcatgatcaaagaaagcaccctgtgatatttgacgacagagctaaatgtaagaagtctaaattaatttcctgtgggagtggagttatattggagtcatattggaactttaagacaagtgggctgcctgtgcgcgtgcttttctaccaacatggtgactggagtgattttccagaggatgttgtaaatctagcacaacaggacttccagttgaagaagccaattacaactgctgtgttccagaacaagcacatcctgttggacttcattcacatgatttgcatagattatgagatgaccatagacaaaccactagcatgggttgatgataatggcaaacgcttctttccagatttatctgctgggctctacacatctaaaccatctcagcatgagaatggtgaagctgatgagtgtgatggaacgcctacaagtgtagctgaaagttctagttcggtatctgttggtgaagtagtttctcatggtaagaggatcaatgatattgcagaggacaacatgagagcacataacatattgtatgaagctgttggtgaaaatatttcaggtccttcattccatttgaatgaatattctagtggaaccatacaagctactggcaagccaaacgattgtcgacgtattgattcagctgtgcggaatttgttgctcaaaggattaggtcagccgtttagtgaggaagatattattggtatctatagaacaccactgctagatcagcgagggcaagttcgttgtggtctcttccagaaggagatcgaagagaccaggagtcgtcgggggaatgcaaatgtacgttatgcttggcttccttgctcaagatataccatggagcagatggcaatgcggggtgctctggaaatcgcgaagcctcataaggggtccatttgtggtgttgggacttgtcttgctcctgcaaactgtacaaattcatgtgccagatattctgattttcatgaagatggcatcatcagaatgatgttgtgccgtgtaataatgggtaatgttgaggttgttttgcctggatcaaagcaatttcagccatccaatggaagttttgataatggtgtggatgatcttcaaaatccacagaattacatcgtatgggatgctaatgtgcataaacacatatatgctgaatatgctgttattgtccaagcacctctcgtgaccaatgaatgttcgggcttgaaggatagcgtgcccaacatatctgagatcataagttctggttctcgagacaatctaaccaaggaggataggttcgcgccttgtggtgtcgaacaagaagcacctaggctggggcgtgctccaagggccccctcctcaccatggatgcccttttcgatgctttttgctgctatttccacgaaagtgcctcgttcggacatggagttggtcatcagatactatgaagaattcaagaggaagaggatgagccggagcgacctggtggtacggatgaggcaaatagtcggtgataagatattggtttctacaataatgaggcttcaccaccagaagaagcccccatcgatggcagcagcagcagctgggctagcaagagcactcgcaaggggggaagagggagggggagtagccgagtaagattagtttaagccgccttgtcttttgagaaatttatggagcacatatgctttgtcgacatggccagacccaaggtgtcaaaagggagggagatgagctgagcaactgttgtagtgtagtctcaaactcaaagcgtttaggtcttgacatttgacaaactaaaactcagaaacattatcatgagtagtgtttttttaaaaaa

SEQ ID NO: 102 - DNA, 1261 bp, Triticum aestivum
ccactctccactccacttttgtacgaagaacactagtgaaatatggctgcccagaacaacaaggaggtggatgccctggtggagaagatcaccggcctccacgccgccatcgccaagctgccgtcgctcagcccatccccagccgtcgacgcgctcttcaccgagctggtcacggcctgcgttcccccgagcccagtggacgtgaccaagctcggcccggaggcgcaggagatgcgggagggcctcatccgcctctgctccgaggccgaggggaagctggaggcgcactactccgacatgctcgccgccttcgacaaccctctggatcacctcggcatgttcccctactacagcaactacatcaacctcagcaaactggagtatgagctcctggcgcgctacgtgcccggaggcattgccccggcccgtgtcgcgttcattggctccggcccgcttcccttcagctcctttgtcctcgccgcgcgccatctgcccgacaccatgtttgacaactacgacctgtgtggcacagccaacgaccgtgcgagcaagctgttccgcgcggacacggatgtgggcgcgcgcatgtcgttccacacggccgacgtagcggacctcgccggcgagctcgccaagtacgacgtggtcttcctggccgcacttgttggcatggccgccgaggacaaggcgaaggtgatcgcacacctcggcgcacatatggcggacggtgcggctctcgtcgtgcgcagcgctcacggggcacgcgggttcctgtacccgatcgtcgacccccaggacatcaccctaggcgggttcgaggtgctggccgtgtgccacccagacgacgacgtggtgaactccgtcatcatcgcacagaagtccaaggacgtgcatgtgagtggacttcacagtgggcgtgctgtgggtggacagtctgctcgcggcacggtgccggtggtcagcccgccgtgcaggttcggtgagatggtggcggaggtgacgcagaagagagaggagttcgccaacgccgaagtggccttctgatcgatcgttgccaaggaacaataatgtgcatgtggtaattttcgaacctagctgcttgatcgcctgcaaccacacgtggtaattgtcctactgctaatgcatttcaagccatgtgctgtttgtacccaataatgtaagtctggtgtttacacgcgatacgccttgtatacaccttgtatgtgcaagtgttgggaatgatacttttgctataaaaaaa

SEQ ID NO: 103 - DNA, 1502 bp, Zea mays
aagcaaaagcaaccgtcgagcttgcaacgccttacgcctccacactcaacagtcatggtcgtcatgggcaaggagcagcaacaacacgaggaggaggaggtgcaagggaaggtcgtccaagaagaagtgcaagtcgttcaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagcggctgggcccggagctgcaggagatgcgcggcgggctgatccgcctctgcgccgacgcggaggcgctgctggaggcgcactactccgacctgctggcctccttcgacaacccgctggagcacctgtcgctcttcccgtacatcaacaactacatcctgctgagccagctggagcacggcctgctggcgcggcacgtgccgggcccagcgccggcgcgcgtggccttcgtcggctccggcccgctcccgttgagctccctggtgctcgcggcgcgccaccttccgggcgcctccttcgacaactacgacatctgcggggaggccaacgaccgggcgcggcgcctggtgcgcggcgacggcgcgctccaggcgcgcatggcgttccgcacctcggacgtggcggacgtgacccgggagctggcgtcgtacgacgccgtgttcctggcggcgctggtgggcatggcggccgaggagaaggcccgcgtggtggcgcacctcgggaggcacatggcccccggcgccgcgctggtggtgcggagcgcgcacggcgcgcgcgggttcctgtaccccgtggtggaccccgaggagatccggcgcggcggattcgacgtgctcgccgtgcaccacccggagggggaggtgatcaactccgtgatcatcgcgcgcaagcccgttgccgtcgacgcgcacgccaccggcggggtggggcacgcgcacgtgcacgcgcacggcgccgtgctcagccggccctgcctctgctgcgagatggaggcccgggcgcaccagaagatggaggaggtggccgtcgagcagctgccgtcctaggcaggcgcacaccggcgtcctcgctttcttgtccgtccggccgcccatttgattttcggagttgcatctatctcatctaatatccatccatccatccatccatctatagcagtattatgtatgcatccacatggtaataatctggctgaccgcatccgcatatggtcgtctcatcgtccatctataccttgaaagctactaattaattactgagttattattactactgtttttactactactacgtacaactacctcatctagctggtgtattaattgattttgtttgttactgctgtactactgttgttgtggagatgaaccatgcatggagtggttagtcactctttagt

SEQ ID NO: 104 - DNA, 2495 bp, Zea mays
cggacctggctacgaagcgcaggcagtacagacagcaccgcctggtttgagcggctgccgccgctgcatatactccctccctgccttccagtgccaggggtgaccggcgtgcgtgccattccacgctctcgcggctcgtgtgccagcggtgaccagcgctcgtgctcgtccagtccaccaggcgctgctgttccggcaagccagccagcagcagccgccgccgccgccgtctcggagctcgagctcctagtcccccggggccgaggcgccggcgccatggaccagctccggcccgagccggccgcgggcgcgcacgagatcgagaagacggcggcgccggacgtggagtcggagcccgcggcggcggtgccggagccggagcgcgtgccgccgtggcgcgagcaggtcaccgcgcgcgggatggtggcggcgctgctcatcggcttcgtctacacggtgatcatcatgaagctgagcctcaccacggggctcacccccaccatgaacgtctccgccgcgctgctcgccttcctggcgctccgcggatggacgcgcgccctcggccgcctaggcattgcatgccgccccttcacccgccaggagaacaccgtcgtgcagacctgcgtcgtcgcctgctacaccatagggttcggcggtgggttcgggtcgttcctgctgggcctggacaagaagacgtacgagctctccggggtgagcacgccgggcaacgtgccggggagctacagggagcctgccatcggctggatgaccggattcctcctcgccgtcagcttcgtggggctcctcaccttgcttccactcagaaaggtgctcgtcatcgactacaaactcacttatccaagtggaacagccaccgcggttctcataaacggattccacacacctcaaggagataagaatgcaaaaattcaggtccgtggattcctcaagtacttcgggatcagcttcctgtggagcttcttccagtggttctacaccgccggcgaccactgcggattcgcccagttccctactttcgggctccaggcttttaaccagacgttttccttcgacttcagcctgacgtacgttggtgctgggatgatctgctcgcacctcgtcaacctctcgttgctgttcggtgccgtcgtttcctggggcgtcatgtggccactcatcggcaagcagaagggcaactggtatccggcagatgcatctcagaatagcatgacaggcatctacgggtacaaggccttcctttgcattgcccttctcgtgggagacggtctctacaacttcgtcaaagtcatagctatcactgtcaagaacatacgcgagagatcacgtcgcaagaacctgaacagagtggcggacgcggacacgatggcgctggacgacatgcagcgcgacgaggtgttcaacagggacaacatcccgacgtggctgtcctacgcggggtacgcggcgctgagcctgatcgcggtgatcgccatcccgatcatgttccgggaggtgaggtggtactacgtggtggtggcgtacgcgctggcgccggcgctggggttctgcaacgcgtacgggaccgggctgacggacatgaacatggggtacaactacgggaaggtcgcgctgttcgtgctggcggcgtgggcggggaaggacagcggcgtggtggccgggctggtggggtgcgggctggtgaagcagctggtgctcgtgtcggccgacctgatgcacgacttcaagacggggcacctgacgctgacgtcgccgcggtcgatgctggtggggcaggccgtgggcacgctgatggggtgcgtcctggcgccgctcaccttcatgctcttctacagggcgttcgacgtgggcgagccggacgggtactggaaggccccctacgcgctcatctaccgcaacatggccatcctcggcgtggagggcttctcggcgctgcccaggcactgcctgcagctgtgcgcggggttcttcgcgttcgcggtgctggcgaacctggcgcgggacctgctgccgcgccggctcgcgcggctcgtgccgctgcccatggccatggccgtgccgttcctcgtgggcgccagcttcgccgtcgacatgtgcgtggggagcctcgtggtgttcgcgtggcacaagctcgacggcaagaaggccgcgctgctggtgccggccgtcgcctcggggctcatctgcggcgacgggatctggacgttcccgtcgtctctgctcgcgctggccaaggtcaagccgcccatctgcatgaagttcacgccagggagctagagggcgcgctgacgatgcgtacagaacagagggcatcgttcgtcgtttgtggggtggaatccgtgtagtagaattacataccaaccaggcctgttctaatgtccatatgagcttaatgtacggtgtatatatatgtaaaaatggaaatctgaaggatgacaggatgaattgcctgttgtctagtagcacgcaaaaaaaaa

SEQ ID NO: 105 - DNA, 1883 bp, Oryza sativa
ctcctcttcctcgtcgccggcgagagctcttcgtcttctccaactcgaccggaagcaagcgcgcttccgatccgccatggtgctctcccacggcgtgtcgggctccgatgagtccgtccactccacgttcgcctcccgctacgtccgcacctccctccccaggttccggatgccggagcagtcgatccccaaggaggcggcgtaccagatcatcaacgacgagctgatgctggacggcaacccgcggctgaacctcgcgtcgttcgtcaccacgtggatggagcccgagtgcgacaagctcatccaggcctccgtcaacaagaactacgtcgacatggacgagtaccccgtcaccaccgaactccagaaccgatgtgtgaacatgattgcacacctcttcaatgctcctctaggggactctgaaacggccgtcggagtcggcactgtcggctcgtctgaggccatcatgctcgccggtttggccttcaagaggaggtggcagaacaagatgaaggcagccggcaagccatgcgacaagcctaacattgtcaccggcgccaatgtccaagtttgctgggagaagttcgcgcgatacttcgaggttgagctcaaggaagtgaagctgagtgacggctactacgtcatggacccagctaaggccgtggatatggtcgacgagaacaccatctgcgtcgcggcgatcctcgggtcgacgctgaacggggagttcgaggacgtgaagctgctcaacgatctgctcaccaagaagaacgctgaaacaggctgggacacgccgatccacgtggacgcggcgagcggcgggttcatcgcgccgttcctgtacccggagctggagtgggacttccggctgccgctggtgaagagcatcaacgtgagcgggcacaagtacggcctcgtctacgccgggatcgggtggtgcatctggaggagcaaggaggatctgcctgaggagctcatcttccacatcaactacctcggcgccgaccagcccaccttcaccctcaacttctccaagggttccagccaggtcattgcacagtattaccaactaatccgcctaggctttgaggggtacaagaacatcatggagaactgccaggagaacgcgatggtgctgaagcaggggctggagaagacggggcggttcaacatcgtgtccaaggacaacggcgtgccgctggtggccttctccctcaaggacagcgcccggcacaacgagttcgagatctccgacttcctccgccgcttcggctggatcgtgccggcctacaccatgccccccgacgcgcagcacgtcaccgtgctccgcgtcgtcatccgcgaggacttcagccgcacgctcgccgagcgcctcgtgctcgacgtcgagaaggtgctgcacgagctcgacgcgctccccgcccgcgtcgtcgccaacggcggcgacgccgccgccgcgtcggcgagcgagagggagatggagaagcagcgcgaggtgatctccctctggaagagggccgtgctggccaagaagaagaccaacggcgtctgctaaagcaagtcagctgcgcagcggggatcgtatactattattatggtccacttcgtaattgcgacttcttaatttttaccgtgtcgatcggtttaccgtctcaagtctgctctcatccgattttcggattgatgctgcttaattatgtaccaagttaattaattcttagaggacggaatagttccgactcaatacgaagcattgcctgtataagtcgaacacgggatcatgcattttacgttgggtgtgtagcagtgaattgatcagtgatgctccatctctaaaaaaaaaaaaaaaaaaaaaaaaaaaaaaaaaaaaaaaaaaaaaaaaa

SEQ ID NO: 106 - DNA, 1557 bp, Oryza sativa
ccaacatcctgagctccaatctcccactccattccggccgcgcattctcccgctctcgatcgatcgatcgatcatggtggtgccttccgcgacgacgccagcgaggcaggagacggtggtggcggcggcgccgccagctgcggcggcgtccggtgtcgtcggcggcggcggcggcgtgacgatagcgacggtggacatgtcggcggagcgcggcgcggtggcgaggcaggtggcgacggcgtgcgcggcgcacgggttcttccggtgcgtcgggcacggcgtgccggcggcggcgcccgtcgcggcgaggctggacgccgcgacggcggcgttcttcgcgatggcgccggcggagaagcagcgcgccgggccggcgagcccgctcgggtacggctgccggagcatcgggttcaacggcgacgtcggcgagctggagtacctgctcctccacgccaaccccgccgccgtcgcgcaccgggccaggaccatcgacgccatggacccctctcgcttcagtgctattgtgaatgagtacattgaagccatgaagaagctcgcatgtgagatcctggacctgttaggagaggggctaggtctcaaggaccccagatacttcagcaagcttaccacaaacgctgacagtgactgcctcctgaggatcaaccactaccctccatcatgcaacattcacaaacttgaccatgatgaccaatgcaatatcaagagccttgttagcaccaaggctagcaatggtgggaatctgatggcaggtgggcgcattgggttcggcgagcactctgacccgcagatccttagcttgctccgagcaaacgatgtggaagggctacaggtgtttgtgccggaccacgagggcaaggagatgtgggttcaggtgccatcggacccatcggccattttcgtcaatgttggtgatgtcctccaggctctgacaaatgggaggctgataagtatccggcacagggtaattgcaaccgcctgcaggccaaggctgtccacaatatacttcgcatcaccacccctgcatgcacgaatctcggcactcccagagacaatcacagccagcagcccacgccgataccgatcattcacctgggctgagtacaagacgacaatgtactcactccgcctgagccacagccgcctagaactcttcaaaattgacgatgatgacagcgacaatgccagtgagggaaaagcataggaattgctggttaaattgcagacgatgcctatggaccagtggggattaggaagctgaaactgtccccaaaattttggctctctggcagtctggctactatcgtcagatatctcactattatgatggtgtagtgcctaagttgacgggtgtgtaatatcgttagcagtctacagaagctatggttgtacggaagtaatgtactgtcgccttttcagctaactatccatgttctctcttatatgtaatgagttagttgacggatgtgtaatattgctagcattgtatataagctatggttgtatggaagtatgtaatatagccttttcagctaaaaa

SEQ ID NO: 107 - DNA, 1828 bp, Zea mays
ctggaactgaaggtggcgggagccgagtgatccggcggtgagctgagcggggcgggatggcggcggagcaggggcggtcgctggcggagacgcccacctggtccgtggcaaccgtcaccacgctcatggtcgctgcctgcttcctcgtcgagcgctccctctcgcgcttcgccaagtggctgcgcaagaccaagcggaaggccatgctcgccgcgctcgagaagatccgcgaagagctgatgctgctcggagtcatctcgctgctgctcagccagacggcgcgcttcatatcggagatctgcgtgccgtcctcgctcttcaccagccgcttctacatctgctccgagagcgactaccaggacctgctgcgcaacacggacgccaaccagacggcgctcgacaagaacatgttcggtggccaacggctgcacgtctgtggcgagggccatgaaccttttgtttcgtacgagggccttgagcagctgcaccggtttctcttcatccttggtatcactcatgtgttgtacagttttgtaacagtggttctgtccatgatcaagatctatagctggaggaagtgggaaaccttagcaggtccaattgctgctgaggaattgaaagctaggagaaccaaggtgatgagaaggcagtcaacctttgtttttaacaatgcttctcatccatggagcaaaaataaaatacttatttggatgctttgctttttgcgtcaattcaagggctccataataaggtcagactatttggcactgaggttgggctttgtcacatatcacaagctaccacattcatatgacttccataaatacatggtacggagcatggaagatgattacaatgggactattggtatcagttggccactttgggcatatgcgattgtctgcatattaatcaatgttcatggtatcaatatatatttctggttgtcctttgttcctgttattctggtgcttctagtgggtactgaacttcagcacgtcattgctcagttggctttggaagtcgctgaggcaacagcgccttatgttggctcacaacttaaactgcgtgatgatctattttggtttggaaagcctcgggtactctggtggcttatacagttcatttcatttcagaatgcttttgagctggcaacattcttatggtctctgtgggaactcagtgcacaaacatgtttcatgaagcactactacatggttgccattcggttgatttctgggctcctagttcagttttggtgcagctacagcacactgccgctgaatgtgattatttctcagatgggttccaagttcaagaaatcactggtctcggagaacgtgagggagtcgctgcacagctggtgcaagagggttaaggacaggagccgacacaatccgctcttctcgcggaacgggaccctcacgaccagatccgtgtgctccctagacaccacctacgagacggatcacgagacgaacacggtgtgcacgctgtcgaggacggcgtcggcgacgtcgctggacgaccagttgaccgtggtcaccgtcgatgacgagccgtcctgcattgagaaggatgtctgacgcagttgctgattcgccaaaactacatactgcaccgacctgtgtgttaggaggtactctaggactgaaatgaatgtatatgtgcagtggttgcccctatcgtggcagtgaccatgtgtatatatagaactaaaaaaactataatgtctcttagctgagagtgagaggctgtacatggaaatacttgaggcagcttggaccaaatacaaaactgcatcttttcgagataaaaaaaaaaaaaa

SEQ ID NO: 108 - DNA, 1629 bp, Zea mays
cccacgcgtccgcgctgcctttcttctactgttcaccccgcgtgcgctcgctcactcgctctctcccctctggctctgagtggcgctagtgggcgaccgccgccgcgtccctccgtcaggtgcccaggtgtagcctcgtcagcccctccgtcaggtcttcgtcggccccctcgccgacgagcacccaccagccaggcatgagagcgcgcttctagaataatgtctgtgcttacctgcgtgattgaaagcatgggctcatcctgtagcagatcccattctttcgacgaggctgaagcagctgaaaatgcaaagtctgcagacattgaccggaggattttgcaagaaacaaaagccgaacaacacatccacaagctcttacttctcggtgctggagaatcggggaagtctacaatatttaaacaaataaagcttcttttccaaactggctttgacgaggcagagcttaggagctacacatcagtcatccatgctaatgtgtatcagacaattaaaatattatatgagggagctaaagagttagcccaagtggaaccagattcttcaaaatatgtcttatctccagataatcaggagattggagaaaaactatcagaaattggtgccagattggaatacccatcgttgaacaaagaacgtgtacaggatgtaagaaaactatggcaagatccagccattcaggaaacttattcacgtgggagtattctgcaagtcccagactgtgcacagtacttcatggaaaatttggacaaattatctgaagaagattatgtaccgacaaaggaggatgtgcttcatgcaagagtacggacaaatggtgtggtagaaactcagtttagccctctaggagagagcaaaagaggcggagaggtctataggctgtacgatgtaggaggccagagaaacgagagaaggaaatggatccatcttttcgaaggtgttaatgctgtaatattctgtgctgccattagcgagtatgatcagatgttatttgaggatgagacaaagaacagaatgatggagactaaagaactctttgattgggtgctaaagcaaagatgttttgaggtccctttaagcgtgtgcgagtggtttaaagattaccagcccactgcacctggcaaacaggaggtggaacacgcctacgagtttgtaaaaaagaagtttgaggagctctacttccaaagcagcaagcctgaccgtgtcgaccgagtgttcaagatctacagaacaacagccctggatcagaaacttgtaaagaagacattcaagctgatcgacgagagcatgaggcgttccagagaaggaacttgatcgaggatgtggtgttataagccacaagacaagtaactaggatggtgtgaggagcagaaagtttacagtgtcgcggctttggccgattgtgattctttttacatgaggaacatttgttgatctttttgccccaccacaagccagtaaaagtatctgttttgcgctggtcttggggaggtttgggtcgtctccatttccccccaatgttaggacaaaatgtacttaccatcttttggagctctgcctgtttggcctcacaatatcaagttcattcgttgttgtctaaaaaaaaaaaaa

SEQ ID NO: 109 - DNA, 1251 bp, Zea mays
ctttccctcgcgccgccgccaacgcaacccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctggtgtgggacctgaccaacccggtccactccaccccggaatccggcgccaccgccgactacggcgtccccttccgccgcctcaccggccactcccacttcgtccaggacgtcgtcctcagttccgacggccagttcgccctttccggctcctgggatggagagctccgcctctgggacctctccaccggcctcaccacccgccgcttcgtcggccacgagaaggatgtcctctccgttgccttctccgttgacaaccgccagatcgtctccgcgtcccgcgacaagaccattaagctctggaacaccctcggtgagtgcaagtacaccatcggaggtgacctcggtggcggcgagggccacaacgggtgggtctcctgcgtcaggttctccccaaacacatttcagcccaccattgtctccggttcctgggaccgcaccgtcaaggtctggaaccttacgaactgcaagctgcgctgcactctcgatggtcatggcggatatgttaacgccgtcgccgtgagccccgatggatcgctctgcgcctccggcgggaaggacggtgttactctgctgtgggatttggctgaggggaagaggctgtactcgctggatgcgggctccatcatccactccctctgcttctcgcccaaccgctactggctctgcgctgcgacccaggactctgttaagatctgggaccttgagtcgaagcacgtcgtgcaggacctcaagcctgacatccagatctccaagaaccagatcctgtactgcacaagcttgagctggagcgccgatggaagcaccctctacactggctacaccgatgggtctatcagggtctggaagatctctggatatggctacgcaggctagatgtcgaaatccagtcgagggtctaggaggtcttgttctgcgaaacattgcaatgcggaacatagttttttttatgtgagttacatcgtctgcttggtactttatggtcgcccaactatctaagcttagctttgttaatgaagtttattaaatttgcttgtttggttttaccttgtgaaaaaaaaaaaa

SEQ ID NO: 110 - DNA, 1043 bp, Zea mays
cccttccgttccgtccgtccacttgccgttgccgaccacaacccgctcccggaggacggcgggatgagggggcaagccaacggagtggaggaccgccggcagcggggcgacgaccacgaggcggacaacgacggcgaggaggcggaggaagaggagggcgacgacgagggccgccaccggggccagggcccgccgcagcagcggcgccaccaggcccagaggccgaactccggcccgcagcagcagcagcagccgcgcccgccgccgccgctcgccaggaacgtcggctacgtcggcaagcatcgcctctccgccgccatcgcccgcctcgaccaggagctccagtccctccaggaggagctggacgagcttgagaccatggaatctgcgtccgcggcgtgccaggagtaagcagattttgagtgtgtagcgttgtgttttccacatcatcatcatcatcacgtgctgtttcttctcgttgttgatgtatggctgcccttgtgaacgaaacagagtggtcacgagtacggaagggaagcctgacccgcttcttcctgtcaccagtggcccggagaactcgtcttgggacaggtggttccagcgggtgcgttcccgcagcaacaaatggtgggcatcgaaaggccctgacttctcgtagctcctgcaaataaagcagagaccatcctcatcagtcgtgtgcagattagaatgaaacacgttgagatgtatcgtccattggtgtcctggggaaacagaacaggcggcggcggcggcggcgagtgcggtgtggctctcgcaacgcctgatagtttttttttttttttgagagaatcattgtgtacgtagtaatccctaacgaggccgaacatagatgcatccacataggcctggttgttgtgtttcctagagattctgactcactaggtcggattcctgatggtcatgcgatctcgctgttctttcttcaaacgtgaagaatcacattgtctttgaaaagtttcagaaaaaaaggagaatcagattgaacgttgttaaaaaaaaaa

SEQ ID NO: 111 - DNA, 1511 bp, Oryza sativa
gcgatgtctttcaggagcgtgatccaggaggtgaagggcgagatcggcgccatctcgcggcgggggttcaggtcgcggccggggcgagtccggcgagtggcggcggcggcggaggagccgccggacgagtcgtcggcggcggcgctggtgatgcgggagagctgctggacgcagctgccgccggagctcctgcgggaggtgctggcgagggtggaggagtcggaggggtggtggccgcgccgccgcgacgtggtggcgtgcgccggcgtctgccggagctggagggggatcgtcagggagatcgtgcgcaccccggaggcgtccgggaacctcaccttcccaatctctctcaagcagcctggcccgagggatgctcctatgaaatgtttcattgtaaggaaccggaccactcagacatattacctgtacattggactgactgatgcattaactgatgatgggaagttcctacttgctgcacgcaaatgtcgtaggaccacatgcactgagtacctgatttcgcttgatatgaacgatatatcaaagaggactgatagttatgttggcaaactaagatctaacttcttgggaaccaaatttactatctatgatgcccatccaccttatgctggagatgtgatttcaaagggtcagtctgcacgtgtgattggttcaaaccatttatcccccaggatacctgctgggaattatccagtctcacatatttcatatgaattgaacgttttgggttctaggggcccgagaaggatgcactgcgctatggattctatccctgtatcagcaattgaacaaggaggaacagctccgacgcagactgaatttcctttgagttaccatgaatctttcacatcaattccctttttcaaatcaaaatcagttcgagcgaataattcaactgcttcattactcactcaaaatggaagcaaactggtgttgaagaacaagtccccgaggtggcacgaacatctgcagtgctggtgccttaacttccatggacgggtaacggttgcatcggtaaagaacttccagctggtggcttcagatgagagtaacccaaccaaccaggaacacgatgatgtgatcctccagtttggtaaagttgggaaggacatgttcaccatggattaccgctatcctatctcggcatttcaggcgtttgcgatatgtctgagcagctttgacaccaaaatagcgtgcgaatgagtgaaggtgtgattctttcttccatgatcgaatgaaccgtttcctgatgacccacattgcaagctggccatgcactctgcttagttgcttccaccttttggaagcatgcagaatagagacataaataaaagttgctttaaatctaacattttagttgggtagggatatgtaacctgcaatttagctttcttgaagtatgttcaacctgcaacatttgagtgacttgtaagtcttgagtttaactacaggtgttggataaccacaattgacagctcaaaaaaaaaaaa

SEQ ID NO: 112 - DNA, 1412 bp, Zea mays
agaagaagaaaaaggagaggcccgcgactgtagtgggattgtgggaagatgcctcgggatggtgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccaccggcggagtccggcaagatcaccttcccctcctcgctcaagcagccaggtccaagggagagaccaatgcagtgctttatcaagaggaataagaacaactctacattctacctctaccttggcttcacaagctcacctgtggataaagggaagtttctcatggctgctagaagatttaggcgtggtccccatactgagtacattatatctcttgatgcagaagacttatcacaagggagcaatgcatacatggggaaactgagatctgatttctgggggacaaacttcaaaatatatgatagcaagccaccatatgatggtgctaaagcatcaagtagtcgatctagtcgtcgtttcggaagcagaaggattagtccccaggtatcggctggcaattacgaagttggacaggtttcatacaaatacaacttgctcaaatccagaggccccaggagaatgtattgcactctcgaatgcccttcagcccaagagacttgggaaaactcactcaagacaaagttcaggcgccccctgggccccacaactttacgaaataaagcaccccgctggcatgagcacctgcaatgctggtgcttaaacttccatgggcgggtaacagttgcatcagtcaagaatttccagcttgtggctgctgccgaccccagtgagcctactaccaacgtggatgatgaaacggttctgctgcagtttggtaaggtcgatagcgatatgttcacaatggattaccggcaaccactctccgcgtttcaagcatttgccatcagcctcagcagctttgggaccaagctagcctgtgaatagcgatgcagtttgatgctcttcgtgtggctatatggtttgtgttggtggttgcttgcttgtttcttgttgttacgatgtgatccgttcttcgttttagttgagtatttatgtactatttgtaccacaagagatgtaataaactattgtattgtcaaacggatttgttcaaggaaattatgtgtaatgaacttttgctctagttccatgcaaaagacatttcaatgtacatctgttcatggtgaagtgatacttctcccttttctaaaaaaaaaaaaaaaaaaaaaaaa

SEQ ID NO: 113 - DNA, 1996 bp, Zea mays
ggctccgaatcggcggccacttctcattcctcacttccgtcctcgcgcaccaccccctccatccgttccggatggtgccttcgaaatcccgtccggcgccctagcgtagctcgggctcggccaggctccgggcccgccgcgccgttccgcagtccagctccacctccagatcttttcttgagtttaaggaagatgcttgcctttatttagaaggccctttttggtacgtcagcagtgttctttcctataggagtaaatgccattccgtagcatcgtgcgtgatgtaagggatggtttcgggagcttgtctaggaggggatttgaggtcaggtttctgagtcatcgcagagggaaatctcatggtgctgtccatgagctgcacgacccagtgcttgtggtacagagtagctgctgggctagcttgcctcctgaattacttcgagatgtgattgagaggttggagaccagtgaggatacatggccttctaggaaacatgtagttgcttgtgcagctgtctgcagaacatggagagagatgtgtagagagattgtcaagagcccagagttttctggaaaaatcacttttcctgtttccttgaagcagcctgggcctcgagatggaactattcagtgttttattaagagggataaatctacccaaatctacagtctgtaccttagttttagctctgccgtgcctgtcgaaaatggcaaattccttctatccgcaaaaaggaactgccgtgcaacatatacagaatatataatatcaataaattctggtgatacatctaggtgtacaagtaacaacacatacattgggaaattaaggtcaaatttccttggcacaaaatttgtaatatacgatactcatccgccatacaatggaactagtcaaacagtggcagggaaaacaagtcagagattctactccaagaagggatcaaccaaggtttcttgcaggtggtacagtattgcacaaatctcatacgagctgaatgtcttgggaactcgaggcccaaggcggatgaactgtgtaatgcactccatcccagcttcatgccttgaggctggtggcagtgtcccttgccagccggacagcattgcagcccactctgttggcggatcattcagcagtgtgtccttgtcaaagtcatcgactatggaccactctatgcatttcaccagttcccggctctctgatgccataacaggagatggcattgtgaacagaggccaggcattgaatgatgctgacgatgaagagtgcaaggacatgcctttgatcctccgcaacaaggccccaaggtggcacgagcagcttcagtgctggtgcctcaacttccggggccgggtgactgtcgcctcggtcaagaacttccagctagtcgcggcgacacagcctgccgccggagccctgaccccatcacaggcagccccgcagccagctccgcctcctccgccggaccaagagaaggtcatactgcagtttgggaaggtcggcaaggacatcttcaccatggactactgctacccgctgtcagccttccaggccttcgccatctgcctgagcagcttcgacaccaagttggcctgcgaataaatcctacctacaattctggtacctaccaaataatcaaaaacactgattgtcgtggtgttcgtccaagaaccgagtttagctgagacgccattgggcaccatgtgctggtgccttgttaactcagaaacgcgtgggggctgaatctgtttcagcagcttccttgtgataatctgtagctgctgcttcgctgctgttgtatcctatgctttcatttctttccggttccgctgtagcttcttaccccccggtgacattagttcggtacccgtatctggatatttttttagccttcttcgttggattgttcaccggtgatggcatgtattaacagagatagttacatacagatgtaatgaattcaggtctggataaaaaaaaaaaaaaaaaaaaaaa

SEQ ID NO: 114 - DNA, 1452 bp, Zea mays
cgaaatccaactcaccggtgtccttggcttcgttcttttcaccggtctgctaccgactcacgcccggcgaactctagccgcggccacgggtcatcacacatggtctcctggcggcgcagcgcgtcctggctgtcgtcggcgtcgcgctcctcgctcggcgccgccgtcggcggggaggccaaggtcacgccggaggcggatccggcggcgcagcacgacgaggccgacgaggagcgctggtcgcgcctgctgccggagctgctcacggagatcatgcggcgcgtcgacgccggcgccgagcgctggccgccgcgccgggacgtcgtggtctgcgcctgcgtgtgccgccggtggcgcgacgccgcggtctcggtcgtccgcccgccgctcgagtgcggcaggatcaccttcccgtcgtcgctcaagcagcctggaccaagggatgcgccgatgcactgttttatccggagggacaaaaaaatttcaaccttttctctctatctcagcttaacgcaggccctaacggataaagggaagttccttttggctgctcgaaggttcagacaaggagcacatacagaatatatcatctcttatgactatgatgatctgcacccaagaagcagttcatatgttggaaagttgagatctgacttcttggggacaaagttcatcatctatgatacccaggcgccatatgacggtgccaaaccttctaggacccgatccactcgccgctttgcaagcaagcagataagcccacaggtttcaggcggcaatttcgaagttggacaagtgacctacaggttcaacttcatgaaatcaagagggccgagacggatgcagtgcaatatccagtgccctgtaggccagggcagcgcttcggatccatccaaggagaaaacaccctcgccgagttccttggacctgaagaacaaggctccaagatggcacgaccatcttcagtgttggtgcttaaatttccacggccgggtgaccgtcgcctccgtgaagaacttccagctcgtcgccacagctggctccggtggtccatggggcgtcggagacgaggagacggtgatcctgcagttcgggaagatcgaggacgatgcgtttacgatggactaccggcagcctctgtctgccttccaggcgttcgccatctgcctcaccagctttggcacgaagctggcctgtgaataaatggttgccggtttaccaactatgttggggatcagattgtagggggtagtctgaactagttgccctgagcacctcagatgggagaaaactggcgataagaaacagggcggacgttgtccctataagctttgactccttgtaatcgcctaaatgattgatttatatatatatgatgtgcgcctatgttgttgaagagatgacgatgacttatcgttgtaaatggcactccacttcgtttggtgacaaaaa

SEQ ID NO: 115 - DNA, 1619 bp, Zea mays
tcgctctagttatggcggatcttgacatggagcattaggagtttctttcgtcgaaggcggaaggagcttgctgtaagctgcaatgtctctcaagagcattgtgcgggagctgaaggagatgagggacggtatcgggagcatgtcgagacgcggcggcagcggctccgacgggcgtgccttccacggccgctcggggtcgcggcattcttggcccagcctgtgggcggagcagcaacagtcgcatcggcagggccagggcctgggtccgggcccggaggggccgcatcatcagcatcaggggcggtgggcgaacttgcctccggaactgctgctggatgtgatacagagggtggagtccagcgaggcgacgtggccggcgcggcgccaggtcgtggcatgcgcagccatttgccgatcatggcgcgaggtcaccaaggaggtggtgaagacgctcgaggagtgtggcaggatcaccttccccatatcccttaagcagccggggcctcgtgaaatgccggtccaatgttttgtgaggagggagagggcaacatccacatatctactctacctagggctcagcccatctatgaatgtggagaaagacaagttattgcttgctgcccgtaaggtcaggcgtgccacaaggacttattttgtgatatcactggtctctgatgatttctctcactctagtagcacctacgttggcaaactgaagccaaacttcctcggcacaaagttcacaatcttcgacagccagcctcctcctgacgctgtagtgctaccaaacaataagacaagcaaaaggcagtccaagcaagtatcaccgagactgccgctaggcaattacaatgttgctacagtcacgtacgagctcaccgtcctacgcaacaggggtccaaggagaatgcaatgcaccatgcactcaataccagctgagtgcatccaggagggcgggaaggcccctacccctacaggcgccatccagtcgcttgacgagccagtgtcgtccaccttacctagtgccaaagggaaggaagtggctgtagaattctcttcgacaagcctcagcgccgatctgtctggaccggcctgcgtgaacggaacacctctagtgctgaagaacaaagctcctcgttggcatgagcagctgcagtgttggtgcctcaacttccgggggcgtgtcaccgtcgcgtcagtgaagaacttccagctcgtcgcctctgttgatccttccctaaacatccccgcagcggagcaggagaaggtgatcctccagtttgggaagataggcaaggatatattcaccatggactaccggtacccactctcggcgttccaggcctttgcgatctgcctgaccagcttcgacaccaaaccggcctgcgaatgattgacggtagtttaaaatcgcgggtggagtcttgtgtacgtccgtgttcttccagggcgatgtaaattctttatcttgccatgctgggcctctgctgcccaggcgaaatggtagcttgtgaggtggagatgagcgatagcatctgtaccataggaagagatttgagcgaccttgtttacccaactgttatatgtattattgctgggatgtttggctgtgaaaaaaa

SEQ ID NO: 116 - DNA, 1476 bp, Zea mays
ggcgaccataactaagatgtgagatttggtggcgtcagctcggctggtgggtgattcttggtgcgtacacagacacatccctggaggcctggaggcttggcgaggaggacagtgcaggagagagatgtctttcaggagcctgattcaggacatgaaggacgagttcgggagcatctcgcggcacagcctgcggtcccggtctcaccgctccgccgggaacgcggcgcgggcggtggccgcgggaccgtcggaggcgatggatcagagctgctggtcgcagctgccccccgagctcctgcgggaggtgctggtgagaatcgaggcatcggagagctggtggccagcgcgcaaggacgtggtgtcaggcgccggcgtctgccggacctggaggggcatcatgaaggaggccgtgcgcgtcccggaggtgtcagggaagctcacgttccccatctcgcttaagcagcctggcccaagggatggcactcttaaatgtttcatcaggaggaatcgaactactcagacatattatctgtatattggattgacagaagcattggctgatgatgggaagtttctacttgctgcacgcaagtgtcgtaagcccacctgcacagactacctaatttctcttgataaggttgatatgtcaaagggaagcagcacctatattggcaagctaagatcaaacttccttggaacaaagttcactgtctatgatgctcatccaccatatgatggagctgcggtctcaaagagtcgctctgcacgtgtggttggtttgaagcaggtctcccctagagttccggctggaaattatcccgtttcacatatttcttacgagctgaatgttctgggctccagaggtccaagaaggatgaactgtgttatggattccatccctgcatcagctgttaaggaaggagggaaaactcctacacagactgaatttccacttagcagccttgactctttcccatcatttccattcttcagatctaaatcagctcggatagacagttcaacgtcgcaatcatccagtcagagggaagataggttggtgctgaagaacaagtctcctaggtggcacgaacaactgcagtgttggtgcctgaatttccgtgggcgggtcactgttgcctcggttaaaaacttccagttggtggcttctgaggacaatggaccagagagccaagagagtgacaaggtgattctccaattcggaaagatcggaaaagatttgttcaccatggactacggttatccaatatcggcatttcaagcttttgcaatttgtctgagcagttttgatacaaaaattgcctgcgaatgaggcaaggtgatttccccccttctctattccccttgcttgtattatggacatgcagtaaaattttattgaacatgcaatttccaatgtcaaggatgattggatgaagctctccacacataaaaaaaaaaaaaaaaaaaaaaaaaaaa

SEQ ID NO: 117 - DNA, 1791 bp, Zea mays
cgaagctacccctgttcctctgcgatttgggctcgtcctgtgtccttcctgttgctcaaaagctcgctcattcgatgtccctgtctgaaaggcgacaaatcccactggaattcggagcacagagctttgaatccaggggccaaaactttttgctcatctcccttgcggaaaagcgcctcctctgcgtctgaaagtcggatcttttttcacagattcgatttgaagttcccgagcagctcgaggaccgcggtgtcggtaagacttgctttgaagatcttgatcaccacaagagatttgctgaatttccggtcactgtactttttccactggacatgtcctttcgcagcatagtccgtgatgttagggaaagctttggtagcttatcaagacggagccttgaggtcaggatttctggtttgcctggtctgtctggtggtcatcatagagggaaatctgttggatctgtgagtgacctgcgcgacagacctgtagtagttgatcaaagcaggtgggttggtcttcctcctgaattgcttcgagatgtaatgagaaggcttgaggaaggtgagagcaattggccatcccggaaaaatgttgttgcctgtgcagccgtctgtggaacatggagagagatatgcaaggatatagtgctgagcccggagttctgcgggaagctcacttttccagtatcacttaaacagccgggaccaagaaatggaataatccagtgtttcataaaaagggacaaatcgacatcaacttattatctttacctatgtcttagccctgttgtcctcagcgaggatgggaagtttctgctagcagctaagaggaatcgccgtacaacatatactgagtacatcatttctgtggatcctaaaagtatatcacgatcaagtgatggctgtgttggaaaaatgaggtcaaattttcttggcactaaattcatcgtgcatgacactcgagcaccacacaatgctgggagccttgtctcctgtgagcgcggcagccgcagaatctcctctaggagggtttcccccaaggtacccactgccagctaccccattgcccgggtgaactatgagctaaacctgcttggcacaagggggcccaggcgtatgaattgcacgatgcattccatcccagcctcaacgctggaccctcaaggcatggtgcctgagcctggccaacccaagcagatcttcgtccctggctcgtcgtccttcgaagattcctttcgcagtgcaaacaacaccccttccagctcaaggttctcggtcgcagaccgctccttggattggagctcctctcgattctcagagacgagcggattggctcagcaggacgacgatgacagtgaccaggctaaggagaggcctttggttctctgcaacaaggagccaaggtggcacgagcagctgcagtgttggtgcctcaacttccatggtcgggtgaccgtggcttctgtgaagaacttccagttgatagctgcaccacaactagattctgaaccgtcacagcaagctcagcagcaaacccagccttcgaattcgtcttcagcatcggatcatgacaaagtgatcctgcagtttggtaaggtcgccaatgacatgttcactatggactaccgatacccactctcggcattccaggccttcgccatctgtttgaccagcttcgacagcaagctggcttgtgaataaattgtacataaagaacaggaatacatgtagattgtatctctgcagtaagtatttacagtgtgtgtgctggtgtagtttaaaaaaaaaa

SEQ ID NO: 118 - DNA, 2202 bp, Oryza sativa
ttggtttagccccatgccacctggttcgggctagatctccggcgagacggccgctgggagcagccgatccggccccgatccgatgggtggcgaggtgccggagccgcggcggctcaaccgggcgctcagcttcgacgactgggtccccgacgaggcgctgcacctcgtgatgggccacgtcgaggacccgcgggacagggaggcggcgtcgcgggtgtgccgccgctggcaccgcatcgacgcgctcacgcgcaagcacgtcaccgtcgccttctgctacgccgcgcgccccgcgcgcctccgggagcggttcccgcggctcgagtcgctctcgctcaagggcaagccccgcgccgccatgtacgggctcatccccgacgactggggcgcctacgccgcgccatggatcgacgagctcgccgcgccgctcgagtgcctcaaggcgctccacctccgccgcatgaccgtcaccgacgccgacatcgccgcccttgtccgcgcccgcggacacatgctgcaggagctcaagctcgacaagtgcatcggcttctccactgacgccctccgcctcgtcgcccgctcgtgcagatccctgagaactttatttctggaagagtgccatattactgataagggtggtgaatggcttcatgaacttgctgtcaacaattctgttctggtgacactgaacttctacatgactgaactcaaagtggcgccagctgatctagagcttcttgcaaagaattgcaagtcattgatttcattgaagatgagtgagtgtgatctttcagatctgattagtttttttcaaacagccaatgcgctgcaagactttgctggaggagcattctacgaggtaggagagctcaccaagtatgaaaaagttaagttcccacccagattatgcttcttggggcttacctacatgggaacaaatgagatgcctgttatcttccctttttcgatgaaactcaagaaactggacttgcaatacacttttctcacaacagaagatcattgtcagattattgcaaaatgtcccaatctactaattcttgaggtgaggaacgtgataggagatagagggctagaagttgttggtgatacatgcaagaagctacgaagactccgaattgagcggggtgatgatgatccaggtctgcaggaagagcaaggaggagtttctcagctaggcttgacagccgttgctgttggttgccgtgaattggagtacatagctgcttatgtatcggatatcaccaatggggccctggagtctattgggactttctgcaaaaatctatacgactttcggcttgtgctacttgacagagaaagacaggtaacagatctgccacttgacaatggtgtctgtgctctgttaagaaattgcacaaagcttcggaggtttgctctctaccttagaccaggagggctttcagatgatggccttagctacatcggacagtacagtggaaatatccaatacatgctactgggcaatgttggtgaatctgaccatggattgatccgtttcgcagtgggctgcaccaaccttcagaagcttgaattgagaagctgctgcttcagcgagcgagctttgtccctcgctgtactgcagatgccctccctgagatacatatgggtgcaaggatacagagcatctcaaacaggccttgacctcctgctcatggccaggcctttctggaacatcgagtttacacctccgagccctgagagttttaatcatatgacagaagatggagaaccctgtgtggatagccatgctcaggttcttgcctactattcccttgctggaaggaggtctgactgccctcagtgggtgatccccttgcatcctgcgtgattgtaaatatgtcaagctgtgtataccttcctatctatccctggggcataagcatggccttgtatggttattgtaagaaccttagcttgccacctttgtgattgtgcccgaataagctactactagtactttagctggggtctatagtgcaataagttgttgtcacttgttctacgtatctaatcctaggaagatgtatactaagttcctctgtaactgtaagagtgatctgtgctttggttgcgagatgtacattgtaagtatcagaaatcatgtgttactggtttttttgccataatatatgcctatataagccgggaaaaaaaaaaaaa

SEQ ID NO: 119 - DNA, 2336 bp, Zea mays
gcaggagacagaggggctccccccccacccccgagcccaaacgcagctagctccccattccacccaagctcccgcagccagatgctctcccccgctcgagccccaccgccgccgcccgtccccgccgccgggtagaccgcccgatccgacggcgcccgccgcacccatgggccgcggcggcgcgcgcgcggcccccgccgccgcggtgccgccctggcacgcgctcccggacgaggtctgggagcacgccttctccttcctccccgcggactcggaccggggcgccgccgcgtgcgcctgccacgcctggctccgcttcgagcgccgctcgcgccgccgccttgccgtcgccaactgctacgccgcgtccccgcgcgacgccgtcgagcgcttccccgccgtccgcgccgtcgaggtcaagggcaagccccacttcgccgacttcggcctcgttccgcccgcctggggcgccgacgccgcgccctgggtcgccgccgccgccgccggctggccgctgctcgaggagattagctttaagcgcatggtcgtcaccgacgactgcctcgagatgatcgcggcctccttcaggaacttccaggtgctgcgcctcgtctcctgcgagggcttcagtacagccggcctcgctgccattgccgctgcttgcagaaatctaagagaacttgaccttcaggagaatgagattgaggattgctctattcattggctcagtctatttccagtatctttcacttctttggtaactctaaatttttcatgcctagagggggatgtcaatatcactgtacttgaacaattagtaaccagatgcagcaacctcaagactctcaagctcaacaatgctatacctcttgacaagcttgctaacctccttcgcaaggctcctcagattgtagaactcggaacaggaagattctctgcagattaccatccggatctcttttcgaagcttgaagcagcatttgctggctgtaaaagcttaagaaggctctctggggcttgggatgccgttccagaatacctgccagcattttattgtgtatgcgaaggcctcacatcactaaatctgagctatgctactgtacgaggccctgaactgattaaattcattagcagatgcaaaaatttgcaactcttatgggtgatggacttgattgaagaccatggtcttgctgttgtggcatcgtcttgtaacaaactgcaggagttgcgggttttcccttctgctcctttcgaagcagctgagcaggtctctttgactgaaagaggtcttgttgatgtatctgccagttgcccaatgctggagtcagtcctctacttttgcagacggatgaccaacgaggcccttattaccatcgcgaagaaccggcccaacttcacttgcttccgcctatgcatcattgagcctcacacaccagattacattacacaccagcctcttgatgcaggttttagtgccattgtggaatcatgcaagggcctcaggcggctttctgtttcaggccttctcacggacagtgtatttaaatccatcggggcacatgctgaccgtcttgagatgctctcgattgccttcgccgggaacagtgatttgggcctccattacatcctatcgggctgcaagagcttgaagaagctagagattagggactgcccatttggtgacaagcccttgctggcaaacgctgccaagctggagacaatgcgatccctttggatgtcgacgtgctcaatgaccttgggcgcatgccggcagcttgcgcgcaagatgccccgtcttagtgtggaggtcatgaatgatcctcgacggggattccccttggactctctaacagatgagagccctgttgagacgttgtatgtctaccggacaatttcaggtccaaggtccgacacaccagcttgtgtccagattctctaaggggcagctgtggtctacaaaggtactatggaagcatccattttcaatcacatcatgtaccttcaacaccttactagcataacctggatcgtctccttgaagtagcaaggctggtgacctcggtaatcctgtcataatctctgcttagctgtacaactgtttctgggagtttagggtgagagactcagggtccctttcaggtgttaataactgtagggaggacactcgatgagttacaggaactactagatagcgtcttgaggaaacttgggtttgttttcttagcgtgcctagttcttttcatgtataaaaaaatatgggatcattccaatgctgccacaatgtactgtactattggaacaattgtacttggagcctctacttttttgaaaaaaaa

SEQ ID NO: 120 - DNA, 1253 bp, Gossypium hirsutum
agggagtggcagtggaagatggccgctagcagcgatcctaacccggagggttccgatgagcagcagaaacgatccgagatatacacttacgaggccccttggcatatctacgccatgaactggagtgtccgccgcgacaagaaataccgtctcgccatcgccagcttgctcgagcattacaacaaccgccttgagattgtccagctcgatgactccaatggcgagatccgatcggacccaaatctctccttcgatcatccttatcccccgaccaagaccatcttcatccccgacaaggagtgccagaaacccgaccttctcgccacgtcctccgacttcctccgcatttggcgcatctccgatgaccactcccgcgtcgacctcaagtctctccttaatggcaataagaacagtgaattctgcggtcctcttacctccttcgactggaatgaggcggagcccaagcgaatcggcacctcctccattgatacgacttgtactatatgggatatcgagagggagacggtggatacccagcttatcgcccacgataaggaggtttatgatattgcctggggcggcgtcggtgtttttgcttccgtctctgctgatgggtccgttagggttttcgacctgcgcgacaaggagcactccactatcatttatgaaagttcggagcccgatactccgcttgtacggttggggtggaacaagcaggacccgagatatatggctactataattatggacagtgctaaggttgttgttttggatatccgcttcccgacactgccggtagttgagctgcagaggcaccaggctagcgtcaatgccatcgcatgggcaccccacagctcttgccacatttgcaccgccggggatgattcccaggccttgatttgggacttgtcctccatgagtcagcctgtggagggtgggcttgaccccatccttgcctacaccgctggggctgaaatcgagcagttacagtggtcatcttcccagcctgattgggttgccatcgccttctccaccaagcttcagattctcagggtatgagtgaatgggattggtatattgggtcgtattcaatgctaaattgctaattcatagtctagtaattgtactcagatctagaggaataacaagattgttgctgtcgttgtgtctgagctgactaaaagtcccaaaactgttttggttttcctgttgtttcgtttgtcttcaacatgtttggatagttgattgaaaaa

SEQ ID NO: 121 - DNA, 1716 bp, Zea mays
ctgacatctcagttgctgaacgcctgaaccgcaagtcatccatgacctcttctattccgaagctgcttctcctcctcttctttctcagccatcgctctcccattgctcgcgcaggcgatgatggcagctacaaggttctgtccatgggctctccgagaactgactccgtctgttcccagtccaaagcggttccttcgtcgtccgccggtgccgccacggtgcccttgcatcaccgtcacggcccatgctcgccgttgccgaccaagaagatgccgacgttggaggagacgctccaccgcgatcagctccgagctgcctacatccagcggaagttctcaggcggcggtggcgctggtggtgacgtccagcgatcggacgccaccgtgccgacggccctgggcacctccctgaacacgctggagtacctgatcaccgtaggcctgggctcgccggccacgtcccagaccatgctcatcgacaccggcagcgacgtgtcgtgggtgcagtgcaagccgtgctcgcagtgccactcccaggcggacccactcttcgaccccagctcgtcgagcacgtactccccgttctcctgcggctccgccgactgcgcgcagctcggccaggaaggcaacggctgctcctccagctcccagtgccagtacattgtcacgtacggcgacggctccagcaccacggggacctacagctccgacacgctcgccctgggctccagcgccgtcaggagcttccagttcgggtgcagcaacgtggagtcgggcttcaacgaccagaccgacgggctcatggggctcggcggcggcgcgcagtcgctggtgtcacagacggcggggacgctcggcagggccttctcgtactgcctcccgccgacaccgagctcctccgggttcctcacgctcggcgctgctggcggtagcggaacctcgggcttcgtcaagacgccgatgctcaggagcagccaggtccccacgttctacggcgtgcgcctccaggccatcagggtgggcgggaggcagctcagcatacccgcctcggtcttctccgctgggacggtcatggactcgggcacggtcatcacgcggctgccgccgaccgcctactcggcgctgtcgtcggcgttcaaggccgggatgaagcagtacccgccggcgcagccgagcggcatcctcgacacctgctttgacttcagcggccagtccagcgtcagcataccgtccgtcgcgctagtcttctccgggggcgccgttgtcagcctcgacgccagcggcatcatcctcagcaactgcctcgccttcgcgggcaacagcgacgacagctccttgggcatcatcggcaacgtgcagcagcggacgttcgaggtgctgtacgacgttggccggggcgtcgtggggttcagggctggggcgtgctgatcgatcgtgatcggcgcaaggacattgacaataccggccgggagtacgtactgtgctcgtttgggttgcgagtgcaacgtaaatggaagaagtgcaaaacatatacatactacttcgattttaattatctttgcgatagcatgcaataacgtcatgcatgcaagtgtgcaaactactaaaagctaaaagataatcttaatgtcacctgattgatgactataaaagattaatgatatattattgtattgcgcttggtgcgatgattaattaaaaaaaaaaaaaaaaaaaa

SEQ ID NO: 122 - DNA, 1735 bp, Oryza sativa
tattgaagaagcttccagctgagctgggggatcaaaatggaggtgcttcttccccttctccttgcctgctctctcctcttcaccattgcaacccctatcagagacatcaccgacgtttgtgcctcacagatcagtgatttccagcacctgaacagctccggactgcacctgacgctgcaccacccgcagagcccctgctcgccggcgccgctcccctccgacctccccttctccgccgtcgtcacccacgacgacgcccgcatcgcccacctcgcctcgcgcctcgccaacaaccacccgacatcgccgtcgtcatcgtctctcctccacggccaccgcaagaagaaggccggcggcgtcggcggctcgcaggcgtcgtcgtcgtccgtgccgctgacgccgggcgcgtcggtggccgtcggcaactacgtgacccgcctgggcctcggcacgccggcgacctcctacgtgatggtggtcgacacggggtcgtcgctcacctggctgcagtgctccccgtgctcggtgtcgtgccaccggcaggccggcccggtgttcgacccgcgcgcgtcgggcacgtacgccgccgtgcagtgctcctcgtcggagtgcggcgagctccaggccgccacgctcaacccctccgcctgctccgtctccaacgtctgcatctaccaggccagctacggcgacagctcctactccgtcggctacctcagcaaggacaccgtctccttcggctccggcagcttcccgggcttctactacggctgcggccaagacaacgagggcctcttcggccgctccgcggggctcatcggcctcgccaagaacaagctctcgctgctctaccagctcgccccgagcctcggctacgccttctcctactgcctcccgacctcgtcggcggcggcgggctacctctccatcggctcgtacaaccccggccagtactcgtacacgcccatggcgtccagctccctcgacgcctcgctctacttcgtcaccctgtcggggatctcggtcgccggggcgccgctcgccgtgccgccgtcggagtaccgcagcctgccgacgatcatcgactccggcacggtgatcacgcggctgccgccgaacgtgtacacggcgctgagcagggccgtggccgcggccatggccagcgccgcgccgcgggcgccgacctactccatcctggacacctgcttccggggctccgccgcggggctgcgcgtcccgcgcgtggacatggcgttcgccggcggcgcgacgctggcgctgtcccccgggaacgtgctcatcgacgtcgacgactccacgacgtgcctggcgttcgcgccgaccggcggcacggcgatcatcgggaacacgcagcagcagacgttcagcgtggtgtacgacgtcgcgcagtccaggatcggcttcgccgccggcggctgcagctgaggacccaaactgcagctggccgactcaagctaggtaaaagagcaatgctgcttcttctgctgctgccgccgcctcctatctctgctcaggcacagaagtgacaacttcttaactgcaaattcattcatcacatgtaaatgcatatacatgtgccaggaagttacgagtgtggctctaggacctagttttacatgtcataaacaaatatagatgtacaaataaatacagggtaactactttaggtgaagataatacttatcaatgtgaaagattattatgttaaaaaaaa

SEQ ID NO: 123 - DNA, 884 bp, Oryza sativa
aaatccagccaagaagatcgagaccggatacagctagcaatccatccaagaagatcgagagagcggatacagctagcctagctacgcgaaggatcagatcatcggcatggagctggagcttgggctggcgccaccgaattccggtcatctcgtcgtcgacgagctcagcagcagcagcagcagcggcggcggcagcggcagcgcgccggtgtctgcctcgtcggccgggaagaggggattcagggaggcgttccaggagacgctgctgctcttcgacgacggcagctgctgcaacaccagcgacgacgattgcaggaggaggaagaagacggtggtggggtggccaccggtgagctcggcgcggcgggcgtgcggcggcgccaactacgtgaaggtgaagaaggaaggcgacgccatcgggaggaaggttgatttggccctccattcctcctacgacgagctcgctgccacgctcgcccgcatgttccccaccaacgaccaccaaggcgagaagaaaatggccaatgatgatcatggcgatgccgctggacctgtggtcacctacgaggatggtgatggggattggatgctggttggggacgtgccatgggatgattttgcacgatctgtgaaacgcctgaagatactgggttaactgaactgaaggagatgcatgcgtgagttgatggagcacagctcggttttggttgcctggcatctgcgtgtgggtgtgcactgatgtatgtacatgttttcgttttcagtcaggatgttaggacgagagaaagagctttctgtcaaagactatatactgctagcttatatatactgtagttgggcacatctcatgtgtgcccagggctaggttttgagaaaaaaaaaaa

SEQ ID NO: 124 - DNA, 958 bp, Oryza sativa
gttcgatcaagataatcgagcaaaatccatcagagttctaacattcgcgcgtgaatttcgaggttaatttttgaagcttaggatcaatggcttcccaccaggaccaggctagctaccgcgccggcgagaccaaggcccacaccgaggagaaggcggggcaggtgatgggggcgagcaaggacaaggcgagcgaggcgaaggacagggcgtcggaggcggcggggcacgccgccggcaaggggcaggataccaaggaggcgacgaaggagaaggcgcaggcggcgaaggagagggcgtcggagacggcgcaggcggcgaaggacaagacctccagcacgtcgcaggcggcgagggacaaagccgccgagagcaaggaccagaccggcggcttcctcggcgagaagaccgagcaggccaagcagaaggccgccgagaccgctggcgccgccaagcagaagaccgccgagacggcgcagtacaccaaggactctgccatcgccggcaaggacaagaccggcagcgtcctccaacaggcgagtgagcaggtgaagagcacggtggtcggcgccaaggacgcggtgatgagcacgctggggatgaccgaagacgaggccggcaccgacgacggcgccaacaaggacacctctgccaccgccgccgccacggagacgacggcgagggatcactagacgccgtgaatgatttccctttgggtctatttatgtatgttttcacttcaaattcggtgcaagtttgaatttgtttttgtgtcgttttgagtctgtatcgatgctgtatgaagtggtggtcgtcgcaggggaggatttctgacgggtgtgggtgatgtgtactgatgatgttcagttgttttcgtcagagtttctcgtctgtgttctgtttattatggcgtaacaataataaaagtttgggcctaaagcccgcatttgtggtttaaaaa

SEQ ID NO: 125 - DNA, 958 bp, Oryza sativa
gagtgtgtgtgactcgatccagcgtagtttcagttcgtgtgttggtgagtgattccagccaagtttgcgatggcttctcagcaggaacgggctagctaccacgccggcgagaccaaggcccgcgccgaggagaagacggggcgcatgatgggcacggcgcaggagaaggcgcgggaggccaaggacacggcgtccgacgccgcggggcgcgcgatgggcaggggacacggcgccaaggaggcgaccaaggagaaggcgtacgagaccaaggacgcgaccaaggagaaggcgtacgaggcaaaggacgcggcctccgacgccaccggccgcgccatggacaagggccgcggcgccgcgggcgccacgagggacaaggcgtacgatgccaaggacagggcggctgacacggcgcagtccgccgccgaccgcgcccgcgacggcgccgggcagaccgggagctacattggacagaccgccgaggccgccaagcagaaagcggccggcgccgcgcagtacgccaaggagaccgcgatcgccggcaaggacaagaccggcgccgtgctccagcaggcaggggagcaggtgaagagcgtggcggtgggggcgaaggacgcggtgatgtacacgctcgggatgtcaggcgataacaagaacaacgccgctgccggcaaggacaccagcacctacaagcctggaactgggagtgactaccagtaatacggtataagaagcatgtgtcgtctttggcactgatgccaaagtgtacgtgttgtatcctcttttttaagtttcagctcgacttcgacgtgttcggtgtcacactttggtttttcagttgtgctcaactgttcatgtttctggttccatggagggccagtgtggaggtcaatgtttaagctttcgttttaaaatctgataataaagttggttaagacctgaaagcgttaaaaaaaaaaaa

SEQ ID NO: 126 - DNA, 1156 bp, Zea mays
acccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctggcatgcaggctcttcccatgccggcgtgcttccttccgccgcgcccgcaggcagcgacctggacccgcctctgcttgcaggctgcgccaagatcgtcccaggcatacgacaacgcgccggaagaccggagagaaataggggacaagtacaaggacgcggcggaggaggcgaaggacgccaccggggacgccaaggagcacgccaagaggatggccggggagacgaagagcagggcgcaggacaaggccggccgcgtggcggaccaggcgtcgggcatggccgagcgggccaaggaccaggcgaagggcgtggcggaggacgccgcggacacggcgtcccgggcgacggagcgagcgaagaacgagacgcgtgacgcggcgcgggaggccgcggacagggcggggcacgtgaaggagcgggccaaggaggcgggacacgaggccgcggaccgggcgcagggggcggcgaaggcggccaaggaccggaccggggaggcggcggggcgcgccatggacagggccggggaggccaaggaccgggccgtggaggggaccgcgtcgtacggggagaaggtggtggagatgaccaaggagggcgcggggaaggtggccgagacggcgcaggccatcggggacatggcgaagcaggcggcgcggagcacctgggacgcggccaaggacaccgcgcacggcgtcaaggagcgcgtggtccccgacgcggaggacgtggacgccgccgtgaaggagcgggaccggatcgcgcgggatgtggacagggtagagcgggagcggaacatgagggaggccagggagaagggctcgggcttgccgtaggcccagctccaattttccctctccagaagacgaattttactcaactagctagctgaataaatgtttggcgatacatcgtgcgcgcgccagtttggttgtgttgaataattagacaaattccaaattaaatttcgaataaaaaaaa

SEQ ID NO: 127 - DNA, 1009 bp, Zea mays
cgagttaacgaaagccttttatccaagctcagggaagggaagctcacagtttcgttggatccaatcttttatccaagctcagcgatggcttctcgtcagcagcatcctactagctaccacgccggcgagaccaaggcccgtgccgaggagaagacgggtcaagtgatgggggcgacgcaggagaaagggagggaggccaagcacaaggcgtccgacgcctccgaccgcgccatgggaatgggccacgacgccatggaggcgaccagggagaaggcgcgcgccgccgcggaccgaaccatggggatgggccacgacgccggggaggcggccaaggacagggcgtaccgggccaaggacgcggcctccggtgccgctggccgcgccagggacactgcgtccgacgcggccggcgctgccggggaccgcgcccgcgacggcgcgcagcagaccgggagctacgtcgcgcagacggccgaggccgccaggcagaaggcggccggcgccgcgctgtacgccaaggacaccgtggtggccggcaaggacaagaccggcgccctcctgcagcaggcaggggagaaggtgatgagcacggccgtgggggccaaggacacggttgtcagcacggccgtgggggccaaggacacggttgtcagcaccgccgtgggagccaaggacgcgatgatgaactcgctcggcatggccggcgaggacaaggacggcaccaccaccaccgacgccggcaaggacaccagcacccgcaagcctggcagggactattagaggacacggcagccaaacttctcagtgtttctgttccagaagtttctgatcccatcatttaggttcaaaagtttctcatttcatttcaaactttcagtgtttggtgcatgctgtaaactctcttcaggacgggtcgtttgacatttgtgtcgactgaagcctccgcgctttcgactcaacgatgtatatgtaataataaagtcgcaaagctgttgttttattttaaaaa

SEQ ID NO: 128 - DNA, 2238 bp, Zea mays
cttatctcctcctccaccccgagatatttccacgtctcctccgccaccatggagtccggcctcgttgcaagccaccgcctccgcgtcccgcccccctccgcctccgccgggcaccaccacctcatccgccaccgccacgcccacgccccggtggccgctgcgcccctccgcctcagtctcccgcgccacctcccccggtccaccccgctccgcctgcccgccgcgctcccgctccgccactgcctcccgcccctccgcgccgcctccgccgccgccgccgcagtcccagcgcccggggacgacgcgtcgcccaagttcctgggcgtggagacgaagacaatcaagaagatcgtgcccctggggctcatgttcttctgcatcctcttcaactacaccatcctgcgggataccaaggacgtgctcgtcgtcaccgccaagggcagcagcgccgagatcatcccgttcctcaagacctgggtcaacctgcccatggcagtcggcttcatgctcctctacaccaagctcgccgatgtcctctccaaggaggcgctcttctacgccgtcatcttcccgttcatcgccttcttcggcgccttcgcctacgtgctctaccccatgcgcgacgccatccaccccactgcgctcgctgatcgcctcctcgcctcgctcgggcccagcttcctcggacccgttgccatcctccgcgtctggagcttctgcctcttctacgtcatggccgagctctggggcagtgtcgtcatatccgtccttttctgggggtttgcaaatcagattactacagttgaagaggccaaagagttctacccgctgtttggccttggtgccaatgtggccctcatcttctctgggcgcacggtgaaatatttctcaaacatgaggaagaatttgggtcctggagtggatggttgggcaatttcgttgaaggccatgatgagcatagtggttgtactgggtcttgtcatcaccggtatctattggggagtgaacaagtttgttattgataactcatctgtgcccgtggttgagcggaaaaagaaggacaagccaaagctcagcatgggtgagagcatgaaggttctgttgtcatctcggtatgtgagggatcttgctacattggttgttgcttatggaataagcattaaccttgtcgaggtgacatggaaatcaaaactgaaagcacagttcccaagcccgaatgaatattcttcattcatgggcgatttctcaactgccaccggcatagctacatttacaatgatgttgttaggaagagtgatcctcagaaagtttgggtggggagttgcagctacaatcacgcctgcagtgttactcctcacaggagttgggttcttctcactgattttgtttggtgagccattgactcctcttatgaccaagtttgggatgacacctttgcttgcggcagtctatgttggagcaatgcagaacattttcagtaagagtgcaaaatacagtctgtttgatccttgcaaagagatggcatacattcctttggatgaggatatgaaggtgaaaggtaaagcggctattgatgttgtgtgcaaccccttggggaaatctggaggtgctctgatccagcagttcatgatcctgtcattcggatctctcgcgaactcgacaccctaccttggcggaatactcctggtgatcgtccttgcatggctgggtgctgtaaggtccctcgacctgcagttctcttccctggcgaagcaagagctcggcagagagaagctgctgaaaacgcaggccgtcgaaacggtcgccgaagtagtcggcactggaaacggttctctccaagaaactctagctagtgagccgtctgcaaatggcgcggccaccaaacagtcgcaagaacctgagagcacagcccctgagaaatcaggccagcagtctcaataagttctccccccaagaaatttagctagcacgagccttttggaggaaccggaagtttcttatctggagctactgaagaaggcaggaatcatgccagaaataagaagggcctgttcttcttgtgttgttgtagcgtttttgtttttaaacttcgccgtatctgtagctgtttgtttcattccataggtatgaactgtttatgttcgttattaaaattttgggaggtctgcttcatcgtaatcttcattagcagctggtccttgttgtggaaaaaaatattttgcatggttttgataaaaa

SEQ ID NO: 129 - DNA, 1400 bp, Xylella fastidiosa
acgaacggtgcagccaacgcgccccagctcgccgctggcgccaaggagcagtaatgccgggcgccgcaccgacttcaccgtcccgacagcccctgttgcagcgcttggcgggcgtgcgcccggaggaagcgccggccgtcctgtggtcgatgctctacgtcgtcgcgctgttcctggcgtactacgtgctgcgcccgatccgcgacgagctgggcgtggctggtggcgtgcagaacctgccgtggctgttcaccggcacgctgctggcgatgctggtggccagccccttgttcgcgctggcggtgcgcagcctgccgcgccggcagttcatcgccttagcctaccgcttctttgcagcgaacctggtgctgttcgcgctgctgctgcacttcgccgatccgcagtggcaggtgtgggtgggccgggccttcttcatctgggtctcggtcttcaacctgttcgtcgtgtcggtgttctggtccttcatggtggatctcttcgacagtgagcagggcaagcgactgttcggactgttcgctgccggcgccacggcgggcggcctgctgggctcggccatcacgtccggcctgatcgagcacctggaccgctcctggctgatggcgatcgccatcgtgttcctggaactggcagtgctcgcctcgcgccggctgtcgcgcatcgcgccggcgttccagcacgccgcgcgccgcgacaacccggatcagccgctgggaggcggcatcttcgcgggcatggtccacacgctgcgctcgccctacctgggcgggctggcgatcttcatcctgctgtactcggtcacctcgaccttcctgtacttccagcaggccagcatcgcgcaggcctcgttccccgaccgggcggcccgcacggcgttcttcgccaacatcgacctcatcgtcaacgcggtgacgctggtgttccagctcttcgtcacgggccggatgatggcgaccgtgggcatcgtggcgaccctgtgcgtgctgcccctggtgagcctgctgggcttcgcggccctggccgccagccccagcgtcgccgtcatcgtggccgcgcaggtggcccggcgcgtggctaacttcgcactggcccggcctgcccgcgaaatcctgttcacctccagcgcccgagaagaccgctacaaggccaagaacttcatcgacaccgtggtgtaccggggcggcgaccagatcgccagttggggctatgcgggcctgatgggcctgggcctgaccctcgcgcagattcccatgatcgcggtgccgctgtcggccgtctggctgggcctgagcgtctggctggggcgcacccaccaggcgcaggagcggcaggacgccgccaccgcgccatccatccactgaggacacgaccatgaagccttc

SEQ ID NO: 130 - DNA, 1350 bp, Saccharomyces cerevisiae
gttcttttttgtgtgctcttttatacttcagaatcatacattaacatacatataagcaaatagccatgtcttccaacgcccaagtcaaaaccccattacctccagccccagctccaaagaaggaatctaactttttgattgatttcttaatgggtggtgtcagtgccgctgtcgccaaaactgctgcatctcccatcgaaagagttaaacttttgatccaaaaccaagatgaaatgttaaaacaaggtactttggacagaaaatacgcaggtatcttagactgtttcaagagaaccgctacacaggaaggtgttatctcattctggagaggtaacactgctaacgttatccgttatttccccactcaagctttgaatttcgccttcaaggacaagatcaaggccatgtttggtttcaagaaggaagaaggttacgccaaatggtttgccggtaacttggcatctggtggtgctgctggtgccttgtcattactatttgtttactctttggattatgcaagaactagattggctgctgactccaagtcctctaaaaagggtggtgctcgtcaattcaacggtttgatcgatgtctacaagaagaccttaaaatctgatggtgttgctggtctttacagaggtttcttaccttctgtcgttggtattgttgtctacagaggtctatacttcggtatgtacgattctttgaagcctctattgttgactggttctttggaaggttcattcttggcttcattcttgttgggttgggttgttactactggtgcttctacatgttcttacccattggataccgttagaagaagaatgatgatgacctccggtcaagctgttaagtacgacggtgcctttgactgtttgaggaagattgttgctgctgaaggtgttggttctctattcaagggttgtggtgctaacatcttaagaggtgtcgcaggtgctggtgttatctcaatgtacgaccaactgcaaatgatcttgtttggtaagaagttcaaataagtctaatctggcttgattcttaatctaaattctttctcacattttcctttttttcttctttggatttttggtgtttaatgagtgacacgatttgttttgataatattattatcctcctatttttttagaaattcttttcaacaagaatcaaagattcataaaaaaagaaaacgatgaaattttttgaacaacttttacgtataaagaagaaaaaaaaaaaattctaaatatccagtaaatagttttatattagtagtattctttcccactttttaaatgtcatcacatgatgtttcttataaaatgcaatttttttattacttaatca

SEQ ID NO: 131 - DNA, 1001 bp, Saccharomyces cerevisiae
gaacaagcaaaaaacatgaaccaagcaatagacttcgcacaagcaagcattgactcctacaagaagcacggcattctggaggatgtaattcatgacacaagctttcaaccctccgggatacttgccgtagagtactcatcaagtgcacctgttgccatgggtaacacgctgcccactgagaaggcacgttccaagccccaattccagttcacgttcaataagcaaatgcaaaaaagcgtaccacaggcgaatgcgtacgttccccaagacgacgatttgttcacactggtaatgaccgatccggatgctccctctaagacagatcacaagtggtctgaattctgccacttggtagaatgcgacttaaagctgttgaatgaggctactcacgagacctccggagcaaccgaattttttgcatcagagttcaatacgaagggctcgaacacactaatagaatatatgggaccagctccacccaagggatccggtccccacagatatgttttcttgttatataagcagcctaagggcgtggactcatctaagttctcgaaaattaaggatagaccgaactggggttacggcacccctgccaccggtgttggcaaatgggctaaggaaaacaacctgcaactagttgcctccaatttcttctatgcggaaacgaaataggtatatatatatatatatgtatatgtatttattttttagatttcagtgcttttcacttgactttttattatttttgttttatttatgtttttgtcacaaacgcgcacatgtttgtagggagtaatgtcattgtcaaacaaaacacataagaaaaacatggtgagattattaaaaaagtgtataagtttataaaatgtttataatgattatataagtttgggttagccgaacaaaaccttcaccaattccatataaacaccgatctggaagtcgtccagtttcaagcgattcagttcaggggccacgacaattccagtgttgtccat

SEQ ID NO: 132 - DNA, 1001 bp, Saccharomyces cerevisiae
tgctcattattggaagtgcgcaccaggtgaggaattgaatgttgccatcaattgtttgagtaaacactgcccatctgccactttcggtacccatccgagtacttagtaatagaaatatatattatgtctagtgccatcgttgctaaactgaacaaagaggacatcattaaggacaccgtcaaggacttggcgttcgagattcttggtgagttgtcggtttcgtacgttgattctgacgacatcaaattgggcaatcccatgccaatggaagctacgcaagccgctcctaccatcaagttcacgcccttcgataaaagccaattgtcagccgaggataaactcgctttgttgatgactgacccggacgcgccctctagaacagaacataagtggtcggaggtttgtcactacatcatcactgatattcctgtcgagtacggacctgggggagatattgccatttcggggaagggtgtcgtgagaaataactatattgggcctggtccaccaaagaactccggttatcacagatacgtgttcttcctgtgcaagcaacccaagggagcggattcgtccacttttaccaaggttgagaacattatctcctgggggtacggtactcctggtgcgggtgcctatgactatatcaaggagaacaatctgcaactggtcggtgccaattattacatggtcgaaaacacgaccgttgatttcaactatgacatgtaaggtgcagcaaccggctcgtatagatacggataagatagagtatattgtgcaaacgcgtatatgaaatagtgaatatatacatgccgaacggttccgttttttttttttttggctcgttgatttttcctatccctttgaacttttctatcttttaagggatagaggggctgttcagggaaggaaagatctcaattggtatataaaaagggggcagcaagaaacgaattgcagtgctccttttccctaccagtgcatcaatacaagaacaagag

SEQ ID NO: 133 - DNA, 3268 bp, Zea mays
gcccgatctcatctcgccggcggcggcgatggcgggcaacgataattggatcaacagctacctcgacgccatcctagacgccggaaaggctgccatcggcggcgaccggccttccctcctcctccgcgagcgcggccatttctcccccgcgcgctacttcgtcgaggaggtcatcaccgggtacgacgagaccgacctctacaagacatggctacgcgcgaacgccatgcggagcccgcaggagaggaacacgcggctcgagaacatgacgtggaggatctggaaccttgcaaggaagaagaaggagttcgagaaagaagaagcttgtcgtatgtcaaaacgccagccagaaactgagaaaacacgagctgatgctactgcagatatgtctgaagatctctttgaaggagaaaaaggagaagatgctggtgatccatctgtcgcatacggggacagcaccacggggagctcacctaaaacaagttcaattgacaagctatacatagtattgatcagtctacatggtctggtccgtggtgagaatatggagcttggccgagattcagatacgggtggccagatcaaatatgtggttgaacttgctaaagcattaagttcatccccaggagtttaccgggttgacctgctaacaagacaaatcttagcaccaaattttgatcgtagttatggtgaacctaaagaattattggtttcaacaagtggtaaaaattataaacaagaaaagggagaaaatagtggtgcatatataattcggataccgtttggtccaaaagacaagtatctagctaaagaacatctatggcctttcattcaagaatttgttgatggtgcactcagccatattgtgaggatgtcaaaagccataggtgaagaaactggccgtgggcatccagtatggcctgctgtgattcatggacattatgccagtgcaggaattgctgctgcgttactttctggagcacttaatcttcctatggcgttcacaggacattttcttgggaaagataaattggaagggcttctcaaacaagggagacaaactagggaacagataaatatgacatacaaaataatgtgccgaattgaggccgaggagctatctcttgacgcatctgagattgtcattgcaagcactaggcaagaaatagaagagcagtggaacttgtatgatggttttgaggttatacttgcaagaaagctccgagcaagagttaaacgtggtgctaattgttatggccgttttatgcctcgtatggttataattcctcctggagttgaatttggtcacattattcatgattttgatatggatggcgaagaagagaatccatgcccagcatctgaggatccacctatttggtctcagataatgcgcttctttacaaatcctaggaagcctatgattctagctgttgcccgcccttatcctgagaagaatattactacacttgtaaaggcatttggtgaatgcaggccattaagggagcttgccaatcttacactgataatgggaaaccgtgaagctatatctaagatgcacaatatgagtgctgctgtcttgacatcagtgcttacattgattgacgaatatgacctgtatggtcaagtggcataccccaagcatcataaacactcagaagttcctgacatttatcgtttagctgcaagaacaaagggggcttttgtaaatgtagcttacttcgaacaatttggagttactctgatagaggctgctatgaatggtttgcctataattgcgacaaaaaatggagcccctgttgaaattaatcaggtcctgaacaatggtctccttgttgatccgcacgatcagaatgccattgcggatgcactatataaacttctttctgataaacatctttggtcaaggtgcagagagaatggactgacaaatattcaccaattctcgtggcctgaacattgcaagaattacctgtcaaggatactaactcttggcccaaggtctcctgctattggtaacagagaggagcggagtaatacacctatttcaggaaggaagaatatcattgttatttctgtagactctgttaacaaggaaggtctagtcaggataatcagaaatgctattgaggtcatacataaagaaaacatgtcgggttcaactggttttgtgctgtcaacttccttaacgatatcagaaatacattcactgctactatctggaggcatgcttcccactgattttgatgctttcatctgcaatagtgggagtaacatttactatccttcacattccggagaaacgtcaaacaactccaagattacatttgcattagatcaaaatcaccagtcacatattgagtatcgttggggaggagaaggcctaaggaaatatcttgtgaagtgggccacttcagtggtagaaagaaagggaagaacagagagacaaattatttttgaagatccagagcactcttcggcgtattgtcttgcatttagagtggttaatcccaatcatcttcctcctttaaaggagttgaggaagttgatgagaatccaatctctccgttgcaatgcattatataaccacagcgctaccagattatctgtagtccctatccacgcatcacgctctcaggccctaaggtacctgtgtatacgattggggatagaagtgccaaatgttgcagtcctcgtgggtgaaagcggcgattcagattacgaggaactgctggggggtctccataggaccgttatcctaaagggcgagttcaacatcgccgcaaacaggatccacacggtgaggagataccccctgcaggatgtcgtcgccctcgatagctcaaacatcatcggtgtcgacggctacaccacggatgatctgaggtctgccctgcagcagatgggtatactggcacggtaacaccttccggagcttccgtttccactaccaggtcaacgaagagaaacgagaaaacagacagaatggtgacgaaacaagtgcgaccgtttccatgctcgatgggaatgccgattttgcattgtaggctgtagcggttgtgttcgtgtgtgtgtgcccgcgcgcggtggtggcctattcttgtgctgtgaataactgcccctcctttgtttgtgatatgccaaaattttgaagtgagtacagtacaaccaaacatgttgatgatggaaaaacgaatggagaaaggggaaaaacaaacaaaaatggtttgggaaaaaaaaaaaaaaaaaaaaaaaaaaaaaaaaaaaa

SEQ ID NO: 134 - DNA, 1081 bp, Oryza sativa
caccgatcgatcccggccattccacggtcgatcgatcgtctccggccggccggtcgccggtgggaattgaagcagctagctgacatacatacatggcgggcgtgtgggtgttcaaggacggcatcgtgcggcgcgtggagaaccccggcagcgaggaatcgtcgtcggcgggggacggcggcggaggcgggcggcggaaggtgctggtgcacgtgccgagcggggaggtggtggcgtcatacgaggtgctggagcggcggctgcgggagctcgggtgggagaggtacctcaccgacccgtgcctcctgcagttccaccagcgctccaccgtgcacctcatctctgtcccccgcgacttctccaagttcaagctcgtccacatgtacgacatcgtcgtcaagacccgcaacgtcttcgaggtccgcgacgccgctgcccccgccgtctcaccggcgacctagctgctgatccgagatccatccatccatcgatcagacgacagcttatagctacagcagtccacatgagcttgcctgcctgctattataagagtgtaagtatgtatatatatactggtatgcgtgtgatcgatcaaggatcgatgtacacacaaatgatcagcatgcacagatcactagatcgagatctatagctcgatcgatttggggtttctcctgccggcgttgcagcttttggattagatgttgcgccggtgaggacattgctataggttaattggcttttgggtatatttctgcataaataatgcatcaatagagagcacaacatgtgtatgcatacttatatttatatgtacacatgcatacatatataagtacatacataggggccgggggcaacatgcaggttgcagagattctgccagagatcaagcagaaaggggatcgccgatgccctactctcaaccgtacctttttactgtttaatttggaataatttggattgtctcaatacaaattatgtaccagttttttcacatatgatttgcacgacattttaaatattgtaatctgtacacataatattgatcggtctctctttccctgtggccaaaaaaaaa

SEQ ID NO: 135 - DNA, 826 bp, Oryza sativa
agcttctagctgtgatcaagcaaagaagaattgaaaaaaaacatatatatattatatatatggcaggggtgtgggtgtttgaggatgggatggtgaggagggcagatagcgaggcgccgtcgagagggcgcggtgtcggtggtggaggtgggggagggaaggtgcttgtgcacgtgccgagcagcgaggtggtgacgagctacgaggttctggagaggcggctgcgggagctcgggtgggagaggtacctcaacgacccgtgcctcctccagttccaccagcgctccaccgtccacctcatctccgtgccccgcgacttctcccgcctcaagctcgtccacatgtacgacgtcgtcgtcaagacccgcaacgtcttcgaggtccgtgacgccgccaccactgcttccccgccatgatcgcatcgatgtctatgctttgatcatcatcgatatgaccttcctcgactccgggctcaggccagacacgccgccatggcgcctacaatcgtatgtgtgtattgtatgaatctcaattcaggtaatgaatgattgtatatcatatgatttgtaattctgtacaggtataacgtatgcgtatatacgtacgtgtgcgatcgatcgggtgtgtgtgatatatattaaaataagcgtggctggtttaattgcaagtgagtgtttagttatttaattatacgagagccatgagcacgtgtgtagctagctttggagtcttgtactttgtggtttggagccattgcttgactgattccgtggcacgaatcaaaaaaaaaaaaaaaaaaaaaaaaaaaaaaaaaaaaaaaaaaaaa

SEQ ID NO: 136 - DNA, 766 bp, Zea mays
ctcgagccgattcggctcgagatcgatccccacagagccagggcgtgcaggcgggcgggcgggcgagcgagcgagaggaaaagccaaggcggcagcagtaggcagccaccatcaataaagaaggtccaagcatgtcgggggtgtgggtgttccggaacggcgtggtgaggctggtggagaacccgacgtcggggaacgcggcggcggcgccgggcaagcgcaaggcgctgctgcacacgccgtccggggaggtggtcacgtcctacgcctcgctggagcgcaagctggcggcgctcggctgggagcgctactacgccggcggcggagacggcggcggcgccggcctgctgcagtaccacaagcgcacctccgtcgacctcatctcgctgcccaaggacttcgcccacttcggctccgtccacatgtacgacatcgtcatcaagaaccgcgacgccttccgcgtcatcgacgcctaattataagctagcggatgcagcagatgacagatactcacctctcctcgctcgctcctcgctccggccagtgcatcatctacctcgctgtagctacctacctaccctaatataatagcagctatagccttcgtcacccattgctcgatcgatttagttgccgtgtcgatctcagtgccgcgttggtctaaattaatatatatagatcatgtactgatgatttggtttgttcatgcatgttttctctattttacatcttgtgttgctgggtcaaaaaaaaaaaaaaaaaaaaa

SEQ ID NO: 137 - DNA, 540 bp, Zea mays
cagaccgccgatatataggatcatcgatcaatgtctgggtcgggcgccggcgtttgggtgttcaagaacggcgtgatgcagctggagcagccggcggcggcgagccggaaggcgctggtgtacgtgccgacgaacgaggtggtgcggtcggtggaggcgctggagcggcggctggggacgctggggtgggagcgctactacgagaaccgaagcatcgtgcagctccacaagcgcgacggcggcgccgacctcatcaccatcccgcgcgacttcgccaacctccgctccacccacatgtacgacgtcgtcgtcaagaaccgcgaccacttcaaggtcgtcgacgcctaataagctctaccagctagcagctagctgcacccatccatcgtccacgatcgatcttcttatctcgccaattcggcatgcatgcgttgcgtgtgccagcagtgtacagctgctgatcgatatgcctgcagcagttatatagcaagtctagctatatatactgaatatatacgaacaaacatatgcatataaaaa

SEQ ID NO: 138 - DNA, 1218 bp, Zea mays
cggctcgagccgtccccgttttccacttttgcctccgccccaattcggataacaaacccctccgcctcgtcgcgtctcctcccagccgagccgatccggtagagagagggagagggagggactgagggaggaggagctgggttccggtcccggccgcccggccggctgcgcgattcgattgcagctctcgtccccgggcggcgtccaggatggtgcggggcaagacgcagatgaagcggatagagaacccgaccagccgccaggtcaccttctccaagcgccgcaacggcctgctcaagaaggcgttcgagctctccgtcctctgcgacgccgaggtcgccctcgtcgtcttctccccgcgcggcaagctctacgaattcgccagcggaagtgcgcagaaaacgattgaacgttatagaacatacacaaaggataatgtcagcaacaagacagtgcagcaggatattgagcgagtaaaagctgatgcggatggcctgtcaaagagactcgaagcacttgaagcttacaaaaggaaacttttgggtgagaggttggaagactgctccattgaagagctgcacagtttggaagtcaagcttgagaagagcctgcattgcatcaggggaagaaagactgagctgctggaggagcaagtccgtaagctgaagcagaaggagatgagtctgcgcaagagcaacgaagatttgcgtgaaaagtgcaagaagcagccgcctgtgccgatggcttcggcgccgcctcgtgcgccggcagtcgacaacgtggaggacggtcaccgggagccgaaggacgacgggatggacgtggagacggagctgtacataggattgcccggcagagactaccgctcaagcaaagacaaggctgcagtggcggtcaggtcaggctagcagctacctcagccacgcacaggcccaatcaacgcaagctagctagctgagaataatcttttagatctctggtagtgtggagatcgagatgcaagccaagcaatgtgatatcgcgttgtgtgttaccaacctgtcagtctgtgtatcatcccgtcccgtccgtcagagtctcagagaacgaacacttcttctccctgtagctagctgctcctgcttgtgtccagatcttctgttcgatcgggtttgggactaaaaaaaaaaaaaaaaaaaaaaaaaaaaaaaaaaaaaaaaaaaaaaaaaaaaaaaaaaa

SEQ ID NO: 139 - DNA, 1221 bp, Zea mays
ccacgcgtccgcgtcctcctccggtcacgcacgcagctagcttacccgccccgccactataaaaatccacctccaccccaccgcgcgtctacagttccacacacgcgtgcacgggcgggcaagcaccagaaaggaaaggcggaggccgcgcggcgggcgccagctgcagccaagagcccactagtagtagtagtagctagttcaccaccgcctgcttgcctcctttactttgccatatttgctagcgtttcctggattggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagccctagaaaagaccaaacgaatgtttctgggtgaaaatttagaagaatgctccattgaagaactgcataatctggaggttaaactggcgaagagccttcacgtcatcagagggaagaagacacaactgctggagcagcagatatccaagctgaaggagaaggagaggaccctgctccaagacaacaaagagttgcgggataagcagcgcaacctccagtctccaccggaggcgccaccggacctgaaccgctgtgtccctccttggccgcgtagcctgccggcaccgagcaatgacatggacgtggagacggagctgtacataggattacccggcagggagcgctcctccaaccgggactctgattgaaccacggattttcagttcgatcggctaaaaggaataagctccctgaaattaaagcatcgaagggcacacgtcaatggttttatttgcaacttttgtatgcaaacttgtacttgaaaagtaaaaaaaataaaaataaatctgtagtatgtggatgcaagaaacggctggttagctagctgcaagccttctggggcctgaaaatgaaatccacccatggatacacccaaaaaaaaaaaaaaaag

SEQ ID NO: 140 - DNA, 1888 bp, Zea mays
caagccgtatcgtcttctccctcttgtccggttcgggtggtccgcggtcggggtgagtgagtgagcagctttgcttctccatctccccgttcccttccctccccagccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagacggcggcggcggcggcagcggccaacggaaaagcgtgctgccacgccgccaaggggcccgggtacgccacgccgctggaggccatggagaagggccccagggagaagctcgtctacgtcacctgcgtctacaacggcactggaattaacaagccggattaccttgcgacggtggatttggatcccagctctcctacatactcccaggtgatccacaggctcccggtcacccacatcggcgacgagctgcatcactctggctggaactcctgcagctcctgccacggtgacccatcggccaagcgccgcttcctgatcctgccttccttgctgtcaggccgtgtgtatgtcgtcgacacagcgacagacccaagggcgccatccttgcataaggtggttgagtctgaggacattgctgagaatactgggcttgggttccctcacacgtctcattgccttgcgtctggcgacattatgatttcttgccttggggacaaggaggggaatgcagctggcaatggcttcctgctgttggattcagagtttaatgtcaaaggacgttgggaaaagccaggtcacagtcccttgtttggatatgacttctggtaccagcctcgccacaagacgatgatcagttcgtcatggggagcccctgcagcgttcaggacaggtttcgatcttcaacatgtccaggatggcctgtatggaaggcacctgcatgtgtacgactggcctggcggtgagctcaagcagacacttgatctaggtgacactggactccttccccttgaggtgaggtttttacatgatccatcaaaggacactggctatgttggctgtgctttaacaagcaacatggtgagatttttcaagaccgcggatggatcgtggagccatgaggttgctatctctgtgaaaccactgaaggtccgcaactggattctgccggaaatgccaggattgataactgatttcgtcatctctcttgatgaccgttatctctactttgtaaattggcttcatggcgatattaggcagtacaacattgaggatcccgcaaagcctttcttggctggacaagtatgggttggtggtcttcttcagaagggcagtgatgtcgtctatgttactgatgatggtcaggaacagcagtacaatgtgcctcaagtcaagggtcatcgacttagaggtgggccacagatgattcagctgagcttggatggcaagaggatatacgtgacaaactcacttttcagccgatgggatgagcagtttttcggtgatgatcttgtcaagaagggctcccacatgttgcagatcgatgtcgacaccgagaaaggaggcctggctgtcaaccccaacttcttcgtcgattttggcaccgagcctgatggtcctgccctggcccacgagatgagatatcctggtggggactgcacctctgatatatggatctgaggtcaaggattcggcgtaattaacaggctgctggagaatccctgttgttgtatgcactgtaattaacatggtatccgtgcggtgttctgtcttgtactgcgactgttgccagtggaataaggcatggtttcatgagaactctagattaataaaagaagtcctgattct

SEQ ID NO: 141 - DNA, 988 bp, Zea mays
gttccagctgctgatcttgatcctgcaccccgagccgtacacaagagctagtcggtagaacttgcaggagcggagcagaactaagtgcagagaacaggacatatggctacgccggcggtgaaggtttacgggtgggctatctcgccgttcgtatcgcgggctctgctggccctggaggaggccggcgtcgactacgagctcgtccccatgagccgccaggacggcgaccaccgccgcccggagcacctcgccaggaaccctttcgggaaggtgccggtgctcgaggatggcgacctcacgctcttcgaatcacgtgcgatcgcgaggcatgttctccggaagcacaagccggagctgctgggcggcggcaggctggagcagacggcgatggtggacgtgtggctggaggtggaggcccaccagctgagcccgccggcgatcgccatcgtggtggagtgcgtgttcgcgccgttcctgggccgcgagcgcaaccaggcggtggtggacgagaacgtggagaagctcaagaaggtgctggaggtgtacgaggcgcggctggccacgtgcacgtacctcgccggcgacttcctcagcctcgccgacctcagccccttcaccatcatgcactgcctcatggccaccgagtacgccgctctcgtccatgcgctcccgcacgtcagcgcctggtggcagggcctcgccgcgcgcccggcggccaacaaggtggcgcagttcatgccggtcggcgccggagcgcccaaggaacaggagtgacgatgaagcgatcgaagcgacttgtgttgttgtgcttgattagttaattggaaaccttctcactcatctagtccatcatggtgcctgcttttctttatactatttgtcttaattttgctgctttctccacggaataatagtagagatttggaaatgtaatgtattttatcaaaatatattggattttcaagcaatatagtatggttttcgctgc

SEQ ID NO: 142 - DNA, 1988 bp, Zea mays
ccagtttttctcctctcgcccccgttccccgtcccgactcccgacccaacccatatcagaggttccgtccgttggtggcgctggcgttcccgtgagtcggcccgcgcgcgaaggcggccgtgaccgaccgtccggagcttcatgcgccaggggcggcggctccaccccgtcgtttgatgggcaacgcatgcggcggcgcccttagatccaagtaccagcacagcttcaagcacgccgcgtcgtcgcagcgccgcgcctcctccgagtacagcgccagcgccgtggccgacgactcgcccaggaagcccacgcagccgcccgccaccacggacgcccacgcgccgccaccgccgcccgccaccgccgcagccgccatgaggcgcggcggggccggcgcgccgccggacctggggtccgtgctcggccaccccacccccaacctccgcgacctctacgcgctcggcaggaagctcgggcaggggcagttcggcaccaccttcctctgcaccgagctcgccacgggggtcgactacgcctgcaagtccatctccaagcgcaagctcatcaccagggaggacgtcgacgacgtgcgccgcgagatccagatcatgcaccacctctccggccacaccaacgtcgtcgccatcaagggcgcctacgaggaccagctctacgtccacatcgtcatggagctctgcgccgggggcgagctcttcgaccggatcatacagcgcggccactacagcgagcgcaaggccgccgagctcaccaggatcatcgtcggcgtcgtcgaggcctgccactcgctcggggtcatgcaccgcgacctcaagcccgagaacttcctgctcgtcaacaaggacgacgacctctcgctcaaggccatcgatttcggactctctgtcttcttcaagcctggtcaagttttcaccgatgttgttggtagcccatattatgtagctccagaagttttgttgaaaaattatggaccagcagctgatgtatggacagctggcgtcattctttacattctactaagtggcgtgcctccgttttgggcagaaacacaacaaggaatatttgatgctgtattgaaaggtgtcattgattttgattctgatccgtggcctgtcatatctgatagtgcaaaagatcttataagacggatgctgaatcctcgctctgccaagcgcttaacagcacatgaagttctatgccatccatggattcgtgatcatggagtagctcctgaccgtccactggatccagctgtcttatctcgcattaagcaattctctgcaatgaataagttgaagaaaatggctttgcgagtaatagctgagagcctatcagaagaggaaattgcggggttgaaggaaatgttccagaccatggacactgacaacagtggcgcaattacctacgatgaactaaaagaaggattgagaaaatatggttccacactgaaggacactgagattcgtgatcttatggatgcagctgatatcgacaacaatggaacaattgactacattgaattcatcgctgcaactttgcatctcaataagctggagcgcgaagaacatctcgtggcggccttttcatatttcgacaaagatggtagtggctatatcacagtggatgaactacagcaagcttgcaaagagcataacatgccggatgcttttcttgatgatgtcatcaacgaagctgatcaggataacgatggccgcattgactatggagagtttgttgccatgatgaccaagggcaatatgggagtcggtcgacggacaatgagaaacagcttgaatatcagcatgagggacgcacctggtgcattctgaaacttaacacgatgtacagcttgtggcctagtcacttcggccctgtttgtttcggcttctggcagcttctggccaccaaaagctgctgcggactgccaaacgctcagcttttcagccagcttctataaaattcgttgcggc

SEQ ID NO: 143 - DNA, 1284 bp, Zea mays
tcgcagcgtgtctcgtgctccccccaggctcctcttcctcgctttccctccaccccgggcgcaaaccctaaccctaccgtcgctcgccccgcggcgtctgccaatggcgcgccccgtgtgagtgtgcgcgagagaggggtagaccttgaggccgctacccggggaggagagcgagagatgtataaacaggggggagcggggggaggggctgggctggaccggaagcggatcaacgacgcgctggataagcatctcgagaaggcggtcgcgtcgccgtccacgtcgagggggtcggcgggcggcgggcgcgaccaccaccgcctcgtcgtgccgtcctccgtgtcgtccatccccaagggccgctgctccgaaggggagtctgattctgatagtgaagcatcggatgttagcggctctgatggagaagacacctcatggatttcatggtattgcaacttaagagggaatgagttcttctgtgaagtcgacgatgattatattcaagacgacttcaacctttgtggtctcagcagccaagttccttattatgattatgctctcgatctcattttagatatcgagtcatctcatggtgatatgttcactgaggaacaaaatgagctcgtagaatcagctgcagagatgctttatggtctgatacatgcacgatacattctgaccagtaaaggactggctgcaatgctggagaagtataagaactatgactttgggcggtgcccgcgtgtttactgctgtggtcaaccatgcctgccagttggacaatcagacatccatcgatctagtaccgtgaagatatactgccccaagtgtgaagacatctactacccacggtccaagtaccaagacatcgacggcgcatactttgggacaacgttccctcatctgttcctgatgacatacgagcacctcaagccacagaagctctcgcagcgctatgttcctcgtgtctttggcttcaagctccacaagccatgaacctcatgtatttgtcttttaaactcctcaagacgtggcactgggggcatgcgggagttttgcaatccttgaagacttgcatataagagcgccattggcaggtcagtggattggtaaaattctatcatgctgcagcgtgcttgtaccttagctggctggcacctatccaacatttgaatgtagctctaaggatatcaatgttgtaacctaactgctattgttctttgattagtaaaccaggagccccccctacaatgtagaatatggcaattatttatggctttgcag

SEQ ID NO: 144 - DNA, 830 bp, Zea mays
atttagaccaactagcaacatagaaagcacaatagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgttgcctacccccagcaatttcttccattcaaccaactggcagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacctagcagtgttctaccaacaacccatcattggtggtgccctcttttagatttcttatgagttatagttcaataataaagttttttgtctgatgtttgtggcttcccagaaataagaaagtacatttct

SEQ ID NO: 145 - DNA, 1516 bp, Zea mays
tagggcccacgccccgtccgcgctctccaaagtttcgtccaccatttcgctctcgcaagtcgcaagccaccgatttgtttacaggcgccggagctcccgacgacgactgagccatgtgcggcggcgcgatccttgccgagctccgcgagccggcgccgcgccggctcacggagcgggacatctggcagcagaagaagaagcccaagaggggcggcgccggcgggaggcgctcgttcgcggcggaagacgatgaggacttcgaggccgacttcgaggactttgaagccgactccggtgattcggatttggagctcggggaaggggctgacgacgacgtcatcgagatcaagcccttcgccgccaagagtactttctccagagatggcttaagcaccatgactactgctggttatgatgcccctgcagcaaggttggccaaaaggaagaggaagaatcaatacaggggtatccgccagcgcccttggggtaagtgggctgctgagatcagagatccccagaagggcgttcgtgtttggcttggtactttcaatagtccggaggaagctgcaagagcttatgatgctgaagcgcgcaggattcgtggcaagaaggccaaggttaactttcctgatgcaccagcagttggtcagaagtgccgttctagttcagcttctgctaaagcactcaagtcatgtgttgaacagaagccaattgtcaaaacagatatgaacatccttgccaacacaaatgcacccttctaccaatctgttaactacgcatccaacaatccatttgttccagcaatgaactctactgtttcttttgaggatcctatcatgaatctgcactctgaccagggaagtaactcccttggctgctcagacttgggctgggagaatgatactaagacaccagacatcacatccattgctcccattcccactattgctgaaggcgatgagtctgtatttgtcaactccaattcaaacagctcgatggtgcctcctgtcctggagaacaatgctgttgatctcactgatgggctgacagatttggaatcctatatgaggtttcttatggatggcggtgcaagtgattcaattgatagccttctgaaccttgatggatcacaggatcttggtagcaatatggacctctggaccttcgatgacatgcccatcgctggcgatttcttctgaggaatttgaagcttggccataggactatgtacatagggactagggaataaagactgggagattgggaagcacctgcttggcaccttggggtagcatatgctcgtgtctagctcagatgcagaagtcgcattctgaaactctttggttatcgacctgttccctattttaactatctctgtatgagagccatttatgagactgaaccattttaccattttgttttcccccttctttcgttgttacagtatatggtttaacattatgatttatggatatgtggccaaacatgccttttatatgcgctttgtgcttggttg

SEQ ID NO: 146 - DNA, 1605 bp, Zea mays
cctttgcgtgaagagagctaggtgggccgtagaaaaggcttcagttcagatctcatttcagatagcacaggaccaatctggtctgcagtgttcaactggaatataagatttcgctgcataggtcaaagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctgcgaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtccgctagacgatcaaggctgagaaaacaggctgagacagaggagttggctacacaagtggagtctcttgcagcagagaacacgtcccttagatctgaaatcggccggctaacagagagctcagagaagctcagactagagaactcagctctaatggtgaagctgaaggacaccgcagaaccgtctcccagcaaagcagccgcatccccatcctctccccgtgcctcggcggagaacttcctttccatgatcgacagcgccaacgcgccgagcgtcagcaggcacacggagcacggcggtcccaggctccggcagctcctggactccagtccggcgacagacgtcgccgccgtaagctgatgatgaagccggtccggcaaatacgccacagcacatgcatgtggcctggggattccgcaggctcatgcggctcgagtgctcgccgtaaacgtcagcgttacggactcggactctgtactccagtttaggcactgattccaccgagggtaccggtaattttatctgctctcgcgccagagtgccgggctgcctgcgaccactcctgtgtacccagagttgtaacgtagtagggtgttgtgctgcatgccgaccttttgaaacttttcgagaccgtcatttggaccatttttttcgtcgcaataacacaatacagatcggagtttgtac

SEQ ID NO: 147 - DNA, 970 bp, Zea mays
ccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtggggaaagctgctggcgacaggtggaaatccctgagcgagtcggacaaggctccctatgtagccaaggctaacaagctcaagctcgagtacaacaaggccatcgctgcctacaacaagggcgagagcactgcagctaagaaggctcctgccaaggaggaagaggaggaagatgaagaggagtctgacaagtccaagtcggaggtcaatgacgaggatgatgaagagggtagtgaggaggatgaagatgatgacgagtgatggagctcctcgagacaatggaccgtgcttcatccaacaatggagcggctacacaaggccccgtggcgatcacaaaaaaggagcctatatccatgtactagaattattcagtttcactccacatcgtgatgttttatttttacttttgtcgtgctataacggatagcgctcctcgttggcgccactggcgggtggttctgcctctggtctggtgtgtttgtgtgtggtcacacttgccagccagcagaggcgcctgcttgtacctagattactgtttccattgtcgtcatcatcggctaacattgtcataatgtcagtttgggtaatgttagattaagtaattattgtgttc

SEQ ID NO: 148 - DNA, 695 bp, Zea mays
ctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggctacggcggtcggcgcgaaggtggcggcggcggctacggaggcggtggcggctacggcggtcggcgcgagggtggcggtggcggctacggcggcggtggcggcggcggctggagggactgatgtgtgggcccatcctggcttcggccgagttatcttatctatctatagtatcgtgttaccgttcgcttctgtcaccgtgttagtgtccgttctacctttggattaggtgttggtaccctgttgttcgctttggttgctcccgctatgaaacgagacgagagaagaatgagcaaggtttttgttcgcagctatttttgtcc

SEQ ID NO: 149 - DNA, 1672 bp, Zea mays
ggcgaggcaaaagcgcaaacgcgaccacagacagagcgcgcttcaaggccttttttttttgagataacaaggaggagaggaggagatggcggtcacgatcacctgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaacgtaaacaacattattggaccagcgattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaacgttggggatgaaggtggttttgcacctaacattcaggaaaacaaagaaggccttgaactattgaaggcagccatagaaaaggctggctacactggaaaggtggtcattggaatggatgttgctgcttctgaattcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagccccttgccggtctgagcgcctggccaaatacaaccagctgctcaggatcgaggaagagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaacccttttttttcaatctctctagattctgacgagtggtggtctgcactcgtcgtaatgtcgtttgcctaaactgattttgatggaacagg

SEQ ID NO: 150 - DNA, 1078 bp, Zea mays
cgcacgcacgcacgaccagttgccacggcagaccaccccgcccagcggccagcttgctcgccacgaccacgatgggcttccccgtggggtactcggagtcggagatgctgctcccgcgcgtgctgctgcaggtgctcctcctcctcggccacttccaccgcttcctcctctgggccttccacgccgtggggctcggcgacctgatcgacctcggctgcaactacccgccgccgccgccctccgcgtccacggcgcacgagatgatggagcaccagcaccagcaccaggggcgcgacgacgtggcctccccgctgcagcaccagcgcccggagttccggcccgtcgcggcggcgctcatcgaggaggcgctccccgtggtgcggttcgacgagctgggcggcgcgccgtgcggcggcggcgactgcgcggtgtgcctgagcggcatcggcggcggcgacgaggtgcggcggctcggcaactgccgccacgccttccaccgggcctgcctggaccgctggatggcgcacgaccagcgcacctgcccgctctgccgcgcgccgctcatcccctgggccgccgacgccgactacgacatgtcctatccgtctcccctgccgcccacgccactgcggcggcctcacgagctgctgctgctgcttaccggcctgggcggcttccagtgatgcgcctgcgcgtgggcagcgtggctggcacttgggcaggccggccacgcgaatccgatccgtggcgaggcaaaccgcgtgctcatgtgcggcccagcacgcccggtcggtcaggcgggtgaccgccgccaaacctgctcagttgccagccgtacacgcttgccggcctcgtcttcggtcgtgtctccgactccgttggtttttttacagaggctcccagtcccaggtcaaacaaaaaaggaggcgaaacagacaaagcagtcggaaattaggcaggtactgtactaggttgatctgtaggccgattgggcgactccaaatctgtggagctgtgaatcctttggcagattaaactaaaaattgtctctatagatcagaccatccaaaaaaaaccc

SEQ ID NO: 151 - DNA, 1224 bp, Zea mays
gggcgccgccgccgcaagccgtccgccttgcccttcacgaaggcttggtcctcctccttgtatctccactccccccttcacagatccgttcctccagctagggttagcgttcctctgcagcgatggcgatcaagcggaccaaggcggagaagaagatcgcgtacgacaagaagctgtgcagcctgctcgatgagtacaccaaggtgctcatcgccctcgccgacaacgtcggttccaagcagctccaggacatccgccggggcctcaggggcgactcggtggtgctcatggggaagaacacgctcatcaggcgctgcatcaaggtgtacgccgagaagaccggtaaccacacctttgacccgctcatggacctcctggtcggcaacgtaggcctcatcttcaccaagggagacctcaaggaggtgcgcgaggaggtcgccaagtacaaggtgggggctcctgctcgtgttggtctggttgctccagttgatgttgttgtgccccctggcaacactgggctggatccgtcccagacctctttcttccaggtgcttaacatccccaccaagattaacaagggtaccgtggaaattatcacccctgtggagctgatcaagaagggtgaaaaggtgggctcgtccgagtctgccctgctcgccaagctgggtatccgccccttctcgtacggcctccaggtcaccagtgtctacgaggatgggtccgtgttcagccctgaggtgctcgacctttctgaggaggacctgattgagaagtttgccactggtgtctccatggttgcctccctgtcactggcgatctcgtacccgacccttgctgctgtgccccacatgttcatcaatgggtacaagaatgtgcttgctgttgctgtcgagacagactactcatacccacatgctgacaagatcaaggagtacctcaaggacccaagcaagtttgctgttgccgccccggttgctgctggggactctggcgctgcagctgctcccaaggaagaagagaaggctgcggagcctgaagaggagtcggacgaggaaatgggcttcagcctcttcgacgactagagctgctgttttcgtcaaactgctgcaagttttggctttttttatcatctacaagtactgtttcctatattttttagcagacaaattatcgtgtgtaatcgacaatgatatctccttaaattttaagtacctgtgttgtgtc

SEQ ID NO: 152 - DNA, 1446 bp, Zea mays
cttggtcgccgaagctcaagaccacagtgtcaggaagttctccaatcttccagccaaacacaattcatcagtcagatacactttgaccgaggaattattcagaatcactccacgagaggatcagctttcgaagctagagaagcagagctctaccaaacaggccaggacgtctctcaaatccccagttcagtaactggctaactgtaggagaaggagagagagatggagaacggcggcgctaaaggcgacgtccccgacgatgcgaacgagcattgccctggaacacagtctgaggaggcaggcaaggcagatgcctgcgctgggtgccccaaccagcagatttgcgccaccgcccccaaggggcctgatcccgatgtggttgctattgttgagaggttggctactgtgaaacacaaattgttagttttgtctggaaagggaggtgttggaaaaagcacattctcagcccaactctcgtttgccctagctgaaatggaccatcaggttggccttcttgacatagatatatgtggccctagcatccctaaaatgctaggccttgaaggacaagatattcatcaaagcaaccttggctggtcacctgtgtatgttgagtccaaccttggtgtgatgtcgattggtttcatgctgcctaatccagacgatgctgtcatatggaggggtccccgcaagaatggactgatcaagcagttcttaaaggatgtcgattggggggagattgactatcttgttgtggacgctcctccaggaacatctgatgagcacatctcgatcgtgcaataccttcaagccacaggaatcgatggcgcgataatcgtcacgactccgcagcaggtctctctgattgatgtgaggaaggagataaacttctgcaagaaggtcggtgttcctgtcctaggtgttgtggagaacatgagtggtctgaggcagccgctttcagacctcagattcatcaagtcagatgaggcgggcaagacagatgcgacagaatgggccctgaactacatcaaggagaaagcccctgagcttctgtcggtcatggcctgcagtgaggtatttgatagcagcaagggaggcgccgagaagatgtgccatgaaatgggggttcctttccttggtaaggtgcccatggatccgcagctgtgcaaggcggctgaggaagggaggtcatgctttgctgatcagaaatgcagtgccagtgcgccggctcttcgaaacatcgtgaagaagctgatcaaggccgagtgagaaaataatgttggcctgctggggaatctggtagtgagaaatgagatgaaatgacagatgccagagttctcgttaccaatatatatatatgttacggcgttacacactgaatctgtattagtgcttgtgttggacctgtaagtttttgttcgtgaataatcagtgggtgcacagact

SEQ ID NO: 153 - DNA, 883 bp, Arabidopsis thaliana
gggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttcttcaaaaaaaaaaa

SEQ ID NO: 154 - DNA, 1038 bp, Arabidopsis thaliana
ccctaaaaaagagaagaaccagaggagattcaattagaggataaaattgatgggaagagggaagattgtgatccaaaggatcgatgattcaacgagtagacaagtcactttctccaaacgaagaaagggccttatcaagaaagccaaagagctagctattctctgtgatgccgaggtcggtctcatcatcttctctagcaccggaaagctctatgactttgcaagctccagcatgaagtcggttattgatagatacaacaagagcaagatcgagcaacaacaactattgaaccccgcatcagaagtcaagttttggcagagagaagctgctgttctaagacaagaactgcatgctttgcaagaaaatcatcggcaaatgatgggagaacagctaaatggtttaagtgttaacgagctaaacagtcttgagaatcaaattgagataagtttgcgtggaattcgtatgagaaaggaacaactgttgactcaagaaatccaagaactaagccaaaagaggaatcttattcatcaggaaaacctcgatttatctaggaaagtacaacggattcatcaagaaaatgtggagctctacaagaaggcttatatggcaaacacaaacgggtttacacaccgtgaagtagctgttgcggatgatgaatcacacactcagattcggctgcaactaagccagcctgaacattccgattatgacactccaccaagagcaaacgaataacagagagattgaagttggaagataccatgatgttgaagaacactccaaaggccttggtttgaataaggttcttgaactggaaacctctatacaccaagccacgtacgataagcagcatggttcttctaacatagtcatattttcaatcctaaatataattaaagcatatataattaaaatccggtgttgttatactcatcttgagtattaatattgtacttgtttataaccatagattcgtcaattaatagagaaaaatcatatgaattattatccaaaaaaaaaaaaaaaaaaaaaaaaaa

SEQ ID NO: 155 - DNA, 525 bp, Arabidopsis thaliana
atggagggtaagagatcacaaggacaaggttacatgaaaaagaagtcttaccttgtggaagaagatatggagactgatacggatgaagaagaggaagtaggtagggatagagttagagggtctagaggtagcatcaatcgtggtggctcgttgcggctttgccaagtagatagatgcacagctgatatgaaagaggcaaaactgtatcaccggagacacaaagtgtgtgaagttcatgcaaaggcatcttctgtctttctctcaggacttaaccaacgcttttgtcaacaatgcagtaggtttcatgacctccaagagtttgatgaagctaagagaagttgcaggaggcgcttagctggacacaatgagcgaagaaggaagagctctggtgagagtacttatggagaaggatcaggtcggagaggaatcaatggtcaggtggtgatgcagaatcaagaaagatcaagggtagagatgacacttcctatgccaaactcatcattcaagcgaccacagattagatag

SEQ ID NO: 156 - DNA, 906 bp, Arabidopsis thaliana
atggcaaaggaagggggcttgggagagaactcaagatggagtcttggaggcatgaccgctcttgtcactggtggctctaaaggcatcggggaagctgtggtggaggaactagccatgttgggagcaaaagtccacacgtgtgccagagacgaaactcagcttcaagaacgcttacgtgaatggcaagcaaaagggtttcaggtcaccacttctgtctgcgacgtctcttctcgtgaccaacgagtgaaactcatggaaactgtttcctctctctaccaaggaaaactcaacatcctcgtaaagtatacatatataagcttcgtcctcctcggtattgggatccacaagaacccaattatgttgtgttttttgttgtggatctatacatatgtaggtcaacaatgtgggaacgtcaatatcaagccgaccacagagtatacagcagaagatttctcttttgtaatggctacaaatctcgagtcagctttccatctctcacagcttgcccacccattgttaaaagcctctggctcagggagcatcgtgctcatatcctctgctgctggagtcgtgcatgtcaatgttggatccatctatggagcaaccaaaggagccatgaatcagctggctagaaacttagcttgcgaatgggcgagcgacaacataaggacgaactctgtttgtccttggtatatcacaactcctttaagtaacgattttttcgatgaagagtttaagaaagaagcggtgcgtacgacaccaatggggcgtgttggagaagcaaatgaagtctcaccgcttgtggcatttctttgtcttccttcagcttcttatattactggtcagaccatttgcgttgacggcggtgccactgttaacggtttttccttcaagactatgccataa

SEQ ID NO: 157 - DNA, 810 bp, Oryza sativa
tcatacatggccactgccagctctataaacaagaggtttagcctcgccggtgccacggcgcttgtcaccggtggcagcaaaggcatcggccgcgccatcgtggaagagctggcgagcttcggcgcgacggtgcacacctgcgctcggaaccaggcggagctgagcagatgccaggaggagtggacggccaagggcctcgccgtcaccgtctccgtctgcgacgtggcggtgcgcgccgacagggaggcgctcgccggcagggtgtccgccatgttcgacggcaagctcagcatcctggtgaacaacgctgggacggcgtacctgaagccggcggcggacctgacgccggaggagacgtcgaggttgatgacgaccaacttcgagtcgtgcttccacctgagccagctgttctaccctctcctcaaggactccggaagaggcagtatcgttaatatctcgtccgtcgcttctgtcctcgcgttccattctcttcctatctactcggctgccaaaggagcaatgaaccaagtcacaaggaacctggcttgtgagtgggcgagcgatgggatcagagtcaattccgttgcaccgggctacatccagactccactcctaactgccttcgtggccggcaacgatttcgcacaggttgagttcaaccgtcttcctttgggccgtctcggtaaacctgaggacatctcgtcgttggtggcgttcctgtgcatgcctgcggcctcctacatcactggccagattatatgcgtcgatgggggccgtatgctttcttaataaactctacatatacaaaat

SEQ ID NO: 158 - DNA, 1128 bp, Zea mays
cgccccgcgcgccggccggccggtcgattcccccactccactcgccgcccgcggctgggctgcgctgcgcatcgacgacggacgacgacacaatcacccccaccccccgtccaatcagcagcggacgagggacgaccacggccccccgtctgccgcacgcgcgcccgctctgccagctgctgctactactgctaaacctcgcccaccagtcgcgtgaggaaatagcaacctgctgagctcgctcgttcgctcgctcgcctgccttcttccctgggcaagctagctagctaggatcgaggaggagctctgcccggccatgcagcgtggggatccgctggtggtgggccgcatcatcggcgacgtggtggaccccttcgtgcgccgggttccgctccgcgtcgcctacgccgcgcgcgaggtctccaacggctgcgagctcaggccctccgccatcgccgaccagccgcgcgtcgaggtcggcggacccgacatgcgcaccttctacaccctcgtgatggtagatcctgatgcgccgagccccagcgatcccaacctcagggagtacctgcactggctggtcactgatattccggcgacgactggagtatcttttgggaccgaggtcgtgtgctacgagagcccacggccggtgctggggatccaccgggtcgtgtttctgctcttccagcagctcggccggcagacggtgtacgccccggggtggcggcagaacttcagcacccgcgacttcgccgagctctacaacctcggcttgccggtcgccgccgtctacttcaactgccagagggagtccggaaccggtgggagaagaatgtgatctcgacccggccgggtggaaattaataagatgacgggtaatcgggtatatgtatatatttatatatatatgtatatgtacgtgtatttgatctggtggcctttggttatatttgggtggggtgtatttgatatattatctgtggcagattggcgcattctctggcgcatatttgatagctacatgtatctatttatacagatataaagcgagcaataatatgcatatgagagggttcagccacatcagtcattactctctccttttaaaaaaaaaaaaaaaaaaaaaaa

SEQ ID NO: 159 - DNA, 844 bp, Zea mays
ctcatatcctaaccaggctcactaatccttaccaatcctttcacccaaatcatacataagatagatgttcaatatgtctagggacccattggtcgtcggcaatgttgtgggagatattgtggatcccttcatcacaactgcgtcactgagagtgttctacaacaataaggagatgacaaatggttctgagcttaagccatctcaagtgatgaatgagccaagggtccacgtcggtgggcgtgacatgaggactctttacacacttgtcatggtggacccagatgcaccaagccccagtaaccctacaaaaagagagaaccttcactggttggtgacagacattccagagacaactgatgccagtttcgggaacgaaatagttccgtacgagagcccacgtccaatcgccggaatccatcgcttcgcattcgtcctgttcaggcagtcagtgaggcagaccacctatgcgccggggtggagatcaaacttcaacactagagacttcgcagccatctacggccttggctcccctgtcgctgcagtgtacttcaactgccagagagagaacggatgtggtggaagaaggtacataaggtgatatatcaaccaagctatgtgtgcttctctctctctcaagggagagaagcataacaacaaattggagtgaaaaaaatatatatcatgtgtgtggtgaacattgcaagtacgatgttcacaatcataagagccattattggatcacatattattctaatgtaatgtggctgggcgttctattggaaaaatagccacggtttgagatttatatataaatttgtgttgacgaaaattctgataaaaaaaa

SEQ ID NO: 160 - DNA, 1198 bp, Zea mays
ctgatagctttcgtaggtgctagctactaccatataccatatactctcacacaaagattagtacagctagcatggctaatgactccttgacgaggggccacataatcggggatgtcttagacccgtttactagctcagtgtctctaagtgtcctgtatgatggcagaccagtgtttgatgggatggagtttcgggcgtcggcggtgtcggtgaaacctagagttgagattggaggtgatgattttcgagtggcctataccctagtaagccatcacgtactccgcagatcgagtccatttggcgcgcggtaggccatatctatggccaagatgtctcgactactctccaaactctcatgtccaagtgacatccatggcttttggctcactgtgtgtgacggctaaatcagtctcctcgatcgtgcccatagctcggttgactacaaagattggctcatgctaataaatatatagtagtattatacactgagagagacactaacacccccccccccaaaaaaaaagtgcagggatttctgatcagcccagccccgaaaaaatgctcaggtttacttttaattccctaacatgttgaccatgtgtttgtgttaatgtaaatatattaggttatggtggatcctgatgcgcctaatcccagcaaccctagcctgcgggaatacttgcattggatggttactgacatcccagcatcaacagatgatagcttcggccgagagctcataccatatgagagcccaagccccaccatgggcatccaccgtcttgtgttggtgctctaccagcaattggggcggggcacggtgtttgcgccgcaagttcgtcagaacttcaacttgcgtaatttcgcacgccgtttcaacctcggcaagcctgtggccgcgacgtacttcaactgtcagcggcaaacaggcacaggtgggagaaggttcacttgtgtttttgatcatgtcgttcaaggtgaaggccggcaagcttgaacctactactactagtaacgttcgcgtgtgcttatatggccgtatcggcgtacactacgtagcatgaaagctagctagaaataaataaagatgtatttctttcgcacatgtagctaggcttttataaaggcgtacctccaagggtattatgtccggcttttaattaataatcgcgtgataagggtggttagtataaaaaaa

SEQ ID NO: 161 - DNA, 1495 bp, Oryza sativa
ctcgaaacacaagaaacaaccggagaaactgagcccggccgaccgcaaggacagcaagctattagccatcctcgcatggatcccaacgatgccttctcggccgcgcacccgttccggtgggacctcggcccgccggcgccggcgcccgtgccaccaccgccgccaccaccgccgccgccgccgccggctaacgtgcccagggagctggaggagctggtggcagggtacggcgtgcggatgtcgacggtggcgcggatctcggagctcgggttcacggcgagcacgctcctggccatgacggagcgcgagctcgacgacatgatggccgcgctcgccgggctgttccgctgggacctgctcctcggcgagcggttcggcctccgcgccgcgctgcgagccgagcgcggccgcctgatgtcgctcggcggccgccaccatgggcaccagtccgggagcaccgtggacggcgcctcccaggaagtgttgtccgacgagcatgacatggcggggagcggcggcatgggcgacgacgacaacggcaggaggatggtgaccggcaagaagcaggcgaagaagggatccgcggcgaggaagggcaagaaggcgaggaggaagaaggtggacgacctaaggctggacatgcaggaggacgagatggactgctgcgacgaggacggcggcggcgggtcggagtcgacggagtcgtcggccggcggcggcggcggggagcggcagagggagcatcctttcgtggtgacggagcccggcgaggtggcgagggccaagaagaacgggctggactacctgttccatctgtacgagcagtgccgcctcttcctgctgcaggtgcaatccatggctaagctgcatggacacaagtccccaaccaaggtgacgaaccaggtgttccggtacgcgaagaaggtcggggcgagctacatcaacaagcccaagatgcggcactacgtgcactgctacgcgctgcactgcctggacgaggaggcgtcggacgcgctgcggcgcgcctacaaggcccgcggcgagaacgtgggggcgtggaggcaggcctgctacgcgccgctcgtcgacatctccgcgcgccacggattcgacatcgacgccgtcttcgccgcgcacccgcgcctcgccatctggtacgtgcccaccagactccgccagctctgccaccaggcgcggagcagccacgccgccgccgccgccgcgctcccgccgcccttgttctaagctcgccggagactctgctgctgttcccgcgccgccacggcgcgtgggagtttcctgtggtgttgggccgtgttttcgttgtaaggcagttaggtcgttctaagctattcgatgggccgatcgaggatgcgtcgtcgtgtaggaactcgtcgtgtacccatgtttgcgatctggatggcccatttgtttagctgttaccatgttaaattcgtttcctttatttatgaaatggtaaatcctaaatgtcgtg

SEQ ID NO: 162 - DNA, 1535 bp, Zea mays
gtcgacccacgcgtccggcacaagcaaaacacaaagaagctcaagaaagctgaggcaagcccagaagaagaaaaaaaaaactagaaggagagatgggaagaagcgaaggcagcacaagcccagcggctgggggagccgcctgcgcgtgcgcggtctgcggcggcgccgcggtggtgtactgcgcggcggacgctgcggcgctctgcagcccctgcgacaccgctgtgcacgctgcgaacctgctggcgtcgcgccacgagcgcgtgcccctttccatggtgactgctgcatccggcgtgtacgacgacgacctcttcgcgcccgacgacatcgacgcggcgtcgtcgtgggcgtcggcgcctgcgcaggggcagggaagcccccagaacgggagctcgtcggcgagcttcaccaccggcgacagcggcgcggagggcaggggcctgttcgacctgctgtccgacgtcgacttcgctgcctgtgtcacgggcggcggcggctacctgccggacggcgtggcgcccgtcgtccatcacggcgctgcacctctgtgggcgcagcccggtctggccgccgccgcatggacggccacgtggtcgcccgctgtcgtcgtcccgggcgccgccgtggtcgccgcggcggcggcggagcgggaggcgagggtgcagaggtaccgcgagaagcgcgagaggcgcaagttccagaagaccatccgctacgcgtcccgcaaggcctatgccgaggcgcggcccaggatcaagggccgctttgtcaagcgcgccgccggcacctcctcctcctcctcctcgggtgccggcacatcggacagcatcgacgctgctgccaagttctggctctccttctccgacgacgccagggacggcttcttcgtggacgccggggcctacggggtcgtgccaagcttctagaaagtttgtgccttgaaaatttaggggtcacactcgcatcacagcgggcagcgcttctgggcttctggcggtggcgttcgcccagtttgaagcaagttaagcaaccgcccttctcgtttgtgtcgtgtcgtctcgtcattcatgtgagcagcatccgtggtgaaattccgccatcgctatttttaaatgatggcgcggaatttcgatgggtcatcaccagttggtgaacgaactaggggatttattgtgtcttgtaagatacaactttactgggttgtctatcaaattctgcgttggctcatcgtcatcgctttactggggctaacaatatagttgtggtggaaatctgccatccatgcttccatagcaagctcttagatgatcggaataaaaggggattttgatgggccaatcaggaagtgggtttggttaatctatatatggagcatatagcttatgcagctgttcatccacatggtttcagtgttttgactttctatccaagttgattaattccatatatggtggtcccaataatcttatgccactaaaaaaaaaaaaaaaaaaaaaaaaaaaaaaaaaaaaaaaaaaaaaaagggcggccgc

SEQ ID NO: 163 - DNA, 4001 bp, Oryza sativa
tattactcccaaagttccccccgacctactcctcctcctcctcctttccctccctccgcctccccccacctcgcgtctcgcggagcccggagagcagcggcgccgcccatggagtcgctcgcgctcctccacgccaagcccggcggcctccctccccgcgcggggctccgcctcccgctcccgcgcgcgcgatccgcgcgcgtctccctcccctcctccccggcggcccccgtatcgctccagtccccgctcctcctcgcttcgagaagcggccctacctcgcgggacgccgtcgtggggttgggattggggtgcgggctcttgagacggaggagcggcgctagtggtggtggtggtggtggggtctcttgcggcgcgcagcctgccgcggcggcggcggcgggggcggtgccggcggcgcagccggaggggaagaagttcctcggcgtggaggtgaagacgctgaagaagatcgtgccgctcgggttgatgttcttctgcatcttgttcaactacacgatcctgcgggacaccaaggacgtgctggtggtgaccgccaaggggagcagcgcggagatcatcccgttcctcaagacgtgggtcaacctgcccatggccatcggcttcatgctcctctacaccaagctctccaatgtgctctccagggaggcgctcttctacaccgtcatcttccccttcatcgccttcttcggcgcctttgccttcgtgctctaccctctcaggaatgtgatccaccccaccgcgctcgccgacaagctccttgcggcgctcggcccgagctttcttggccccgtcgccattctgaggatttggagcttttgcttgttctatgtcatggccgaactgtggggcagcgtcgtcatctcggtcctcttctggggcttcgctaaccaggtgagtcatgggtttggatttttgtggtcaatctaggcatgtgcaaatgtcaatttattgtctattttcagtcaaaaattgatggccatctcattagctaatgtttaacctgatgtttggctgtggagagcaaaacatgaaggagcagagtttgttgttgggtttctgtcactccgtcagaaattaggatgtgctcttgggataatgggtagttacagaaacgttggtttgattagtatttagtagtattgctcagtgtattgtcaaacctattggctaagtctaggtgcttgttgctttctggcatgaatgccttcaacttcatgattgctactttgctagcttttgttaatctgaattatatttagttggttaagttgcatttttgttgtgatatgcgttcttttacaaccacttgcctggatatggttcacactttttaactgcttttgcaataagtaatgttgattgatgtgggcctgtttgttttgagggccagagttgcagatgaaaccctagccaattttggtactaccaaaccaaacaagctgcagcctttaacataacatgtggccatattatggctacttttcttcccacaaaggaatgcctgaatgcttatattggatagttttatacatacatttcatttgtgtgaaacagtagggaggatccttgctggaagttcaagagggggaagaaatacttagggcaagatttaaaataagagaaaacaaagacagaaacaagcttttcaggagatagggatactctacacaaccatgagtagctagctgataataattcaagacaatctaggtgatagaatggcattatttcacaagtacaaatgtttgaacttctctcttatatctatctgagagaagacggtggaatagattgtgtcaactctctgactgaataattctgcataggggatatagagttttttttttctgggccatttgccagagtggctttgtgggctgttggtcatgcctgaatgagtaatgttggtgcatccgaataacacgtgtgtcctcagctatttgatttcagaattacatctgaatggtaggtgatcaatgtcctcagttatgcagagttcacagtggttgttttttgttgttcacgaagcttgaccagaggtgtataactgtcaattggttgcaagctggatggggttttctagtgttgtctgacgtttggttgtatatacctgtttaatattttctgaacttcccatcaaatggtgacccttcaggctacaactgatttcatccatccttctgcagattactacagttgaggaagcaaaagaattctaccctctatttggtcttggggctaatattgcgctcatcttttctgggcgtactgtgaagtatttctcaaatctgcgcaagacattgggtccaggtattgacggatgggaggtgtctttgaaaggaatgatgagcttagtggtgcttcttggacttgtcatcacttccatctattggggggtgaacaagtttgttttgaatgatccttctcttccgaagtctgaccgtaagaagaaaaaggtcagccgaatagttaaatgtgcttcttttttttttttactactactactacaaataatgcactaacgttttttttcaacaggataaacctaagcttggaatgaaagagagtcttaaagttctcctctcctcaagatatgtaagggaccttgctactttagtggttgcatatggcatcagtatcaaccttgtggaggtcacatggaaatcgaagctcaaggcacaggtaactttctcagctttgtttgtttcatcttcagattaatttgtcaaacagtttttctaattaagtatttctttcttcatcatggcagttccctagtccaaatgagtattcatctttcatgggtgatttctcaaccgctactggcattgctactttcacaatgatgctgttaggccggatcatactccgaaaattcggctggggagtggctgcaatgatcacccccacagttttgttgctgactggcgtcggtttcttctccctgattctatttgggcagcctctcactcctatgcttgccacaatgggcatgacccctcttcttgcagcagtttatgtgggtgcacttcagaacatattcagcaagagtgcaaagtatagtttatttgatccatgcaaagaaatggcctacattcctttggatgaagatatgaaggtttgcttctataccagattgcatatttattcatgtgattcgacgatgaacatttaaaaatatttttgcgcattattctgctttgtatactctcgtgattcatttaagcagtttgttgcttcatatatgcatatcccatgtgcatcatttagaaattatctagcaattcttgatgaactagtatctgttaagtaatttaaagcttctgtcttgatcctgtagttgtaagataacattgcctgtgtttacctgcttccattcattgcatcatatttgctttagttacaccaataagtgcaatccattggcatgagcaattgagcagtttgaactgaatgtcagttctctatccataaagtttgatgttgtgggctttgtacaaagcactagggcgagtttgcaccaccaattatgctgcagaagccaactctgcttcctctgtttgcaggtgaagggaaaggcagccattgatgttgtctgcaacccattggggaagtctggtggagctcttattcaacagttcatgatccttacatttggctctttagctaactccaccccctaccttggtggcatactgttggtgattgttctagcatggctaggcgcggcaagttcactagacaagcaattctctagcttggctaaggaagatctcaaaagggatatgtctgcaaaagagaaggtagatccttccctgctcaaggctcctgaggctgatgtattggtggagcacacaaacggcactatagagagcgaagctactgcaactgagagttcaccatcaaactcatctccaagtaattagattcatctttctttgacaaagtcaatcgataggtaggagaatgattgcagt

SEQ ID NO: 164 - DNA, 1206 bp, Oryza sativa
cttctcccaccttctcccttctcctcgctcttccccctccgccgccgccgcagcggagcagcaacagcaggcgagcgacatgggagggtttgtcaagacccagaagacccatgcctacttcaagcgtttccaagtcaagttcaagagacggaggcagggcaagactgactacagggccaggattaggctcaccaaccaagataagaacaagtacaacacaccgaagtaccgctttgttgtgagatttacaaacaaagatatcacagctcaaattgtctatgctaccattgcgggtgatatcgtgatggctgctgcctactcccatgagctgcctcgttatggtcttgaagttggtctcaccaactatgcggcagcttactgcactggcttgcttctggctcgccgtgtgctcacgctccgtggtttggaccaggagtacgagggcaatgttgaggccactggggaggactactatgttgaaccagctgatgaaaggaggcctttccgtgctctcttggatgttggcctcattaggacaaccactggaaaccgtgtctttggtgccctcaagggagctttggatggtggtcttgacattcctcacagtgacaagaggtttgctgggttcaagaaggacgagaagcagcttgattctgatattcaccgcaagtacatctacggtgggcacgtggctgactacatgaggtctatggctgaggaggaacctgagaaattccaagcccactttagtgagtacctcaagaagggaattgacgctgatggcatggaatcactgtacaagaaggtccatgctgccatccgcgctgatcctaccatggccaaatcgaccaagaaggaaccggctacccacaagagatacaacctcaagaagctaacctacgagcagaggaaggccagtctcgtcgaaagattgaatgctctcaactcctcagctggtgctgatgatgatgacgaggaagaggatgacgagtgagagagtagccttatcacagtagtttcatcttatgctgccaaacaaactccttatggcatttaagtttacctgtagtcttgcaatttgcaacaggcatttttgtttatgttctgcactctgctcaaagaacctatttctttcggtttttgattctcaaccttgagctatcggttatcttatttatgtgagaagctgccgtttggataaaaaaa

SEQ ID NO: 165 - DNA, 1223 bp, Zea mays; identical to SEQ ID NO: 31

SEQ ID NO: 166 - DNA, 917 bp, Zea mays
caacaatatgggttttgttaagttgattaagactaaggcatacttcaagcgctaccaagtcaagttccgccgcaggagagagggcaaaactgactacagacaacgtacaagacttatcacccaagataagaacaagtacaacactccaaagtacagactcgttgtcagaaagaccaacaagaacatcatcgcccaaatcatctacgctaccgttcaaggcgatcgtgttgtgaacgctgcctactcctctgagctcccaaagttcggaatcaagctcggtctcaccaactacgcttccgcttacgctaccggtctcttggttgccagaagacacctcaccaagatcggtcttgccagcaagtaccaaggaaaggttgaagccgacggtaacgactacaccgtcgaaccagctgaaggaccacgcccattcaaggcccttctcgacatcggtctcgctcgtaccagcactggagctcgtatcttcgctgttgccaagggtgctctcgatggtggtattaacatcccacacagcgtcaagcgcttcgccggctacaacgctgaaaccaagaagcacaaccccgaggtcctcaagaagtacatctacggacaacacgttgccgaatacatgaagaagctccaaaaggaggagccacaagcctacgaaaagcaattctcccgcttcgtaaaggccggagtcaaggctggtgacattgaaggaatctacaagaacgcccacaaggctatccgcgctgacccaacaaagaaggccaacgagaagaaggcagtcgaacacaagagatacaaccccaagagacttacacacgcccaacgtgctgaacgtgttgctaagaagaaggccatcttgggactctaaatgtcttttcttaacttacaatataaaacctatgaacaaaaaa

SEQ ID NO: 167 - DNA, 1601 bp, Agrobacterium tumefaciens
gactgcgaatattcttatctcccatgctgcccaaagtcgcacgtgcccatgtgtgtccgccgagtcctcgatgtggtgaggatttaggtaaggtacctggaactaacccctccagtcgctattccggccaaccgggaaatgcgaggacatatgaagcaacgacggtgcgggcctttctggttctctgccggctttccatcagccggggtactgaagaggcacaccatcattgcctgaagtgcggtcgggtcattccctccaatcgatggcagacaaagccgaatgatgctctggcagggcatcgttcacattcgcgccttgagcgtatgctatcgattctgcgcctccaccggctgattcgaatgcatatctcgagcgtcctttgtcctccggattctgccggagtcggttttatagggaatatatcgatgacgactgcacgcattctcgacttcatcaagacccgacgtcccgaaggcccttgcctcgtggttgatctcgacgtcgtgcgcgacaatttcaacgcgttccggcattccctgccgaacagcgcgatctattatgccgtcaaggcaaacccggctcccgaaatcctgaagctgctcgcttcgctcggctccaacttcgattgcgcctccgtggctgaaatccagatggcgctcgatgccggtgcaacgtccgaccggatttccttcggcaacaccatcaagaaggaacgcgacgtcgcccgtgctcacgcgctcggcatcgatctcttcgccgttgatagccatgaggaagtcgagaaggttgcccgtgccgcccccggcgcgcgtgtgttctgccgcgtgctgacggatggcgaaggtgctgaatggcctctgtcgcgcaagttcggctgcgtgccgcagatggctgtcgatgttctggtttatgcgcatcagatgggtctggaatcctacggcgtttccttccatgtcggttcgcagatgatgaatctcgacgcatgggatgcagcacttgccgatgccaagcgcgtctttgcgtcgcttgccaagcagggcatccacctgcagatggtcaacatgggcggtggtttcccgaccaagtacctgcgcgacgttccggctgccgaagaatacggccaggcgattgacacggcgctgcgcaagcactttggcaaccagatcccgaagacgatcatcgagccgggccgcggcatggtcggcaatgccggcgtcatcaaggcggaagtcgttctcgtgtcgaagaagtccgacaacgacaaccaccgctgggtgttcctcgacatcggcaagttcggcggtctcgccgagacgatggacgaggcaatccgttacccgatccgcaccgagcgtgatcaggacgagatgcagccctgcgttctggccggcccgacctgcgacagcgccgacgtgctgtatgaaaagaacatgtatccgctgccggtctcgctgaccatcggcgatgaagttctgatcgaaggcacgggtgcttacacgacgacctattcggcggttgcctttaatggcttcgagccgctgaaggcttacgtcatctaggcatcgggccgaaaagtgtaacgcggttttcggaaaacc

SEQ ID NO: 168 - DNA, 1583 bp, Zea mays
gagcgagttatctccggctcgaacccgtactcctcaagcaaaaccactggaggagcaccaagagttatctccggctcgaacccgagccaggtcctgactcctgatccgcaccgcacacggcaagggggcatcgccgacgggccgtcagcggcgagacccaagccaacacagcccagcgatgtcggcgcgtgaccgcgagacggccgaggcgctggtgcgcctcgccgcctcgctggacggggcggtgctcggcctcggcacggctgccgtcgccgtcgcgtcgtgggtcaagtacctcgccgtctcggggcagctacgcctcgtcgcctccgcggcgacggcctccatcgccgacgcccgctccctcctctcaggcgacggcgccgagccgcggatcgccgcggtgcggggctacgtgcgggcccatgacaagttcttccgggccccgttctcaggcgaggcgggcgtcgtcacgaagcacacccagatgtgtttgttcacagaatggagaggcatctttggatggacctttgatctgcatgctcttcttttcagatcatggaaagagcaaattgtgacgtcttttagatcggttccatttgttctggttagtactgaattaggaaatcctacgggagtggtacatataaatgtggataaggcggatcaaccgttgcctcttaccacagtgtttcataaacttatcccacttgagacgactccttacacattgtttcaaactattattggcaacggctatccgattgcgttgttggatgaagaaaaaatactaccgattggtaagaaaattacagcaataggactatgtcaagcaaaggatgcagaaagtgttgagataacatcgtgcccagagatcccctttttcttatctgaactaaccaaggatgagatgcaagctcagctggcttcacgtgctaggatactcttctggggtagtattgttttgggaaccttgtcggtttgcctagtgggccatgccatttacaggggctggacgagaatcaaactacgaagagaggctaggcatgcacgacagatgtttgaggaggctgaagatgctattcacagggatgactctagtgatgatgatgaaataggagacgggcaactatgtgttgtgtgcttaaggaagagaaggagggcagcttttattccatgtgggcatcttgtctgctgttccgaatgcgcattaacaatagagcgtacacctcatccattgtgccctatgtgtcgtcaagacatcagatacatgatgagggtttatgactcttgaggtatgctgctgataagatctacacgcttccttgctgacccatgcaaacctgaggagcacaactgttcgtcctgctgggcgttttcctagtcaaggtggcctaccctggatttgtgaatataatgtcttgaccctccaaattatgctcttgattgcctgggacaaatagcttagctgaagtcatgaactaacgtagagttattttttgtttgctttgcgcatatgtctatccatcatgtaaagcacagggtttactgcaaataggttaaagatttggacattttctgcc

SEQ ID NO: 169 - DNA, 3498 bp, Saccharomyces cerevisiae
tgttttatctactgctttctataattttctccgttccaatgcgatccaatgcctttcattcatacatagttatttatttcattaacgatccaaatctctttacttaacttcactagtcaacgcttctaacacatcacgcgatacgaagattaacagtttagtataatattgcaatacatacccatttcacacatcggtcaaggtcatcaagcacttttagttatagtgtgtcctatagttctttcagattgattgaggtttcatattagtgttgaaagcctagctaaagttctctgggcgtgcaacattcgaggacacatcggttgtttatacctcatgggattatggatggtcaaatagataaaatggagaagcgatatagcatgaccaaactggagaataggttaaggactttccaagatggtgttgcacttgaaaaaaaaaagttaaagtggagttttaaagttattccgtatcaggcaatggccaagcttggattttactttgatccagtgatcgatcctaagacatctaaactgaaaaaagactctgtaagatgttgctattgtcatcgtcaaacatacaatgtgagagactgcagatccaaaagaaaagatgttcttgagactctaagcaatataatgaggcaacatctgactgttactgataacaaacaagtttgcctccttatttacttgcgcaataagctattgacggactatagcttccatatgggggtttcggactggaaaaatgacaagtacttcagcaatccagatgatgaaaacgtgataaacctaagaaaatttacttttcaagataactggcctcacagtggttctcaaaatgaacatccgctgggtatagaaaagatggtgaatgcaggactcatgcgatacgactccagcatagaaggcttaggcgatccaagcatggataaaacacttatgaacgatacctgttattgtatttattgcaaacagttgttacaaggttggtcaataaatgacgatccgatgagccgacattataaggtttctcaaaatgggaactgttatttctttcagacacgtaatcgatttgagagaataaaaaatgacaatgacagtatcacgaaaaattgcgaagtctctccaactttaggcgaaaatgggaaaagagaagtgatcaacacgaaaaccgcttctcaaaggcagtgtcctttatttgagtcacctccatctagtactggtcctcaacttgacgattataatgagaagacagatatatctgttattcaacataatataagtgtgcttgatggagcacaaggcgaaaatgtaaaacgtaatagtgtggaagaaaaagaacaaatcaacatggaaaatggaagcactacattagaagagggcaatataaatcgtgatgttttagcagataagaaagaagttatttcgacaccaactgcaaaagaaatcaaacgtccaaatgtccagctaacccaatcatcgtcacctataaaaaagaaaagaaagtttaagagaatatcgcctagaaaaatctttgatgaggaagatagcgaacactcccttaataataattctgccaacggagacaacaaagataaggatttggttatagattttacaagccatatcataaaaaatagagatgtagggagaaagaatgctattttagatgacagcacagatgaattcagtttcagtaaccaaggacataacacatttgacatacctataccaacctcatcacatttgctcaaaggtatagattcagataatgacaatgttatacgagaagatgatactggcataaatacagacacaaaaggagcgtcttctaaacacgaaaaattttctgttaattctgaagaagatttaaatttcagtgaagtgaaactcacaggtagagacagtagtactaatattcttataagaacgcaaattgtagatcagaatttgggtgatatcgacagagataaggtccccaatggtggatccccagaagttccaaagacacatgagttaattagagataactctgaaaagagggaagcacaaaacggggaatttcgacatcaaaaagattcaactgtacggcaatctccagatatattacattctaataaaagtggtgataattccagtaatattaccgcaatacccaaagaggaacaaaggagaggcaatagcaaaacatccagcattcccgctgatattcatcctaaaccaaggaaaaacttgcaagaaccaagaagcctatcaataagtggaaaagttgttccaacagaaagaaaattagataacatcaatatagatctaaatttttcggcgtccgatttttcaccatcatcacaatctgagcaatcatcaaaaagctcaagcgttatttcaacgccggtagcgagccctaaaattaatctcacacgcagtttgcatgcagtcaaagagctttctggcctcaaaaaagaaactgacgatggtaagtattttactaataagcaggaaactataaaaatactggaagatgtgtctgtgaagaatgagaccccaaataatgaaatgttactttttgagactggaaccccgatcgcatctcaagaaaacaagtcaagaaaattatttgatgaagagttttctgggaaggaattggatatacctatagattcatcaactgtagaaataaaaaaggttattaaacccgaatttgagccagtcccatcagttgcaaggaatttggtgtctggaacctcttcatatccacggaattcacgtttagaagaacaaagaaaggaaacaagcacaagtttggctgataattctaagaaaggaagttcatttaatgagggcaacaacgaaaaagaaccgaatgcagcagaatggtttaaaattgatgaaaatagacaccttgtaaaaaattacttccatgatttgttaaaatatataaataataatgatgctacgctagctaatgacaaagacggtgatctggcttttttgattaagcaaatgcctgcagaagagttggacatgacattcaacaattgggtgaacctaaaagtgcaatctattaagcgcgaatttatagatgactgtgataagaaattggacatattgagaagggattactatactgccacaaattttattgaaactttggaagatgacaatcaattgatcgatattgctaagaaaatgggcattttatagctaactaatttgataaacaggctaaaggtttgtattttttgtagttttgaaactgtgtatagaatgtttcgccgcatcgcagatatctgcagggaactgttgacatagcatcttctgtggacgtgacaacgttacgtatattcgttgataccgcaagtctatagcgtatacatgctaaggcaaaaagtttcaaagtgaatgcattatgtatttatatgtaaataagtaagaaaagtgggattttgaaaataaaggtgtagtaggacagtaagtattcaatgaaatacaa

SEQ ID NO: 170 - DNA, 1082 bp, Zea mays
gcaaagagtgggccgggtggccaggaccaacgacttttccatagtcgtgctcgtcttcgtccacctcccgacccgactgagtagcaagcaattctccaaattagggtttctttccgcttgctttccagtttgcggcatcagtcggtggcgcctgcgatggagtctctgttcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcaacgtcggaggcgccctcacgaccgtgggatgcgtggcctccatcgccttcctcatctccctgcccgcttcacgggaccaggagaggaaccgcttggcgctgctcatgtctgccgcgctccttcaaggcgcgtccgttggtccgctcgtcgaccttgttattgacttggattcgaggattctcgtcactgcgttcgtcgggaccgcagttgcttttgcatgcttctctggcgctgccatcatcgccaagcgcagggaatacctgtacctcggcggtctgctttcatctggcctctccattcttctctggctgcagtttgctacttcaatctttggccacaccagcgcgaccttcatgtttgagctctactttggcctcctggttttcctgggatatatggtgtttgacacccaggagatcatcgagagggcgcaccgtggggacatggactacatcaagcacgcgctgactctcttcaccgactttgttgcggttcttgttcgaatccttgtcatcatgatgaagaatgcacaggagaaatcccaagacgagaagaagaggaagaagcggtagctgctgaatgaattggatgacatatgttgttgtggtcactacttcatagtaccgtgtactcctatcctattgtactaataataataatagtaagacgaaagatgactgctgggaatgaatatttggttctgctaaaaaaaaaaaaaaaaaaaaaaaaaaaaaaaaaaaaaaaa

SEQ ID NO: 171 - DNA, 1031 bp, Zea mays
ccttgattgaagtattaaatattcctatataaatataaattgggggtcttgaaattcaaagccatatctgtgattcatcaaatttgtgtttccccgaccccgattgcaagcaatggacgccttcaattccttcttcgattcaagaaaccgatggaattacgatactctcaaaaacttccgtcagatttctccggtcgtgcagaatcacctgaagcaggtttattttactctgtgttttgccgtggttgctgcggctgtcggggcttaccttcatgtcctcttgaacattgggggttttcttactacagtggcatgcatgggaagcagcttttggttactctccacacctccttttgaagagaggaagagggtgactttgttgatggccgcatcactgtttcagggttcctctattggacccttgattgatttggctattcatatcgatccaagccttatctttagtgcatttgtgggaacagctttggcctttgcatgcttctcaggagcagctttggttgcaaggcgtagggagtacctgtaccttggtggcttggtttcttctggattgtccatccttctctggttgcactttgcttcttccatctttggaggctcaacagctctctttaagtttgagttgtactttgggctattggtgtttaggttacattgtagtagacacccaagaaatagttgagagggcacacttgggcgatctggactatgtaaagcatgccttgaccttgtttaccgatttggtcgcagtttttgtccggattcttgttattatgttgaagaattcgactgagaggaatgagaagaaaaagaagagaagagattgattttcttaccaatctgctcgattaacacttcacctcgcttggtctgtaatacataaaaacagccgtctatacagtgttttccactttttaagcttgctcctcctactgtgcagttaagtcgtttgtttaccaatagtacatgttgacatgttttgagctctctaataagagaaatgtttacattac

SEQ ID NO: 172 - DNA, 1129 bp, Zea mays
gcgcagcgcgcagcgcagcccacctatcaataaccgacgagcgaggcgcgagaaccgacttgccaccggctgctcgccgtctctctctctccctcggggcgcgcgcgcgggagacaggccaaccgatcgtcaggcggccagccatgggcaagcacgggcacggcaagtgccacgacgtggaggcgtgctacccgccgggggcagcgggcggcggcaagtacccgtacatgacggagaacccgcagctgcggtgggccttcatccgcaaggtgtacgtgatcgtgtgcctgcagctgctgctgacggtggccgtcgccgcgacggtgaacctggtgcgcgccatcggggacttcttcctctcccgcaccatgggcgccatgttcgccatcatcggcgtcatcgtcgcccccatcctcgtgatgatcccgatgatcatttaccggaagcggcacccggtgaacctcgcgctcctggcgctcttcaccgtctgcatcagcttcgccgtggggctgagctgcctgacggcgaacgggccagtgatactggaggcggtggtgatcacgatggtggtggtgctggggctcaccttctacaccttctgggcggccaagaggggctacgagttcgagttcctggggccgttcctggtgtccgcctgcctcatcctcatgctcttctccctcctgcggatcatcttcccgctgggcaggacggggaccatggtgtacggctgcatcgccgcgctcgtcttctccggcttcatcatctacgacaccgacaacctcatcagggtctactcctacgacgagtacgtcgccgccgccatcgagctctacctcgacatcatcaacctcttccaggccatcctagcggtgctcgaaggcgtcgactgatagggtcatatatataacacggccggctgaggctcatgggctgtgagcatatatacataggatcatatatatgcaatctatacatgagctaccactaccactaccgagagatgggttccaagcttgctgggcaatctgtaatccatagacgatagatagggtcgaacggcaccgccgtgattgaacattattgctacaacgaaacattgcaaatgcaattcattatcttctcttgc

SEQ ID NO: 173 - DNA, 1547 bp, Zea mays
aggccagccacgcgcaaaccgaatccaccaacgtcaaacgaccgcaccaaccaatccacttcgccggcgatccgtctcatctcgtcgcgtctccggcgccggcagacacgggtaacgcggctccgagatcggcgggcaggatgatgatgctgatcgattgctcggggtgccgtaccccgttgcagctgccgcacggggcgccctgcatccgatgcgccatctgtggggccgtcacgcacatcgcccccgcccctcccgccgagcccaaccgcggcgccgtacaaccggcgccggggtgggcgccgccgccgccgccggtgcacggacggaagcgcgccgtggtgtgcgggatttcgtatcggtactcgcggcatgagctgaagggctgcatcaacgacgccaagtgcatgcgccacctgctcatgacgcgcttcaacttccccgacgactccatcatcatgctcaacgaagaacaaacggacccctacaaaatcccaacaaagcataacataaggatggctatgtattggcttgtgcaaggttgtcaacctggagattcattggtgttccattattctgggcatggatcacaacaaagaaattacagtggagatgaggttgatgggttcgatgaaaccctctgcccgttggattttgagacacaagggatgattttggatgatgagataaatacagcattagttcgaccacttcctcatggagttaaacttcatgcactcattgatgcttgtcatagtgggactgcacttgatttgccttatctctgcagaatgaacaggagtgggcaatatgtatgggaagatcaccgaccgcgatctggtgtctggaaaggcactagtggtggggaagctatttcctttagtggttgtgatgatgatcagacctctgcagatacctctgctttatcaaagatcacttcgactggtgcaatgacattctgcttcatccaagctattgaacgtggacagggcaccacctacggtagtatcctgaactctatgcgttccacaatacgcaacacaggtgactcagcgggtgtaggtggcggtgctgttacatcactaattacaatgcttcttactggagggagcctttctgctggtggtctgagacaggagccacaactgacggcgtgcgagccatttgatgtctatgcgaagcccttctccctatgacgtgttcatagtattgcccaatgtactatggggttgtttgtttcggcttctggcagcttctggccaccaaaagctgctgcggactgccaaactctcagcttttcagccagcttctataaaattcgttagggcaaaaaccatccaaaatcaacataaacacataatctgttgagtcgttgtaatagtaggaatctgtcactttctagatcgtaagccctatgaacaactttatcttcctccacatgtaatcataataatactcagattctccccacagccagattctcagaaaagctggttagaaaaaagctgaaccaaacagcccctatatatctcctcccatttcacgtt

SEQ ID NO: 174 - DNA, 1576 bp, Zea mays
ccacgcgtccgggcaggcagaggcaagaggcccctcaccctcaggtgatcaggtcgctagctcccggcttaactagtaggcagccatgaatttcggtgggaatggcaacgcgacgatccggtgcaagtactgcagggcgagcctgagcgtgatccccggcgagcgcgccatccagtgcgcgcaatgcaactgcgtgacccgcatccggcgggccgaccgcatcccgctggcgcggccggcgcacgtgccgccggcgttccagcgcgcccggggcaagaagcgcgccgtcctggtcggcatcacgtacgccggcgcgcgccggggctgcggcgacctgagaggccccgtcaacgacgtcaagtgcatgaggaacctcctctgccagcgcttcggcttccccggcgagtgcatcatcatgctcactgacgaccagagggacccgttcaggctgcccacgaaggagaacatccggatggcgatgcactggctggtgcagggctgcagctacggcgactccctggtgttccacttctcgggcatcggcgcgcaggtggcggacgacgacggcgacgaggcggacgggtacgacgaggccatctgcccgctggacgcgttccagagcgggcccatcctggacgacgagatcaacgagaccatcgtgcgcccgctggtgcacggcgccaggctgcacgccgtggtggacgcctgctacagcgccacggtcctggacctcccctaccagtgccgcatgtccaggaacgggttctggcagtgggaggacgagagcccgccgtcgggcgcctggaagggcaccagcggaggccacgccgtgctcatcagcggatacagcgagggcaaaggcaacttcgccatggtcagggacatgatacatacatacatactgctgatcgagctctgctgccttgcatctatctatatacctaacatgcatatgctgctgcttggacgacgcgcggcgtgcagatgcccgacgcccacgcgtcggtcgtcggggccatgacgcacagcttcgtccggacgctggagtgccagccgcgcggggtcacctacggccacctgctcagctccatgagggccatcatgaagaaccgcggcgggggctgcgatctgcagggggccatcggcgcacccatccgcaccgtcgccaacttcagcggcgtgcaggagcctaacctgtcctcttcggagacgtttgacatttaccgcaagcagttcgtcctgtagacaccaccacaccagggtttgcccctgccggccggccgcttgtaatgaattgccgtcgtatcagaataagaaattatctatcgaccatgatatgatatgatatatcaggaaagaaggaactattacccctcaatgtaataactaagcatgttcaatgtcctctttttattagagagagagacagagagaaaacgcggaatttgagacgtgtgcatgcagtttacgtgatcaataaagttacatagaaattattttaaaaaaaaaaaaaaaaaaggggtccggtatagaagattcaagcttatgtatgcgacatgatagctttctatagtgc

SEQ ID NO: 175 - DNA, 1461 bp, Zea mays
ggagctagctagccagcaacgcgtagcaagcagcgcaagcaaagctccgagcgcccggccggctagcttcgccatgaacatgggtggaaggtccccggcggcgacgacgatccggtgcaagtactgcagcgcgagcctgaccgtgtgcgccggcgagcgcgccatccagtgcgcgcaatgctgcggcgtgactcgcatccggcggtcgctgtcctcgcggctcccgctgccggcgctgacgaggccggcttccgtcgcgggcttcccgccgtgcggcggccgcggcaagaagcgcgccgtcctgatcggcatcacgtacggcggcgcgcgccggggctgcggcgagctgcggggccccatcaacgacgtcaagtgcatgaggcagctcctctgccagcgcttcgccttccccagcgacggcatcatcatgctcactgacgaccagaaggacccgttccgggtgcccaccaaggacaacatccggatggcgatgcagtggctggtgcaggggtgcagcagcggcgactccctggtgttccacttctctgggctgggcgcgcaggtcgccgacgcggactgcgacgagcaggacgggtacgacgaggccatctgcccggtggactcgttccagaagggccccatcctggacgacgagatcaacgagaccatcgtccggccgctggtgcccggcgccaagctccacgccgtcgtcgacgcgtgccacagcgattccgtcctcgacctccccttcctctgcaacatgtccaggaccgggaactggcagtgggaggatcaccgtccaccgtcgggcgtctgcaagggcacgagcggcggccaggcggtgcttatcagcggctacagcgacggcaaaagcaagttcagcatgacgccggaggcctgcgcggcggtgggggccatgacccacagcttcatcaaggcggtggaatgcgagccccagggggtcacctacggccgcctgctcacctccatgaaagccatcatgaccaacgccggcggctgcaaccagcagctgcagggcgcctgcgcacccgcccgcaaggtcgtcaacttcagcggcgtgcaggaacctaacctgtcttgctcggagatgttcgacgtctaccgcaagccctttgcgctgtgaacctcctctgcattgccattgcctttgcagactaccacagattcccgtctggactctatatataaattaccgtgacggaataataaaccagacggatttatattatatatgatgatatgtcataatgtgtgccttaattgtcttgcggccaataatgtgtgtccatgtgtcgatcggttaccggccctgagccaagcttatagcctgtggaccgacgactttgttgaccattataaatacaatgttgataatgttttaaaaaaaaaaaaaaaaaaaaaaaaaaaaaaaaaaaaaaaaaaaaaaaaaaaaaaaaaaaa

SEQ ID NO: 176 - DNA, 1815 bp, Saccharomyces cerevisiae
tattgtggcttaacagttctccttaaaatccacataactgacaaaactggatacttaatgcccatcgagtcatatacatatatttgattactacaagtgcttttcaaataactgcttcgagaaaagcgtccgggtaataacaactattgaaaaagcatggcttcgcattaataggagccaaaaatatgaagatgagcctcgaagtttatctaaactaccaccaaagaagaccgactagatttacaatcatgtatccaggtagtggacgttacacctacaacaacgctggtggtaataatggctaccaacggcccatggctcctccacctaaccagcagtatggacagcaatatggtcagcaatatgaacagcagtatggacagcaatatgggcaacaaaatgatcagcaattcagtcagcaatatgctccaccaccaggtcctccccctatggcttataacaggcctgtgtatcccccccctcaattccagcaggaacaggcaaaggcacaattaagcaacggctacaacaatcctaatgtaaacgcatccaatatgtacggtccaccccagaatatgtcattacctccacctcaaacacaaactattcaaggtacagaccaaccttatcagtattctcaatgtactgggcgtagaaaggctttgattatcggtataaactacataggttcaaaaaatcaactgcgtggttgtatcaatgatgctcataacatcttcaactttttgactaatgggtacggttacagttcagatgacattgtcatattaactgatgatcagaacgatttggtcagggttcccactagggctaatatgattagggccatgcaatggttggtcaaggatgcgcaacccaatgattctttgttccttcattattctggacatggtggccaaactgaagatttggatggggacgaagaagatgggatggatgatgttatatatccggtcgatttcgaaactcaagggccaattatcgacgatgaaatgcacgatataatggtgaagcccttacaacaaggtgttagactaacagcattgtttgactcttgtcattcgggtacagtgttggatcttccatatacctattctactaagggtattattaaggagcccaatatttggaaggatgttggccaagatggcctgcaagcagctatttcatatgccacaggaaacagggctgctttgattggttctttaggttctatattcaagaccgttaagggaggtatgggcaataatgtggatagagaacgcgtgagacagatcaaattctcagcagcagatgttgttatgttatcaggttcgaaggataatcaaacttctgcagatgctgtcgaagatgggcaaaatacaggtgcaatgtcccacgccttcatcaaggttatgactttacaaccacagcaatcatatttatctcttttacagaacatgaggaaagaattggctggtaagtattctcaaaaaccacaattatcatcgtcacaccctattgacgtaaatctgcaatttattatgtagaaatatatgaatgtgtacgttggtagatgtattcagactggtgtagtatgtgattcaatttttatttttttagaaagcagaaacaatctaagctattaatactatatacatataggcaaagatatatagggaataggcattttggaaaataagaccatgtgtttttttaacgtagtgaatactaagtacagaaaaaaacatcacctcaaccaaagaaaaattaagtaatgaagaaagatcaggagaaaaatttttttctacttcaggt

SEQ ID NO: 177 - DNA, 1799 bp, Glycine max
cttattatgaacctctctctatgcaattcttcaaaccttaacacctcaagaaaaccattgatggcactccctcactccatctctgccttagccaccacactcacactctcctcgccaacaaccaaaccccagaaagttaacccctttccctttttctcgaaccaaaagacacgatttttaacgaaacaaacgcgacccagaagcagaagaagcctctccctaacccctgcacgcgttgcggcgccaccctcaactgttgaagccgatcaatcatacccggagaccgaaaataacgaaactgaggaagagtttaacgatgaaagctcttattctaaattcacttggagggatcactggtaccctgtttcgttgatcgaagatctgaaccctctcttgcccacaccgtttcagcttctgggtcgtgaaatcgtgctctggtacgacaagtccatttcccaatgggttgcttttgatgacaaatgcccccatcgtcttgcccctttgtctgaagggaggattgatgaagatgggaagttgcagtgttcttatcatgggtggtcttttgatgggtgtggatcttgtgttaagatacctcaggctgcatctgaaggccccgaagcacgtgctattggatctcctaaagcgtgtgccactaggttccctaccatggtgtctcagggcttgctcttcgtttggcctgatgagaatggttgggagaaagcaaaggcctccaagcctccaatgttgcctgatgactttgacaaaccggagtttgccacggtcaacattcagcgtgatctgttctatggttacgatactctcatggagaatgtctctgatccttctcacattgagtttgctcatcacaaggtcacaggaaggagagacagagccaagcctctgccattcaagatggattctcgtggttcatggggcttctctggagctaatgaagggaacccacagatcagtgccaagtttgttgcaccatgttatatgatgaacaagattcagattgataccaaactccctgtagttggtgaccagaaatgggtagtatggatatgttccttcaatgtccccatggcacccggtaagactcgctccatagtttgcagtgctcgaaacttcttccagttctcagtgccagggccagcctggtggcaagtcgttcctagatggtatgagcattggacttcaaacaaggtatatgatggagacatgattgttcttcaaggccaagagaaaatcttcctttcagaaaccaaggaaggtggagacattaacaaacagtatacaaacatcaccttcacaccaacacaggcagatcgctttgtcttggcatttcgaaactggctaaggcggcatggcaatggccaaccagaatggtttggcaacagcagcgaccaaccattgccatcaactgttttatcaaaacgtcagatgttggatagatttgaacagcacactctcaagtgttcatcatgtaaagcagcatatgagggattccaaacatggcagaaagtcctaattggtacaacagttgtgttttgtgcaacatcagggatcccatcagatgtccagttgcgtgtacttttggctggactcgcaattgtcagtgcagccataacttttgccctaaatcaactccaaaagaattttgaattcgtggattacgtgcatgccgaaattgattaaacacttccctccaaaggaacttctactagttagttgtaaatagagttgaagacaaaaatacatgtatactagtattttgatgaaagagctcaaatcttcct

SEQ ID NO: 178 - DNA, 1701 bp, Synechocystis sp. PCC 6803
tggctgtgccctgactgagaatccactaattcttcctatgaccagtttgttaacctcctctgcccaagctccagttgccaacgctccctttccagcagggggactagaccaaagcaaatttgattgtcgggccgtgtggtatcccctggcttacgaggaggatttggacaaacgcaaaccaactcgttttaccctgctgggagaagatttggtgatctggtgggaagcgaatagtcaacaatggcgggtttacgccgatcaatgtccccaccgtttggcccccctttcggaaggtaggattaacaaggctggccagttggaatgtccttaccacggttggacttttgcgggatcagggcaatgtcaagcgattcctcaacaacataccggaggccaagcccacaccagtaaacgggcctgtgtgcgttccctgccaacccaagtggctcaaggtttgctctttgcttttcctggggaaactgatcaagcagaaaaagttgccctccccttggtggatgtgttggatggggatcagtctgaatgggtttgtctcaatacttttcgggatttgccctacgacgcctttaccctgatggaaaatgtgttggattcgagccatattccctacacccaccataaaaccgttggtaaacgcagtaacgttagtccggtggatttggagattatccatggcgatcgtcagggatttaccggcatttgggaagagggaccaagaaaaggtacgttgggcaagcaaaccaccactttcattgcgccggggttgatgtggcatgatttaacttcaaagcaatttggtcgaactttaacggtggtttacgctactccgattcgcccaggggagtgtcgtttattcgcccgttttccttttaaatttcctagtaagtttccccggttagtaattggtttcacgccccgttggtattcccatttaggacaaaaccgggtgttggaagatgaccaaatttttctccatttccaagaaagatttgtgcagggcaaaggcggatcgcccaattatgaaaaagattgttacttacccactaaagcagatttgtttgtggcggaatttcaccgttggattgagcaatatcaagtcaaaccctttggggatagtccgttacctgatcgccaatcggtagagcaattaatggatcgttaccattcccacactgaacattgccacagttgccgcaatgcccttgctaacattgaaaaaattcaaaccgggagcctcgcgatcgccattatctgcttggtttgcttgccagtggctagtttaggcttagctcctaatttcgctctgggattgggcttgacagtgttgactggcttaggttttgcactctgggctggtttgggcaaatttaaacaatctttttaccaaggcaaccccattcccccaagaaatattcttgataaaggctaactgcttttttctgtgattaaaaacctttgcaatggagtattgagcataattttattgccgaaagtaagaccattaaactgaatctaagagcctgtttaaaagcccccttgacccccaaatttggggggacactgactgaaagtcccccagtattgccggagccttagtgagttaatttagaggatggaataaaactttccaaacacgttccaacgtcagggtttggccaagaataatcgatatctttgtaacaa

SEQ ID NO: 179 - DNA, 1162 bp, Arabidopsis thaliana
ccacgcgtccgatacattgaacctttcctcttcttcttcttccttctaccttcttctctctgttcaattttgggggaaaatgggtcgtggaaaaatcgagataaagaggatcgagaatgcgaatagcagacaagtcactttttccaagaggcgttctgggttacttaagaaagctcgtgagctctctgttctttgtgatgctgaagttgctgtcatcgtcttctctaagtctggcaagctcttcgagtactccagtactggaatgaagcaaacactttccagatacggtaatcaccagagttcttcagcttctaaagcagagaacctccaggaggattgtgcagaggtggatattttaaaggatcaactttcaaagcttcaagagaaacatttacaactgcagggcaagggcttgaatcctctgacctttaaagagctgcaaagccttgagcagcaactatatcatgcattgattactgtcagagagcgaaaggaacgattgctgactaaccaacttgaagaatcacgcctcaaggaacaacgagcagagttggaaaacgagaccttgcgtagacaggttcaagaactgaggagctttctcccgtcgttcacccactatgttccatcctacatcaaatgctttgctatagatccaaagaacgctctcataaaccacgacagtaaatgcagcctccagaacaccgattcagacacaactttgcaattagggttgccgggagaggcacatgatagaaggacgaatgaaggagaaagagagagcccgtcaagcgattcagtgacaacaaacacgagcagcgaaactgcagaaagaggggatcagtctagtttagcaaattctccacctgaagccaaaagacaaaggttctctgtttagtcctagaaaagtatgggagaaggctactaatgtttcctctttagcaagtatccgattgttttaaaagtaattttagagggatacttgcaaaaagaagagaagattcagttatctaatctctgcaccaactctctttgtccttcttcttttgattatttctcgactgtctctcctataaaaaagatatgcctagctgagagtttgaaatcaaaaaaaaaaaaaaaaaaaaaaaaaaaaaaaaaaaaaaaaaaaaaaaaaaaaaaaaag

SEQ ID NO: 180 - DNA, 451 bp, Saccharomyces cerevisiae
aaaagaattgtaacgaggaatacatgactaatatggcaaaagcaccaaaggcaaacacaccaaaagtaaccagcacgtcatctgcagtcttaacagattttcaagaaactttcaagacttctaagagggcatattttgcccaaattgaaaaatatcctaaactgaaactaattgatacattctgcttctttttggtattattaggggtgatccagtgtacattcattatcttgatccgtgataattttccattcaatgcgtttttagcgggattcattatttgtgtgggacaattcgtcctattgatgagtttgcggttacaattgtgtaatagttttccaggcatttctaaaaacagagcttttgccgagtttattgttgctagtttgattttacatttcgtttgtttacattttataaattgaggaagggtttgccggcgtgcttgcat

SEQ ID NO: 181 - DNA, 693 bp, Zea mays
ggctcgaggacgcctgctgcccaggtcttcgccggcgacgagcactccaccagacgagaggggattccaagatgccgagggccaccagcgacgcgaagctcctgatccagtccctcggcaaggcgtacgctgccacaccaacaaatctcaagattattgacctctacgtgggttttgcggttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttcccccagaaagggcctttgctgatttcgtcctatgcaatctggtgctccacctggtgatcatgaatttcctcggataagcaactgctgcaccatgttggttaaaggttttgtagccccaggttgtggtcgctgattgttgcctttaaatgtttggaactgttgtgatcgtgatgtcgaatatccatatgatctgttgaaggattacttgtgtaagctgagtattcccggagggaactattagtcgaatggacagtttgcccagcgctgagaatgtgacctagcatgttctttatttgaagaagatataattcatttttcacaaaaaaaaaaaaaaaaaaaaaaaaaaaaagggcg

SEQ ID NO: 182 - DNA, 1334 bp, Zea mays
cgcacgccttcccgttgtccatttgctccacgggccagcctgccggcgccgccactgcaaagtccgtacacacagacacacaacgcacgtcaccgccatgtctgccgccactgcttgcatgcccctggtccttgatccgtctcctctccatggatcggcggcaatggcagatgccgttgagaggcggcagcccggtggcatggagaccaccaagaccggttccgagggaacgctcggccgcgtcgtcaggagccaagtgtttggcaacgaggacgacgaccgtgctgggcacggcgacggcgacgaggtgagcaagccgcgggcggtggtccacacactgacgtgcgagcgcaagccattgttcgagggcttcgcgctctggcggagcatcggcaggcctgagcttcccgaactggatccaatcttatcgttcgacgaattcgagttttctgctccagctggcttccttgaccatcctcacaggggatttgagaacgttacctatatgctcgagggcggcatcagttaccacgacttttcaggccacaagggaaccatcaacccaggagacgttcagtggctgacggcggggcgcggcgtcgtgcacgcggagatgcccgccgccggccagggagtacagaggggcatcaacatctggatcaacctctctgccgccgacaagatggtggagccgaggtaccaggacctggcgagccacgacatccccgccgccgcggcggacgccgctggcggcgtctccgtcaaggtcatcgcgggcgagtgcctcggcgcgcgctccccgctccggccccgcaccccggcgctgtgcctcgacgtcgccctgcggcccggcgcgcgcctgcgccagcctgtcccgcgcgggtggagcgcctgcgcgtacgtcatccacggcgaggccgccttcggcactgcctccggcgagggtaacggcgcctccacggctaccgcgcgcacgctcgtcgtgttcggtggcgacggcgacggcgtggagctgcggggcgatgcagcgggccagggcgcgagggtcatgctggtcgcagctcggtcgcacggcgaggcggtggcgcgggacggccccttcgtcatgaatacccgggaggaggtggaccaggcgcgggaggactaccgccaccgccgcaacggcttcgagatggccgacggctggacctccgatcacgcctccgcagctgaaaagcattcataggatacacctaccttaggctagtcgcgcgcggatgcaactgtgtaaggctttatatgtagtttgatttccatcaataatccacaagttttatttccaaaaaaaaaaaaaa

SEQ ID NO: 183 - DNA, 1672 bp, Zea mays
gccagagtcctcacggatggcctcgccagcgatggtcccgctgcggcagctcttcgtcgacggcgagtggcgcccgcccgcgcagggccgccgcctccccgtcgtcaaccccaccaccgaggctcacatcggcgagatccctgcgggcacagcggaggacgtggacgccgcggtggcggcggcgcgggcggcgctcaagaggaaccgtggccgcgactgggcgcgcgccccgggggccgtccgggccaagtacctccgcgctatcgccgccaaggtgattgagaggaaacctgagctggctaagctagaggcacttgattgtgggaagccttatgatgaagcagcatgggacatggatgatgttgctgggtgctttgagtactttgcggatcaggcagaagccttggataaaaggcaaaattccccagtttctcttccaatggaaacttttaaatgtcatctccgaagagagcctattggggtagttgggctgataactccttggaactatcctctactgatggctacatggaagatagcccctgcattggctgctggttgtacagctgtgctgaagccatctgaactggcttctgtgacttgcttagagcttgctgatatctgtaaagaagtcggtctcccttctggtgtcttgaacattgtgacaggattaggtcctgatgctggcgctcctttgtcagcacacccagatgttgacaaggtcgcttttactgggagttttgaaactggcaagaaaattatggcatcggcagctcctatggtcaagcctgttacactggaacttggtggaaaaagtcctatagtagtatttgatgatgttgacattgacaaagctgtcgagtggactctgtttgggtgcttttggaccaatggtcagatttgcagcgcgacatctcgtcttcttatccatacaaaaattgctaaaaaatttaatgagaggatggttgcatgggccaaaaatattaaggtttcggatccacttgaagagggttgcaggcttgggccagttgttagtgaaggacagtatgagaagattaagaagttcatatcgaatgccaaaagccaaggtgctactattctgactggaggtgttagacctgcgcatcttgagaaggggttctttattgaaccaactattattactgatatcaccacatcaatggaaatctggagggaggaagtctttggtccagtcctgtgcgttaaagaatttagcactgaagatgaagccatcgaacttgccaacgatacacagtatggtttggctggtgctgtaatttctggtgatcgggagcgctgccagaggttatctgaggagattgacgctggatgcatctgggtaaactgctcgcaaccctgcttctgccaagctccctggggcgggaacaagcgcagtggatttggacgtgagcttggagaagggggcattgataactacctgagcgtcaagcaagtcacggagtacatctctgatgagccgtggggatggtaccaatccccctccaagctgtaaactggcaagacgaaaatttgtctgtttcggtagaataaatatatctcgatgctatacagaacgaacccgtgtatcacattgaatgacatggtgaaaaaggcacatctgcaggataaaggcgagagttgagttgaaacc

SEQ ID NO: 184 - DNA, 1887 bp, Oryza sativa
gcagggcagcctgaaagaaagcggcggcggcagcaggtcactggctcactgctctgtcctctcgtctccagagttcagaccaccgcatcgccatggcgccgccgcagacgatcccccggcgcggcctcttcattggcggggcctggagggagccgtgcctcgggcgccgcctgcccgtcgtcaacccggccaccgaggccaccatcggcgacatcccggcgggcacggcggaggacgtggagatcgcggtcgccgcggcgcgggacgcgttctcccgcgacggcgggaggcactggtcgcgcgcccctggggccgtgcgcgccaacttcctccgggcgatcgccgccaagattaaagacaggaaatctgagctggctttgctggagacacttgattctggaaagcctctggatgaagcaagtggagacatggacgatgtcgctgcatgctttgagtactatgctgatctggcagaagctttagatgggaagcaacagtcaccgatctctctgcctatggaaaactttaagtcgtatgtacttaaagaacccattggggttgttggactgatcactccttggaattatcctctgttgatggcaacttggaaggtcgcacctgccttggctgctgggtgtacaactatattaaaaccttcagagttggcttctgtgagctgcttagagcttggtgcaatatgtatggaaataggcctaccaccaggtgtcttgaacataattactggtctgggccctgaagctggtgctccattatcctcacattcccatgtggataaggttgcttttactggaagtacagagactggtaagaggataatgatttcagctgcccaaatggttaagcctgtttcattagagcttggtgggaaaagtcctcttattgtctttgatgacattggtgacattgacaaagctgttgaatggaccatgtttgggatcttcgcgaatgctggtcaagtctgcagtgctacttctcgtttactgctgcatgagaaaattgcaaagaaattcttggatagattggttgcatgggcaaagaatataaaagtctcagatccactggaggaaggctgcagactgggttcagttatcagtgaaggacagtacgagaagataaagaaattcatctcgactgcaagaagtgaaggtgccacaattctgtatggaggtggccgaccacagcatctcagaagagggttctttcttgaacctacaattataacagatgttagtacgtcaatgcaaatttggcaagaggaagtctttggaccagttatctgtgttaaggagtttaggacagagagtgaagctgtggaacttgcaaatgatactcactatggtttagctggtgccgtgatctccaatgatcaggagaggtgcgagcgcatttcaaaggctcttcactctggtattatttggataaattgctcgcaaccatgcttcgtccaagctccttggggagggaacaagcggagcggttttggtcgggagctcggagaatggggtcttgataactacctgacagttaagcaagtcaccaagtattgctcggatgaaccgtggggatggtaccagcctccatctaagctgtgaaggggcattcactccagggaatgtaatgcatcattaactgacagcatcagtcctgttaatggacaggagctcgtgtacagtacagtgctcgtaaaaaaagctctttgatggtaaagttgcttgctgctatcactactccagaccagaattcaggactggagagtacgatgtcatgagttgtactacttgttagtctgcactcttatcattcgaagtttggcagtggtgtgtagttgcacttggaagattgcaataataataaagataattggat

SEQ ID NO: 185 - DNA, 3445 bp, Saccharomyces cerevisiae
gtaatcagagccatagcgtatcagaaaaccacacctaattagatggttcttgcatctgtacctcttatcactaaaagcggcactaaacttccaacattaaatgtttgccttgttaaatatatatttttgccttggtttaaattggtcaagacagtcaattgccacacttttctcatgccgcattcattattcgcgaagttttccacacaaaactgtgaaaatgaacggcgatgccagaaacggcaaaacctcaaatgttagataacgtggatctccgacacatgtgaatttataagtaggcatatgaaaatacagattctttccactgtgttcccttttattcccttctcatgtgaagagttcacaccaaatcttcaaaatataactaatatagtagagtttgattcaaaggacctttttttttgcctctttgattagtttatcttcttttcttcattttatcccctaattttatacgttagttcaacctaacaatccaggatttcattaacaagaaaggtaaaagtaacctatcaaggctattttgaaaaaaaaaattccgccctgaatatttcgagtgattttcttagtgacaaagctttttcttcatctgtagatgtccagttgtaaaaccactttgtctgaaatggttggttctgtgacaaaagataggggcactatcaacgtcgaagccagaacacgttcgagtaatgtaactttcaaaccacctgtaacccacgatatggtgcgttcgcttttcgatccaactttgaagaaatctctgctggaaaaatgcatcgcgctagctattatatcgaattttttcatttgttattgggtcttccaaaggtttggcttacagtttaccaaatacttttttctggtacagtatttattttggagaattgcttataatttaggtattggactggttctgcattaccagtcacattatgaaacactaacgaattgtgctaaaactcatgcgattttcagcaaaataccacagaataaagatgctaattcgaatttctcaacaaattccaattccttttcagaaaaattttggaattttattaggaagttctgtcaatatgagattaggtctaaaatgccaaaggagtatgatttatttgcctatccagaagagatcaacgtctggttgatatttcgccagtttgtcgatttaatcttgatgcaagattttgtgacttacattatttacgtttacctttctattccatatagctgggttcaaatcttcaactggagatctttgctaggtgttattttgattttatttaacatctgggtcaagttagatgcgcatcgcgtggttaaagattatgcttggtactggggtgatttcttctttttggaagaatctgaattgatttttgatggtgtcttcaacatctctccacatccaatgtattctattggttatttgggttattatggcctatcattgatttgtaatgactacaaggttcttctggtgtccgtatttggacattattctcaatttttgtttctgaaatacgtcgaaaatcctcatattgaaagaacgtatggtgatggcactgattccgattctcaaatgaatagcagaattgatgacttgatatcaaaagagaattacgattattcaagacctctaattaacatgggtctttcttttaacaacttcaataagctaagatttactgactatttcacaattggtaccgtagcggcacttatgttaggaacaatcatgaatgctaggtttatcaatttaaattacctctttattaccgtttttgtaacaaaactggtttcatggttatttatctcgacaatattgtacaagcaatctcagtctaaatggttcacgagattgtttttggagaatggttacacacaagtttattcctatgagcaatggcaatttatttacaattattatttggtattaacctacacacttatgataattcatacagggcttcaaatttggagtaatttttccaacataaacaacagtcaattaatttttggtttaattcttgtggctttacaaacatggtgtgataaggaaacgagactagcaatctctgattttggttggttttatggtgattttttcttgagcaactatatctcaactagaaagctgacttcccaaggtatctacagatatttgaatcacccagaagcggtattaggcgttgttggagtttggggtactgtattgatgacgaattttgccgttacaaatattatcttggctgttttatggacattgacaaattttattcttgtcaagtttattgaaacacctcatgttaataagatatatggtaaaactaaacgagttagtggtgttggaaaaactttactaggcttgaaacctctaagacaagtttcagatattgtcaatagaattgaaaatattataatcaaatcattagttgatgaaagcaagaactccaatggtggggcagaacttttgcccaaaaattatcaagataacaaagaatggaatattttaattcaggaagcaatggatagcgttgcaacaagattgagtccatactgtgaattgaaaattgaaaacgagcaggtagaaaccaattttgtcttgcctactccagtaactttgaattggaaaatgcccattgaactttataacggagatgattggattggtttgtataaagtcattgatacaagggcagatcgtgaaaaaacaagagttggatcaggtggtcattggagtgcgacttctaaagattcatatatgaaccatggattaagacataaagaatctgtaacagaaataaaggcgactgaaaagtacgttcaaggtaaagtgacattcgacacgtctttgctttattttgaaaatggtatctacgaatttaggtatcattctggtaactcccataaggtgttattgatttctacaccatttgaaatttcattgccggtactaaataccacgacacctgaactgtttgagaaggatttgactgagtttttgacgaaagtcaacgttttgaaggatggtaaatttcgtccattaggaaataagttcttcgggatggacagcttgaaacaattgattaagaactcaattggcgtcgaactttcgtctgagtatatgaggagagtcaatggtgacgctcacgttatttcgcatcgcgcttgggatataaaacaaacgcttgatagtcttgcttgagttttttttttttgagtatatatatttaaaaagtactaggattcaagttaacattttgaatagaagtagttatgttgttgtaatataatggagctaccatatatgcagaatgacattataaattatgatgttgatgtacaatgcctttgtgcgcttcttttaccatgaattttttcttaacctctttcacttttctttccgactaggataatctcgtgt

SEQ ID NO: 186 - DNA, 970 bp, Saccharomyces cerevisiae
atgcaaacccacacatgcatcgttggtttctgtccactgccactgcaatgaccactggataaggggtctttataagagaacacatatgaagaacatgaacgttcttggacagagccataaacagcaattgaagacaacaagaatagcgcaagtcaagcgatgaaggagtcagtccaagagatcatccagcaactcatccacagtgtcgatttacagtcttccaagttccagctggccattgtgtgcacgatgttcaatcctatcttttggaacatcgttgcaagaatggaataccacaagcattctctcaccaagatgtgtggtggggccagaaagggctgttacatgttggcggcgaccatattttcgctaggtatcgtcagagacatggtgtacgagtctgcattgcgtgaacagcctacgtgttctctgatcacgggcgagaactggaccaagctgggtgtggctctctttggtttggggcaagtgcttgttttgagttccatgtacaagctgggtatcacagggacgtacttgggtgactatttcggcatcctgatggatgagagagtcaccggcttccccttcaacgtttccaacaaccccatgtaccagggttccactttgtccttcttgggcatagccctttacaaaggaaagcctgcggggctggttgtttctgccgtagtttacttcatgtacaagatcgctcttcgttgggaagaaccttttactgccatgatctacgctaaccgtgataaggccaaaaagaatatgtaagtgctctatttctatatattctataatgttagaagcctatgctattaccgtttctatatagctccataagcaatttcttcgcgaaagtgaaaaaaaaaaattttaatgcgatgctctatttaacaaggaatacaatgagagcatctagcgcacacaaacaactacaaaacgcaataacgacacagcaaga

SEQ ID NO: 187 - DNA, 2787 bp, Zea mays
cgttcatccatcacagtatcacaccatccccactctcttctctccacccggcgagcggacactcccctgtcctcttgacccgatcccgtccccgcccgcccgccccgccgccgcgcgcgctggtccggacgctcgggcgctggtgatccggttgatgcagcagcggggcctcgcccacaactgccgctcccgcggcttctcccgctcccgccgcgcagtcgagggcgcctgaaacgcacccgccccacgcacgcagggcaaccgaaaacccctcgatccggctctcctcgcgctgtagcttttataacgccgtagacgacaacgaaagagaacggaaagaaataaaacccaccacacctaccgtcgtccgtagaggaaggaaggactcgagatggacaccgtcagcgtccccgtggtggccgttgcgaatgggatcggggaggtggagcgcaaggtgcagaagagctactgggaggagcactccaagtgcctcactgtcgagtccatgatgctcgactcccgtgccgccgacctcgacaaggaagagcgacccgagatcctgtctttgcttccctcttacaaagggaaatcagttctagaacttggtgctggaataggacgctttactggagatctggcaaaagaagctgggcacgttctggctctagacttcattgaaagtgtgattaagaagaaccaaagcataaatgggcatcacaagaacataaccttcaggtgtgccgatgtgacatctaacgacttgaagattgaagataactctgttgatctgatattttcaaactggctattaatgtatctttcagatgaggaggtccaaaagcttgtggggaaaatggtaaaatggttaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgcattggggcttatgtcaaaaacaagaagaatcaaaaccagatatgctggttatgggaaaaggtaaaatcaacagaagacagagattttcaaagattcctggacaacgtgcaatacaaaacaagtgggatattacgttacgagcgtgtctttggtgaaggttttgtgagcactggtggaatcgagacaacaaaggaatttgtgggcatgctcgatcttaaaccgggccagaaagtacttgatgtcggatgtggaattggaggcggcgacttttacatggctgcaaactatgatgtccatgttcttggtattgatctttcggtgaacatggtttcatttgcaattgaacgtgccattggacgcaagtgctctgttgaatttgaagttgctgattgcaccacaaaggattacccagaaaatagttttgacgtcatctacagccgtgacaccatccttcacatacaagacaagcctgctctgttcagaagcttcttcaaatggctaaagcccggtggcaaagtcctaatcagcgactactgtaagaatcctggaaaaccatcagaagaatttgctgcgtacattaagcagagaggctatgaccttcacgacgtgaaggcttatggacagatgctgaaggatgctggttttcataatgtcatcgcggaagatcgcactgagcagttcttgaatgttctacagagggagctaggtgaagttgaaaagaacaaagacgctttcctggcagacttcacccaggaggactatgacgacattgtgaatggctggaacgcgaagctgaaacggagctctgccggcgagcagaggtgggggttgttcattgccaccaagtgatttggcctggcagcaggagggctcttcggaataagaatggatgtggctctaactctgcttctagaccggtgatggttcagcttagaagcaggggatcttcatcatcagaataaaaacgtgtgttgttgtgttgctgtgtctacgccactagtatttctgttgttacttatgttctaggtaaactgcgcagccagagcagagctgaagaatatgtactgcttgctcgctcttgtgtggttgtgtctacccctactagcatttcagctttgttgtaggtaaactgcgaacccagagttgcagaacccgtactgctcgtttaagttcatggtgaactacgagctaaaaggctgttgccagagtggatgtcacttgtcactggaggtccccggttcaattcagatgttgctttggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggccaagctccaaccccacgccttcactacagccaacctttttttatagtgccacccaaattaaaaacacaggccaaaatataaaaaaccccgggattaaaaaaaccttggggttacacaacactttccctttgcaaaatatccccttttcccaaacgcccccattaacaaaaagtcccaaaaagagagccctccccaaaactcccccccacccaaattgtaaatgggaatcaccctcggccggggcattaaacacacccagagtgggggttacacttatcggaaccccaacacgagccaattccctatcgcccccccctttttctttcaccttttttttttttcctcccttatcgggttacccccggcgccctt

SEQ ID NO: 188 - DNA, 2101 bp, Escherichia coli
attttaaatagtaacaataacagtggggatactggatgacagacctttcacacagcagggaaaaggacaaaatcaatccggtggtgttttacacctccgccggactgattttgttgttttccctgacaacgatcctgtttcgcgacttctcggccctgtggattggccgcacgctggactgggtttctaaaaccttcggttggtactatctgctggcggcaacgctctatattgtctttgtggtctgtatcgcttgttcgcgttttggttcggtgaagctcgggccagaacaatccaaaccggaattcagcctgctgagttgggcggcgatgctgtttgctgccgggatcggtatcgacctgatgttcttctccgtagccgaaccggtaacgcagtatatgcagccgccggaaggcgcgggacagacgattgaggccgcgcgtcaggcgatggtctggacgctgtttcactacggcttaaccggctggtcgatgtatgcgctgatgggcatggcgctcggatactttagctatcgttataatttgccgctcaccatccgctcggcgctgtacccgatcttcggtaaacggattaacgggccgataggtcactcagtggatattgcagcggtgatcggcactatcttcggtattgccactacgctcggtatcggtgtggtgcagcttaactatggcttgagcgtactgtttgatattcccgattcgatggcggcgaaagcggcactgatcgccttgtcggtgataatcgccacgatctctgtcacctccggtgtcgataagggcattcgcgtgttatcggagcttaatgtcgcgctggcgctgggattgatcctgttcgtattgtttatgggcgacacttcgttcctgcttaatgcactggtgctgaatgttggcgactatgtgaatcgctttatgggcatgacgctcaacagttttgccttcgaccgtccggttgagtggatgaataactggacgctcttcttctgggcatggtgggtggcatggtcgccgtttgtcggcttgttcctggcgcgtatctcgcgtgggcgtaccattcgccagttcgtgctgggcacgttgattattccgtttaccttcacgctgttatggctctcggtgttcggcaatagcgcgctgtatgaaatcatccacggcggcgcggcatttgccgaggaagcgatggtccatccggagcgcggcttctacagcctgctggcgcagtatccggcgtttacctttagcgcctccgtcgccaccattactggcctgctgttttatgtgacctcggcggactccggggcgctggtgctggggaatttcacctcgcagcttaaagatatcaacagcgacgcccccggctggctgcgcgtcttctggtcggtggcgattggcctgctgacgctcggcatgctgatgactaacgggatatccgcgctgcaaaacaccacggtgattatggggctgccgttcagctttgtgatcttcttcgtgatggcggggttgtataaatctctgaaggtagaagattaccgccgtgaaagtgccaaccgcgataccgcaccgcgaccgctggggcttcaggatcgcctgagctggaaaaaacgtctctcgcgcctgatgaattatccgggcacgcgttacactaaacagatgatggagacggtctgttacccggcaatggaagaagtggcgcaggagttgcggttgcgcggcgcgtacgtggagctaaaaagcctgccaccggaagagggacagcagttgggtcatctggatttgttggtgcatatgggcgaagagcaaaactttgtctatcagatttggccgcagcaatattcggtgccgggctttacctaccgcgcacgcagcggtaaatcgacctactaccggctggaaaccttcctgttagaaggcagccagggcaacgacctgatggactacagcaaagagcaggtgatcaccgatattcttgaccagtacgagcggcaccttaactttattcatctccatcgtgaagcgccgggccatagcgtgatgttcccggacgcgtgattgttattgcataaaaccgcgccatgtctgca

SEQ ID NO: 189 - DNA, 2101 bp, Xenorhabdus sp.
tctttttcacttacttcaggaactgcctatgaatatcggagacagtccaaaaaacactcagaaggattcactaaactctgtcgttttttttacctcagccgcattaattattctcttttcgcttttcacgctcttttttacggatgcaacaagcatctggataaaaaacaccctgaactgggtttcgaaaacatttggttggtactacttgctggcagccacgctttacattgtctttgtcatttttgtggcagcttcccgctttggcgctattaagctcggcccggaacaatccaaacctgagttcagtctgctcagttgggcggcaatgttgtttgcggctggcataggcattgatttgatgtttttctccgtggctgagccgattactcaatatatgcgtccgccaacgggtgaaggagaaacaattgaagcagctcgtcaggcgatggtgtggacactgtttcactatggactgacgggctggtctatgtatgctttgatggggattgcactgggctatttcagttatcgttacaatctgccgttaactatccgttcggcgctttatcctattttcgggaatcgtatcaaagggccgattggtcataccgtggatattgccgcagtgatagggacgattttcggcatcgcgacaacacttgggatcggggttgtacagttaaactacgggctaaaggtgttgtttggattgccgcaggggttgggagttcagggcgggttaatattgctgtcggttatcgtggcaacaatatctgtaacctctggtgtcaacaaaggtattcggtttctgtctgagctgaatgtactgttagcgttagggttagtgctgtttattctgtttgtgggagatacagaatttctgcttaatgggctggtacagaatgtgggtgattacatcagccggtttatgggcatgactctcaatagtttcgcatttgagcgaccgacggagtggatgaatagctggacgttgtttttctgggcgtggtgggttgcctggtcaccgtttgtcggattatttcttgcccgtatttcccgaggtcgaacgatccgccagtttgtgatgggtacgctgattattccatttgtgtttaccctgatttggctgtctgtttttggcaatagcgcgttatatgaaattattcacggcaaccacgaattagcggaaacggtgttagttcatcctgagcgggggttttataacctgctggcactttatccggctttcacgttgagtgcttctgttgccacaattacagggctgctgttttatgttacgtcggcagattctggctcactggttttaggtaattttacgtctaatctcagtgacattaataacgatgcaccgaactggttgcgaatattctggtctgtggcaattggtgtactgacgctgggtattttgatgactgacggcatctcagcgttacagaatatgacggtaattatggggttgccttttagttttgtgatcttctttatcatggcaggattatataaatcgttgcgggttgaggattttcgcaaagccagcgcattgcagaatacatctccgacattggtgcatgataatggatcgctgaactggaaacagcgcctgagccgtatgatgcattttccgggtacgaaaagtactcagcgtatgctggatatggtgtgtcgtcctgcgatgcaggaagttgcaaaagagctggagttacgtggtgcaagtgtgcagtttaatatgctgccgtcagaagaagataaacgtcttactccaattgagttgattgtcgatctgggagatgaacagaattttatctatcagatttggccccagcgttattctgttccgggattcacttatcgtgcaagattaggcaaatcttattatttccggctggaaactttcttaatagaaggaactcagggtaatgatttgatggggtatacaaaagaacagattatcagtgatattctcgaccattatgagaagcatctgaattttattcatctgaatcgtgaatctccggggcagacgttaattttcccaaatggggtataaatcagaggtggcctgcaagagtattgcagg

SEQ ID NO: 190 - DNA, 1986 bp, Zea mays
gttggtggggtcattagcggagctgtgtgaggcgacgatggggctgggggctgcggtggcgctggcgctgggcgacccgccggcggactacgcctccatcgcggcggtggggctgttcgtggcgctcatgtgcgtctgcatcgtcgtcgggcacctcctcgaggagaaccgctggatgaacgagtccatcaccgcgctcttcatcgggctgggaactggagcggtcatcctgttcgcgtcgagcgggaagcattcgcgcgtgctggtgttcagcgaggacctcttctttatttacctgctgccgccgatcatattcaatgcagggttccaagtgaagaagaaacagttctttcgaaacttcattactattacactgtttggtgcagttggcaccttgatctcttttactgtaatatcccttggcgctctaggactaatatcaaggcttaatatcggcgcacttgaactgggagactatcttgcacttggggcaatattctcggccacagactcggtttgcaccttgcaggtgttaagccaagatgagacaccattcttgtacagcctcgtgtttggtgaaggtgttgtcaatgacgcaacttctgttgtgttgttcaatgcaatccagaactttgatcctggaaatatcagcagtgccaaattactgaacttcattggcagtttcctttatctgttcggctccagcaccattcttggagtagcttctggacttcttagtgcttataccattaagaagttgtacttcggcaggcattcaaccgatcgtgaagtttccattatgatgctaatggcttatttatcttacatgctagctgaattgctcgatttgagtggcattctcactgtgtttttctgcggtatcgtaatgtcacactatacttggcacaatgtaacagaaagttcgagggtcacaaccaagcatgcctttgcaacattgtcgtttatctccgagacttttctgtttctttatgttggtatggatgcattggatatagagaagtggaagattgtcggtcaaacttatagcccggtaaagtctatcgctttgagcagcaccattttagccttggtgctggtttcaagagctgcttttgttttcccactatcctttgtatcaaatttgaccaaaaaaactccaaatggaaagatatcttttaggcagcaggttattgtttggtgggcgggtctcatgagaggtgctgtgtctattgcgttggcttacaataagttcacaagatcaggccatactcaacaacctagcaatgctatcatgatcacaagcacaatcagcgttgttcttttcagcacaattgtctttgggctgctgacgaagccactgatcaggctcttgatcccgtcaaggcacctatccagggaaccaagcgccctttctgaaccttccagcccgaagtctttctttgagcagctggccgccaacagccctggacacccggatcttgagaatggcataagcctacgacgcccggcgagcctccgttttctcctagtaagcccggcacggtccgtccaccattactggcgcaagttcgatgacagtttcatgcggccggtgtttggtggccgtggcttcgttcccttcgtccctggttcacccactgagagcagcttgccattgcttcctggcaatgagaactgaaaccagcgtatcgaggggctttaattcagcagaagttttgtaaattggcttcgcttatggttataatattttgtgtaaatctaggtttgtagattcaacttggtagcatgtacatgttgatgtaggctagttaactgaccagcgaccaaacggctgtgcatattgatatctcgtcgctctcaatgagtttgtatttataaaatactctgtacatcggatcactaaatatgtatcgtctccaacttaataaatactcatccgttctaaaataatattagtcgttttagatttccaaaaaaaaaaaaaaa

SEQ ID NO: 191 - DNA, 2313 bp, Oryza sativa
gagaagagagttttgtagcgagctcgcgcgaatgcgaagccaaccgagagaggtctcgataccaaatcccgatttctcaacctgaatcccccccccacgttcctcgtttcaatctgttcgtctgcgaatcgaattctttgtttttttttctctaattttaccgggaattgtcgaattaggcattcaccaacgagcaagaggggagtggattggttggttaaagctccgcatcttgcggcggaaatctcgctctcttctctgcggtgggtggccggagaagtcgccgccggtgaggcatggggatggaggtggcggcggcgcggctgggggctctgtacacgacctccgactacgcgtcggtggtgtccatcaacctgttcgtcgcgctgctctgcgcctgcatcgtcctcggccacctcctcgaggagaatcgctgggtcaatgagtccatcaccgcgctcatcatcgggctctgcaccggcgtggtgatcttgctgatgaccaaagggaagagctcgcacttattcgtcttcagtgaggatctcttcttcatctacctcctccctccgatcatcttcaatgcaggttttcaggtaaagaaaaagcaattcttccggaatttcatgacgatcacattatttggagccgtcgggacaatgatatcctttttcacaatatctattgctgccattgcaatattcagcagaatgaacattggaacgctggatgtaggagattttcttgcaattggagccatcttttctgcgacagattctgtctgcacattgcaggtcctcaatcaggatgagacaccctttttgtacagtctggtattcggtgaaggtgttgtgaacgatgctacatcaattgtgcttttcaacgcactacagaactttgatcttgtccacatagatgcggctgtcgttctgaaattcttggggaacttcttttatttatttttgtcgagcaccttccttggagtatttgctggattgctcagtgcatacataatcaagaagctatacattggaaggcattctactgaccgtgaggttgcccttatgatgctcatggcttacctttcatatatgctggctgagttgctagatttgagcggcattctcaccgtattcttctgtggtattgtaatgtcacattacacttggcataacgtcacagagagttcaagagttacaacaaagcacgcatttgcaactctgtccttcattgctgagacttttctcttcctgtatgttgggatggatgcattggatattgaaaaatgggagtttgccagtgacagacctggcaaatccattgggataagctcaattttgctaggattggttctgattggaagagctgcttttgtattcccgctgtcgttcttgtcgaacctaacaaagaaggcaccgaatgaaaaaataacctggagacagcaagttgtaatatggtgggctgggctgatgagaggagctgtgtcgattgctcttgcttacaataagtttacaagatctggccatactcagctgcacggcaatgcaataatgatcaccagcaccatcactgtcgttctttttagcactatggtatttgggatgatgacaaagccattgatcaggctgctgctaccggcctcaggccatcctgtcacctctgagccttcatcaccaaagtccctgcattctcctctcctgacaagcatgcaaggttctgacctcgagagtacaaccaacattgtgaggccttccagcctccggatgctcctcaccaagccgacccacactgtccactactactggcgcaagttcgacgacgcgctgatgcgaccgatgtttggcgggcgcgggttcgtgcccttctcccctggatcaccaaccgagcagagccatggaggaagatgaacagtgcaaagaaatgagaatggaatggttgatgaggagaatacatgtaaaatgtgacagcaaaagagagaaggcaagttttgggtttgtagagtttggctgctgctaatgagttgttgatagtgcctatattcttcagaacttcagatggtgcctcaccaaggcctaagagccaggaggaccttctgataatggttcgggatgattggtttgttctgtcaggatgaaccctagtgagtgacacagggtgatgtgctccgacaacctgtaaattttgtagattaacagccccatttgtacctgtctaccatctttagttggcgggtgttctttcctagttgccaccctgcatgtaaaatgaaattctccgccaaaatagatttgtgtgtataataattttgcttggttg

SEQ ID NO: 192 - DNA, 2747 bp, Zea mays
gaattcccgggtcgacccacgcgtccgcccacgcgtccgcggacgcgtgggcgcgtctcccacacggccgccgccctcgccttcgtgcgttccccgcgtagagtttagggttttgtcgccgccatggcgatcctctcggcgctcgccaccgaggtgttcatccccgtcgccgccgtcatcggcatcgccttcgccgtcgtgcagtgggtgctcgtgtcgcgggtgaagctctccccggctgcagccgcgtccggcggcagcaagaacggctacggcgactacctcatcgaggaggaggaggggctcaacgaccacaacgtcgtcgtcaagtgcgccgagatccagaccgctatctccgaaggagcaacatcgtttcttttcactgagtaccaatatgttggtatcttcatgtccatctttgctgttgtgatcttcctcttccttggttcggttgagggattcagcacgaagagccagccctgcacctatagcaaggacaagtactgcaagcctgcactgttcactgcactctttagcactgtgtccttcttgcttggagccatcacctctctggtctccggtttccttggcatgaagattgccacatatgcgaatgccagaactaccctggaagctaggaagggtgttggcaaggcttttatcaccgcttttcgctctggtgctgttatgggcttcctgcttgcatcaagtgggcttgtggttctgtacatcaccattaatgtatttaagttgtattacggtgatgactgggagggtctttttgagtctatcactggctatggccttggtgggtcgtccatggctctctttggaagagttggtggaggcatctacacaaaggctgctgacgttggtgctgatcttgttggaaaggtcgagaggaacattcctgaggatgatcctaggaacccagctgtgattgctgataatgtcggtgacaatgttggtgacattgctggaatgggatctgatctctttgggtcatatgcagagtcttcctgtgctgcccttgttgttgcgtctatttcatctttcggaatcaaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccactgtcctgatgactgttggtattgctgtaatcagctggttggcccttccagctaagtttaccatcttcaactttggtactcagaaggatgtctccaactggggcttgttcttctgtgttgcaattggtctgtgggctggtctgattattggttttgtcacagaatactacactagcaatgcatacagtcctgtgcaagacgttgcagattcttgcagaactggtgctgccactaatgtcatttttggtcttgctcttggatacaagtcagttatcatcccgattttcgctatcgctgttagcatctatgtcagtttctccattgctgcaatgtacggcatcgcagttgccgctcttggtatgctgagcacaattgcaactggtcttgctattgatgcttatggtcccatcagtgacaatgctggtggtattgctgagatggctggaatgagtcacagaatccgtgagagaactgatgctcttgatgctgctggcaacaccactgccgctattggaaagggatttgccattggttcagctgctcttgtgtctctggcgctttttggtgccttcgtcagcagagctggagtgaaggttgtcgatgtcctctcccccaaggttttcattggtttgattgttggagccatgcttccctattggttctctgccatgaccatgaagagtgttggaagtgccgccctaaagatggtggaggaggtccgcagacagttcaacaccattcctgggttgatggagggaactgccaagcctgactatgcaacctgtgtgaagatctccactgatgcttccatcaaggagatgattcctcctggtgctctggtcatgctcactcccctcattgttggaaccctcttcggtgttgagactctctctggtgttcttgccggtgccctggtttctggagtgcagattgccatctctgcttccaacaccggtggtgcatgggacaatgctaagaagtacattgaggctggtgccagcgagcatgccaggaccctcggccccaagggatctgactgccacaaggctgctgtgataggtgacaccattggtgaccccctgaaggacacctcgggcccgtccctcaacatcctgatcaagctcatggcggtggagtcccttgtgtttgcccccttcttcgccacccacggtggcctgctgttcaagtacctgtaagggccacaccaatcatcacagcagaaatatacgaccgaccgaccgtggacatctcgaataactcctgccaaatcgccagttcatgtgtattgtgcgctagccgcctagctgcactgctgtttttttggtctcattgttcgtattttctccttggcccctccccctagaggcgttactgttagccttactcttactccctgtagctgcacgtagaagagaactgttgtcctgcaggtctggcaaattttcccagtctcttgatgatggcgatgatgttgaaatctttgaacaatgatacatgattgttgcaaaaaaaaaaaaaaaagggcggccgc

SEQ ID NO: 193 - DNA, 2796 bp, Zea mays
ccacgcgtccgctcccggattctctccggttcgtgggagggccaaagcttcgagttaggaaaaccctaccgctgtgggagtagcctccggcgatggctgcggcggcgatcctgccggagctggcgacgcaggtgctcatcccggtcgcggcggccgtgggcatcgcgttcgcggtggtgcagtgggtgctggtctccaaggtgcgggtcacccccgagcgccgcgcggacggcggggccgtgaagagcgggcccagcgactacctcatcgaggaggaggagggactcaacgaccacaacgtcgtcgtcaagtgcgccgagatccagaccgccatctctgaaggagctacatctttccttttcactgagtacaagtatgttggattattcatgggcatctttgcaatccttatattcctcttccttgggtctgtcgagggattcagcacgaagagtcaaccttgccactatatcaaggaccagacttgcaagcctgcccttgctaatgccatcttcagtactatagcttttgtgcttggtgcagtcacctcactagtttccggctttcttggaatgaagatcgcaacttatgcgaatgcccggacaactttagaggccagaaagggtgtcggaaaggcatttattactgccttccgagctggtgcagtaatgggcttcctgcttgctgccagcggtcttttggttctttacattgctatcaatttgtttggaatttattacggtgatgactgggaaggtctttttgaagctattactggttatggccttggtggttcttctatggctcttttcggccgcgttggtggtggtatttataccaaggctgctgatgttggtgctgaccttgtggggaaggtagaaagaaacattcctgaggacgatccaagaaacccagctgttattgctgacaatgttggtgataatgttggagatattgctggaatgggatcagatctctttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagttggcttggtcttccatacactttcactattttcaactttggagtccagaagacagtgcaaagctggcaattgttcttgtgtgtggcggttggtctctgggctggcctagtcattggttttgttactgagtactacacaagcaatgcctacagccctgtacaagatgttgctgattcctgcagaactggagcagctactaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctgggatgagccataggattcgtgagagaactgatgctctagatgctgcaggaaataccacggctgcaattgggaagggttttgccattggctctgcagccttggtttcccttgcactatttggtgcgtttgtaagccgggctgctatctccactgttgatgttctgactcctaaagtattcatcgggcttattgtcggtgctatgctcccgtactggttctcggcaatgaccatgaagagtgtgggcagtgctgcgctcaagatggtggaggaagttcgtcggcagttcaacaacatccctgggctcatggaaggcaccacaaagcctgactacgcaacttgtgtcaagatctcaacggatgcatccatcaaggagatgatccccccaggtgctcttgttatgctcacaccactgatcgttgggattctatttggggttgagaccctctctggagtccttgctggtgcccttgtctctggtgttcagattgccatttctgcatccaacactggtggtgcctgggacaacgccaagaagtacattgaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgccgcccatggtggcattctcttcaaatggctctaagccagcgagagacgcaggataaaggccgtagttttgcaaggcgagtagagcagtatgtcagtaatacagcatctatggcatgtgcttttgctcgtccagttcatgagccccgttgtgtatttggtttccgttttcttggttggagtttttagttccaaggtccgatcatgttttgatcccataaattctcttccagccttcgagcaactgagtccatcttcctaagtcatcagccccagcgagacattgaagcatggggaaacttaaacagtatggtgatgattaatctcagcattttttttcttgcagcaaaaaaaaaaaaaaaaaaaaaaaaaaaaaaaaaaaaaaaaaaaaaaaaaaaaaaaaaaaaaaaaaaaaaaggggcgggcggttctagaagaac

SEQ ID NO: 194 - DNA, 2571 bp, Zea mays
caactccctccatcgtcttgaggcgtgcgcagccatggctgtcctcggcaccgcggcggttgaggtgctcatcccggtagcggcattggttggcatcgctttcgcgttgttgcagtggtatgtggtggccagagtccccgtgccttcgcacgccggcgaggacggcggtggaggaggcaataagaacgtgagggaggaggaggagcatgtggaggaggacggcatggactaccttctcgtggaggcccggtgcgccgagatccagcgcgccatctccgtcggcgccacgtcgttcctgctaaccgagtacaagtacctggccgtgttcacggcggcgttcgcggtggtgatcttcgtgttcctgggttcggcgcagcggttcagcgcgcgccctgggccgtgcgcgtacgacccgtcgcgggagtgccggccggcgctggcgaacgcggccttcagcgcggtggcgttcctgctgggcgcggcgacgtccgtgctgtccgggtacctcggcatgcgcgtggcgacgttcgcgaacgcgcggacggcgctggaggcccgccacggcgtggggcgcgccttcgccgccgcgttccggtcgggcgccgccatggggttcctcctcgcctccagcgcgctgctcgtgctctacgccgccgtcaacctcttcggcctctactacggcgacgactggggcgggctctacgagtccatcaccggatacggcctcggcgggtcctccgtcgcgctgttcggtcgcgtgggcggcggcatctacaccaaggccgctgacgtcggcgccgacctcgtcgggaaggtcgagcgcaacatccccgaggacgaccctcgcaaccccgcggtgatcgccgacaacgtgggggacaacgtcggcgacatcgccgggatggggtcggacctgttcgggtcgtacgcggagtcgtcctgcgcggcgctcttcgtggcttccatctcctccttcggggcggagcacaacctcacggcgatgatgtacccgctgctcatcagcgccgtgggcctgctcgtgtgcgcgatcaccactgtcgtcgccaccgacgtcaccgaggtgaagggttccgacgaggttgggccggcgctcaagcggcagatcctcatctccaccgtgcttatgaccgccggcatcgccgccgtcaccttcctcggcctgccgcccagcttcaccctcttcgacttcggcaacgacaagcacgtcaagaactggcacctattcatctgcgtgtcggccggtctgtgggcggggctcgtgatcggctacgtcaccgagtacttcacgagcaacgcgtacggcccggtgcaggcggtggcgcggtcgtgcaggacgggcgcggcgacgaacgtcatcttcggcctggcggtgggttacaagtcggtgatcgtgcccatcatggccatcgcggcggccatctacgccagcttccgcctggcggccatgtacggcatcgcgctggcggcgctggggatgctgagcaccatcgccacggggctcgccatcgacgcctacgggcccatcagcgacaacgccggcggcatcgcggagatggccggcatgccgcaccgggtccgggagcggacggacgcgctcgacgccgcgggcaacaccacggccgccatcggcaaaggcttcgccatcggctccgcggcgctggtgtcgctggcgctgttcggcgcgtacgtcagccgcgccgggatcacggcggtggacgtgctgagcccgcgtgtgttcgtgggactcctcctcggcgccatgctcccctactggttctcggcgatgaccatgcggagcgtcggaagcgcggcgctgaggatggtggaggaggtgcgccgccagttcgacaccatcccgggcctcgccgagggcctcgccgtgccggactacgccacctgcgtcaggatctccaccgacgcctcgctcaagaagatgatggcgccgggcgcgctcgtcatgttcagcccgctcgtcgccggtacgctcttcggggtcgagacgctcgcggggctcctcgccggcgcactcgtctccggcgtccaggtcgccatctctgcctccaacagcgggggtgcatgggacaacgccaagaagtacatcgaggccggcttgtcggaggaggcgaggtcgctggggcccaagggatcggaggcgcacaaagcggcggtgatcggggacaccatcggcgacccgctcaaggacacctccggaccgtccctcaacatcctcatcaagcttatggccgtggagtcgctcgtcttcgcgcccttcttcgccgcgcacggtggcatcatcttcgaccacctctgatcaatgcatgctgctgacgttccatggcaaaggcgccggctgtcgccgcaagccgcctctttgaatttgccgtgatcagttagtaagaataatcgtcgtgtatgtagcctgtaacaagtaatgccagaccaccagagttggaggcttattcatgtctggccctcttatcttacccttgaatatgttgctcggtatgctgcaactgcaatacaaagcgcgaacactagtcggctaaaaaa

SEQ ID NO: 195 - DNA, 1226 bp, Glycine max
tctcactcttcttgcagcatctctctccattaccttcataactcaatctcccattattattagagatgacggttgaaaaggaagatttgggtttgagtctaagcttgagcttccctcagaaccccccaactcatcttcatctcaatctcgtttcctcttctccttccagccacaaccctcagaaaccctcttggaacgaccctttcacttcttcagctggatcatcattccttcgaggaatcgatgtgaaccgtttaccttctgtggtcgattgcgaagaggaagcaggtgtgtcatctccaaacagcacggtttctagtgtcagtggaaaacgtagcgagagggaagaagccaatggtgaagaaaacgacacagacagagcttgttccagaggcatcatcagcgacgaagaagatgccgaaacctctagaaagaaacttagactctccaaagaccaatcaattatcctcgaagagagcttcaaagaacacaacactctcaaccccaaacaaaagttggcgctggcgaaacagctgggtcttcgagcgagacaagtggaggtgtggttccagaacagaagggcaaggaccaagctgaagcaaacggaagttgactgtgagtttttgaaaaggtgctgcgagaatctgaccgtggagaacaggaggttgcagaaggaagtgcaagagcttagagcactgaaactttccccgcagttctacatgcacatgaccccacccaccactctcaccatgtgcccctcgtgtgagcgtgtcgcggttcccccctcctccgccgttgatcctgccatgcgtcaccatcacgtgcctcctacacaacctcgggccttccccattggcccatgggccaccgctgccgccactatcccgcacaggcccttcgatgccctccgtcgcagatcttgactcgtcgaaacaaaatgacaaaatttgaaaaaaagaaaacggttgtaatagtaggaagccatgaattatgtgttcaaagtgtggtctaagatatggtggttaggaaaactgattttgtgggtctctaatgttttgtactagtttgacccttcgtctttgttttgggtttcggagcatgacctggtttagttagttagaggtttttttagtttgtaatacttactgcgttactctcatttctcatgattaaatcggagattctgtaaagttcagtagtcttaataaatattatatattacatat

SEQ ID NO: 196 - DNA, 795 bp, Glycine max
atcactttgtcccttttcatacattcacatattcattttgccacaccttaaaaccaagcacccggccatatttcaatttttgttttggttagttgtcatgaagagagaaagagaggttgatagcttaaccatggcgaattgtttgatgttgctttctcgtggaagtgaatttgaggccacctactcaagcacttctatgagcaatcgtgtctttgagtgcaagacatgtaataggcaattcccttcatttcaagcacttggtggccacagggctagccacaaaaagcctaggttgatggcaggagatatcgaaggccaattgcttcatgattcacccccaaagcctaagactcatgagtgttccatttgtgggttggagtttgctatagggcaagccttgggaggtcacatgaggaggcacagagcggcgaatttgaatggaaacgtgcacaattctacggctacgagtagtagtagtgggggtagcagttttgattcatcgccaaagaagaaagctgacaacaagagagttttggttttggatttgaatctgacaccctttgagaatgatttggagtttttgaagattggaaaaccaaccacttttgttgattatttgtattgattgatctgttgagtgtactgttaattaaacttaggaaggtatagtttgtgtatcatagataggtgaatgctttgtttttttaatctaccgtctatatttgtttatcatactgtatgaaaaattgctcatttcttgggcaaaattagaacttcatcatgatattctgagtc

SEQ ID NO: 197 - DNA, 1329 bp, Glycine max
gcgggaacaacaacaactgaagaaagagagagagagagagagagagaggtgtgaagttggtgaaggtttttgagaagaaagatggaacgaagtggcggaatggtaactgggtcgcatgaaaggaacgaacttgttagagttagacacggctctgatagtaggtctaaacccttgaagaatttgaatggtcagagttgtcaaatatgtggtgataccattggattaacggctactggtgatgtctttgtcgcttgtcatgagtgtggcttcccactttgtcattcttgttacgagtatgagctgaaacatatgagccagtcttgtccccagtgcaagactgcattcacaagtcaccaagagggtgctgaagtggagggagatgatgatgatgaagacgatgctgatgatctagataatgagatcaactatggccaaggaaacagttccaaggcggggatgctatgggaagaagatgctgacctctcttcatcttctggacatgattctcaaataccaaacccccatctagcaaacgggcaaccgatgtctggtgagtttccatgtgctacttctgatgctcaatctatgcaaactacatctataggtcaatccgaaaaggttcactcactttcatatgctgatccaaagcaaccaggtcctgagagtgatgaagagataagaagagtgccagagattggaggtgaaagtgccggaacttcggcctctcagccagatgccggttcaaatgctggtacagagcgtgttcaggggacaggggagggtcagaagaagagagggagaagcccagctgataaagaaagtaaacggctaaagaggctactgaggaaccgagtttcagctcagcaagcaagggagaggaagaaggcatacttgattgatttggaaacaagagtcaaagacttagagaagaagaactcagagctcaaagaaagactttccactttgcagaatgagaaccaaatgcttagacaaatattgaagaacacaacagcaagcaggagagggagcaataatggtaccaataatgctgagtgaacataatgtcaaaagatggcagagaaaacttatagatggaatagatttagaaagagagaatacattagccagaaagagaaaaaaaaattggacattagttgatgattctttctaggtgtgcgtttggaatacaatgaagtaaaggatgaaccttaagacatgctttatcctaaaatagtgtgatctgatattccattgttaatgagtaatgtaattatcatacaaacaatttgtagtctcattttaattaataattattaaactacttgatta

SEQ ID NO: 198 - DNA, 1198 bp, Zea mays
cgctgccacatctctcctcgtccaaagactccaagctcctgtgcggcctgtgttctgctgccgcctctggtccacatctccccgccgccgccccgtcgtctgccgacacctttagcgctgggaaggatcacaggggatcggcgcgaggcgggggacctgcggtttttgtcgcccggatggcggcggagcgatgacactggcgtcgggagcggcgcggcgttgggatgcggacgatctgcgatgtgtgcgagagcgcaccggcggtgctcttctgtgcggccgacgaggcagcgctttgccggccctgcgacgagaaggtacacatgtgtaacaagcttgctagtcggcatgtgagagttggacttgcagaccctaataaacttgtccggtgtgatatatgtgaaaattcacccgctttcttctactgtgagatagacggcacctcactttgcctgagctgtgatatgactgttcatgttggtggcaagcgaacccatggaagatacctgctcctaaggcaaagggttgaatttccaggagataaaccgggccatatggatgacgtgcctatggaaatccaagatcctgaaaaccagagagaccagaaaaagccacccaaggagcaaacggcaaaccaccataacggcgatgatccggccactgatggcaactgtgatgaccagggtaacattgattcaaaaatgatcgatcttaatatgcgcccggttcgtactcatgggcaagaatcaaattcccagactcagggggtaggtcttagtgtgaacaaccatgactctccaggggtggtgccaacaagcaattccgaaagagacaccagcaagtaaacgttggaagatcggaatatacatttcaactacatatactgttctatacgagttcattttgtggtgtgtgtgtgtgtcactaatttttactcaattctaaattataagtcattctaacttttttgaagaggtaaagtatctcaggtttgactaaaattgtagaggtaatcacagatttatgacatcaactaggtatattttaaaaatataattaattaaaacactaataatacttatttggtatcatgaatgtgattgttttattatataaatttgatcaaacttgagatgctttggctctcttaagaaaattagaatgtactagtaagtatatttttggcagagttgtagct

SEQ ID NO: 199 - DNA, 1178 bp, Glycine max
ggctcgagctcgagccgccaaaaccacccaacactcgaactcaatatccattattaccaaaaaaaaagaaaaaaggatatcaaacacccttttcatcattaaaactctcagttccctctttccctatcaaaaccctttcccacaacactactcactccagtacaagaaaccctttttcaatttggtttcaacagcacacacacacacacatatatatatatatagcatgtttaccttgaatcattcttctgatttgtaccatgtttcccctgagctctcatcttccttggacacatcctcgccggcttcggagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggtttggtttttgttgttagttttttggagtgaacagtgtctgtactggttttttattagtagtacggatactagttataggtggaaagattgcgagggaccaaaaggaattttcttttgaacccttttttgtcaatgtaatcaatatcacgtatatcatgaagtgaatcccttcaaaaaaaaaaaaaaaaaaaaaaaaaaaaaaaaaaaaaaaaaaaaaaaaaaaaaaaaaaaaa

SEQ ID NO: 200 - DNA, 2439 bp, Glycine max
gaattcggctcgaggtgccggctgtgatgcaggcgacgcagggggaacagagcaacaatgcctccgctgttcattgggagcgctttctgcctcggatggtgcttcgggtcttgcttgtcgaagctgatgattctactcgacagatcattgctgcacttctccgtaaatgcggttacaaagttgttgcattttgtgatggcttaaaggcatgggagacattgaagaacaaagcatttgacttagatctcatattaacagaagtggatttgccatcaatatctggattttcacttcttactttaatcatggagcatgacatttgcaaaaacattcctgtcataatgatgtcttctcatgattcagtaagcatggtgtttaaatgcatgttaaaaggtgcagctgattttcttataaaacctgttcgcaagaatgagctaagaaacttgtggcagcatgtatggagaaggcacgccataagcaggcctcctcaaaatttaacactgccggagattgaacttggttttgctgcagaaaaccatgctgcaagcaatgactctagtggttctgtggcttctacaccaaaagatgatgaatgcagtgagaaaacaagtgaggctcatagcacttgcccatcgccatttttggaagctgagagtacctacatggaaaatatgcaggatatattgcagctgaagagctcttcaaatttgagcaatattgacacagtgaagcatgaaaactctaccaaatgtgaaagggagtcagataagcataatgatgaagctggagagaaatcactgtttatattggaagatgcaaggtgcaacaaaacttttaaaccaacaggtttaaggctaggtcaaagctatgagtgccatgaaacgagaaatcaagatgaagttctaagaatagagttgataaaatccaatcctgaaattaatacagatattcatagatgcagtgatgaactggtagatccttctactggcgccattgacttgattgctacattcaagaatcttccaaagagcactgatgaaaaatgtagtttcagtagtggtaacactgccaagtttgattttgatacacaattggaactttctttaagaagagattttcctggaagctcatgtaaagctgcattcaaggaaaggcaaatattgaaccattcaaatgcttctgccttttctaggtatagtaatagtaagttgttgcagcccctttttccaacaccatcaactatctctgctaaattaaccaatgccagtcagaattctcatgaatcccttaaattatcaaaaaatacatctacttctcatcaatatagtgaaaaaagtcaaaatcaggaggagaaaatcatcacttcagtcattggtcagtctggacaagttgatccaaaattaccaaacagtcaacttggattgtttcctgctacaggggttacttctgatcacaagtctaaaggaaatggaaatgtcttcccttctaagctttatgcaaaatcaggtgtccatcccatatcgactccaaaatcagtgtgccagaaagagagttctccatttcccacaagcacttcctcccagtccaatcctcaaagtcacaactcagaacgtcatcactggttggaagatgcaacccatgcttctgatcaaaatgtaaatgatcaaagcaatttggaatgtgagacacatgactctcctgctgctagtcagagtgctggtcctagttttttccatgacacagcaaatcataatagtagtggtgtatacagaagtgatggaaatgctacttcagctaaggtagccaaggagagccatgaaatttttattgatagtggtcaacgcagttatgatggattcatagggacagattctcatcgcactagccaacgagaagcagctctaacaaagtttcgactgaagcggaaagacagatgctatgagaaaaaggtgcgatatcaaagccggaagagattggcagagcagcgccctcgcgtgaaagggcaatttgttcgccaagtacacgatgatcatccagtagcagatgtgggtggtggttcctgaaattgttttgttaccatcatcattgaattacagtctgacttccaaaactgatttgcctctcttgacaaggattaactgtaggatctagtttgtctggtgaaattatgtttcttcttagcattgttagtattttcttctggtttgttatattggctgtctcttagaatgtaggattgtaattatttagtaggattgatttgaagttttgattttacctagagtatttgttttcttgattgaatactaatatagggctatcgttgtataggcagtatgcgtctgtcttgaaagattcaaataccttttatatatatatatatatatctcggcaagcatctctggtttgcaatcaaaaaaaaaaaaaaagggcggccgc

SEQ ID NO: 201 - DNA, 1447 bp, Glycine max
gaattcggctcgaggtcgctaatcctagttccttcaactcctcgctggcaacaacagcagtactaccattagccgcgtttttcaaaagtgattttcgagaattagcgatgggaattgaaagaggaggcttcaagggattcaggagcgcctggagcgtgccgcccaagccgtgcgattcctgcaagctggcctcggcggcgcttttctgccgccccgattccgcgtttctctgcatcgcctgcgattccaacattcactgctcgaacaaactcgcgtcgcgccacgagcgcgtgtggatgtgtgaggtgtgcgagcaggcacccgctgctgtcacgtgcaaggccgacgccgccgccctctgcgtcacgtgtgactccgacatccactccgcgaaccccctcgcgcaacgccacgagcgcgtccccgtggaacctttctttgactccgctgagtccatagtgaaagcctctgctgccgccaccttcgggttcattgtcccatccgacgacggcggcgcctccgacgctttcgcccccgatgactccgacgccgccgcgtggctcatcccgaaccctaatttcgggtccaagctcatggacgcccccgaaatcaagtccaaggagatattcttctctgaaatggaccccttcctcgattttgattactcaaactccttccaaaacaacaacagcgccggaaacgacagcgtcgttccagttcaaaaaccctctctcgcccctcccctaatcaataatcaccaccaccaccaatcagaaacttgcttcgacgtcgatttttgtcgctcgaagctctcctcctttaactacccttccaattctcttagccaaagcgtttcgtcgtcgtcgcttgatgttggagtggtgccggacgggaatacggtgtcagacatgtcgtattcttttggtcggaacagttcggattcgagtgggattgttgttgtgtcaggaaatagtgtggggcaaggtgcgacgcagttgtgtggaatggatcgggaagcgagggtactgcgatacagagagaaaaggaagaaccgaaaattcgagaagacaattcgatacgcatcgcgaaaagcatatgcggaaacccggcccaggataaaaggccgcttcgccaaacgaacagaaattgactcggatgtggagcgtctctatagccctggccctgcggtgctcatgctggacactccatacggcgtcgtaccatcgttttagttaatttcaaaatgaagaaacgatggagtgcatgaatcttagaataatgattagcgattctgtgggattgttaggggaaaaaggtgaagaatcgaatcggtacgaacgtgattcttagctggagcgcgatgggggaagattattgtgaagatttgtctcgatcgaccagaaaagcccgtttactttttataaaaaaaaaaaaaaagggcggccgc

SEQ ID NO: 202 - DNA, 2007 bp, Glycine max
aaaaaaccaactacatcagctcatggcaacccccaaccccaccagattctcccttgccatggagagaaccgggcaatgggttttctccccagaaatccccaccgatgttattgttgcagttggacaaaccaatttttctctccacaagtttattctggcggcgaagagtaactacgtcagaaaagtgataatggaatcagaggagagtgacctaacaagaatagagatttccgacatacctggaggatcagaagcttttgagaaagcggcgaagttctgttacggcgttaacttcgagatcacggttcacaacgtggcggcgctgcactgcgccgctgtgttcctccagatgaccgacgagtattgcgacggaaacctcgccggaaggacggaggattttctctctcaggtcggcctctccacgctccacagcgccgtcgcggttctcaaatcctgccaaaagattctccccttcgccgccgaggtcaacgtcgttgaccgctgcgttgaggtcatcagctgcaaggcttgcaacgaggcgaattttccgagccagtcgccgccgaactggtggacggaagagctcgccgtgctcgacgtggattccttcgcgaaggtgatcgccgcgatgaagcagcgtggcgcgaagtacctaaccgtcgccggagctttgattacgtacaccgaacgcgcgctgagggagctcgtcagggatcactccggcggcggaagaggaatccggtcaccggaatccggagactccgattcggagtcgaaaagaagcgaacagcgcgagcttctgcaggctatcgttcctctctttccgacggagaaagccgcgtttccgatcaacttcctctgctgcctcttgcggtgtgcgatctacctccgcgcgtcgagcgcgtgcaagcgcgagctggagaagcgcgtgacggagattctcgagcacgtgaccgtcgacgacctcctcgtgctcacgttctcctacgacggcgagaggctcttggatctggacagcgtgaggagaattatctccggttttgtggagagggagaagggcacgacggtgttcaacgccggcgtcaacttcaacgaggacttctccgccgcgatgcagcgcgtggccaaaaccgtcgactcgtacctcgctgagatcgccgcgtacgccgaactctccatctcgaaattcaacggcatcgccatcctcattcccaaaggcgcgagaaaatccgacgacgatctataccgcgccgtcgatatctacctcaaggtgcacccgaacctggacgagatagagaaggagaaagtgtgcagtgtattggacacgttaaaactgtcctacgaggcgcgtgtgcacgcgtcgaagaacaagcgtttgccgctacagatcgtgcttcacgcgctgtactacgaccaactacaaataaggagcggtacggcggcggacaagcaagctgtggtggcggcggcggagaaaaaacagctgcaagctgacgtgtccttggtgagggagaacgaggagctgcggtcggagctgatgaagatgaaaatgttcatttccgatttgcagaagaatgttcacggaacgtcgtcgtctgggagggagaatattgggcccactaaaaagcccacgttcttctcgtccatgtccaagaaactgagcaagttgaacccgttcaagaatgggtctaaggacacgtcacacatcgacgatgcccctgtggacttgaccaagcccagaaagagaaggttctccatttcctagatttgctttccttagtcaattccaagctttgtcaaaaagaattttaaattttttgaagtaattacgttttctctcttgattgttaattttttttcatgaaagtgtcaatttgtaattaagaaaaaagtgagacgtgattggatttcttaaattagatttgttcatatctgtatgttaagatgtatttgatctggatatataggaacatcctagtttcaatatgaattaatgagaattataat

SEQ ID NO: 203 - DNA, 1318 bp, Zea mays
ccagcgtccgaattaacaaatcacactgctttaatggggcgatcgccatgctgtgagaagattggactgaagaaaggcccgtggacaccggaggaggatcagaagctgcttgcctacattcaggagcacggacatgggagttggcgagcattgcctgtgaaggcgggcttgcagaggtgtgggaagagctgcagactgaggtggacaaactacctgagaccggacatcaagaggggcaagttcagcttgcaagaagagcagaccatcatccagcttcatgctcttttaggcaacaggtggtcggccattgcaacccatctaccaaatcgcacggacaatgagatcaagaactactggaacacacacctcaagaaaaggctggccaagatggggatcgatcctgtcacccacaaatctatcagtggcactcgcattggcaccacaaacgacaaatcaaccaaggccgccgcaagcctcagccacatggcacaatgggagagcgcccgcctcgaggctgaggcacggctggctcgagaatcgaagatacggacagcaacgccaacaccaactgctctccatgcgcagccaacgatactacctgcctctgctgcttctccatgccttgacgtgcttcatgcatggcagggtgcaaagatagacctggagtctccaacctccacgctgacgtttacagggagtaatagtggaacgctgccaacccccaggaccaatagactagacgtatcagaaagcaactgtgcagtgtggcatcagaggagtgatgacttggaggatgaagaaaacgattggcagatcttcagcaagcaccaattgctggaactcgacagcaaggagagggaagaggacttcattggttgtgaggagccgtggttctcagagatggctggggttggagctggcttcactggcatgctgcttggtgtatccaatgagcatgatgcatcagaatgctggggtgagtccaataatggccaaactgagcgcagcaaccaagcatcagatgaggaggacaagaattattggaatggtgtccttgacatggtaaactcagagctgacacccaagtcgcctccatttgtctagactctagaatacagtcccctccgttttatttcaagtactcctgagcaaaatctattggatcatctcaagtcaaaagagaaacagaacaagcactacaaataaatgctgcatgtgctacaacaatatgttttttttgtccatgcatgtgaaagtgaaataattaactattgtgtggatggagtaaaaaaaaaaaaaaaaaaaaaaaaaaaaaaag

SEQ ID NO: 204 - DNA, 1161 bp, Arabidopsis thaliana
gtcgacccacgcgtccgaaacaaagcaacaagcaagattcatcaaatccttatcttctctctttcactcacaaccaattgctcatcccacctacttgttccccacaaaacactctctccctctttgttctttcatcttctctaagctctttctctgaacctacgcttctgctaagctattctaagagaagccagactagcaataaacccttcattttaagcattctgtttccttcttgagaaacctagatattttggtttcttgtatccggtgatgaagatacagtgtgatgtgtgtgagaaagctccggcgacggtgatttgttgcgccgacgaagctgctctctgtcctcaatgcgacatcgagattcacgccgctaacaaactcgctagcaagcaccaacgtcttcatcttaattccctctccaccaaattccctcgttgcgatatctgccaagagaaggcagctttcattttctgtgtagaggatagagctctgctttgcagggactgcgatgaatccatccacgtggctaattctcgatctgctaatcaccagaggttcttagccactgggatcaaagtagctctgacctcaactatatgtagtaaagaaattgagaagaatcaacctgagccttccaacaaccaacagaaggctaatcagattcctgctaaatccacaagccagcagcaacaacaaccttcttctgctactccacttccctgggctgttgacgatttctttcacttctctgatattgaatccaccgacaagaaaggacagcttgatcttggggcaggggagttggattggttttcagacatgggattcttcggtgatcagattaatgacaaggctcttcctgcagctgaagttcctgagctttctgtttcgcatttaggtcatgttcattcatacaaacctatgaagtcaaatgtttcacacaagaagccgaggtttgagaccagatatgatgatgatgatgaggaacacttcattgtccctgatcttggctaaaaagctatatgtaatctatgtgtagacattcttcaatgtaaaagaacaaacaagaaacctatctgcatgtgtggagttaatgtcatatacattttagttttgtcttaaaaaaaaaaaaaaaaaaaaaaaaagggcggccgc

SEQ ID NO: 205 - DNA, 1770 bp, Glycine max
ccacgcgtccgagataatcggaatttagtagttagttcggtttttagttacttaaccgcttaacgatataaataaataaataaaaagaagcgcgacgatgttagatcttaatctcaatgcggagtggaccgattcgtttagtaacggtgagtcgccgttaccgttagagaagtttccagacggtttgaggaaccaaatggccgagtcagggacttcgaattcctccgtggtgaatgcggacgggtccagtaacggcggcggcgacgaggactcggactccacacgagctgctgatgacgtgtacaccactttcaatttcgatatccttaaagtcgaaggcgcgaacggcttcgtaacgaaggagctctttccggtgatgagtgaaggagctaaaggacacgctacgtcgtcgttttcagggacgaatggtttcgtggatctctcgttcgatggcgatggagggaacactagtgagatgaagatgcttcagcctcagaatcagaatcagactcaaacgcgaactcagacacagcaaccagcgaaaaagagtaggagaggaccgaggtctcgaagctcgcaatacagaggggttactttttacagaaggacgggaagatgggaatcgcatatctgggattgcgggaaacaagtctatttgggtggatttgacacggctcatgctgctgccagagcctatgatcgagccgctattaagttcaggggagttgatgctgatatcaatttcaatctgagtgattatgaggatgaccttaaacagatgcagaatttgtccaaggaggaattcgtacatatactgcgtcgccaaagtactggtttctcaagaggaagctctaaataccgaggagtaacactccacaagtgtggccggtgggaagctcgaatgggacaatttcttggcaaaaagtatatatatcttggactattcgacagcgaagtagaagctgcaagggcttatgacaaggcagctatcaaatgcaacggaagggaagcagtgaccaactttgagccaagtacttatgaaggagagctgaaatctgcagccattaatgaaggaggcagtcagaatcttgatctcaatttgggcatagcaaccccaggacctcccaaagaaaattgggggcaacttcagttcccctccttcccttacaatacacatggtggaagaagttcaatgatggaaaccaatgttagttctggaattggtaatccatctttgaaaaggatggttgcaactgaagatcgtccttcattatggaatggcatgtctcctaatttctttcccaatggggaaagagcagagagaatcggcgttgatccttcaaacggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggatacatcatctttgaagcaaacaaaaaaaaaaaaaaag

SEQ ID NO: 206 - DNA, 3159 bp, Glycine max
cgtttcagcaaaacctctcttcttcttctgattgattccacctcgcgatttttcgattttcgtttgttttcttctttttcggtttctgatctgaactcgattcgattcgctattgccggaaaatgagtcctccggcaagtgtccggtgatgatcgctccctcgagaggttgttgaggttatcgttgttgttcttcgaagtcatggtttcgatctgaggtgctgtcagtgctcacagcgcgacgctgttgagttgaaatttcgctggttttgagttgctttgtgactaattttttttctcggcaaccaaacaggaggattcaaaatttgcactgattaattagtaaagttttggcgctctcgagttcgttttggtgaggattctgattaaggaaaattttcttttattcattcggaggagaagcgtctcaaactctctctctttctccctcgtagcatcatcatcatcaccataccttgttcagattctgctcactttcaccacaacggctttactatttaccgcgtttcgttttcgtgtcaccgcaaataatgaaaggaggtgttccctgtatccactcctcgtcagggaagatctgaagcagtgctagctgctcacgtcctgtaatggacgcatactcctccggcgaagaagtggttgttaagactagaaaaccatatacaatcactaagcaaagggaacgatggacagaggaggagcataataggtttctagaagctttgaaactacacgggcgagcatggcagcgcatagaagagcatataggaacaaagactgccgtgcaaataaggagtcatgcacagaagttctttacaaagctggagaaagaggcccttgtaaagggtgttccaattggacaggctcttgatatagacattccccctccacggcccaaaagaaagccaaacaatccttatcctcggaagaccaggattggtaccacatcattacatagtggagcaaaggatggaaaactcaatttagttgaatcttcacatgttaatcaagcactggacttgaaaaaagaaccacttccagagaaacatgatttagacgaagggctaacaactgtaaaagaaaataaggatgagaaccacgcaaaagtatttactcttctccaggaggtaccctgttcctctgtatcttcagcaaatgagagttcaataacaatgtctgtgccactgggaaatccatgtgccttcaaggagattacaccttccgtgaaagaggtaatagcacgagatgaaaaaactgaatcttttgtcactgttgaacctgaaaatgggaagttggagatcaatgatggaaaacagactaatggcactagtaaagactccaggttagaggattctgatgctttacatatgaaattggttcaaaatgagaaaccagatggtcttgattgtgaattaacaatagatgggatgcaaggcaatcagaattaccctaggcatgttactgtgcacgttgttgatgggaaccttggaacaaatactcaaaatccatcacaagatatgttgtttcgagattccatgtttcagccaataggaggggttaacgggcaacgaaatgtttttaccaatacagctccatcgaacacaagtgaaagtcaaaataacactgcacgatcttctgttcatcaatcatttcttccttatcctcccttcacacaacacaaccaagacgattaccaatcatttcttcacatgtcttcaacattttcaaatcttattgtctctaccttgatgcaaaacccagcagctcatgctgctgcaagtttcgctgctacattttggccgtatgcaaatccagaaacttcagcaaattctcctaggtgctcccaaggaggttttacaaatagacaaattggttcccctccaagcgttgcagctattgcagctgctactgtagcagctgcaactgcatggtgggcagctcatggattgcttcctttgtgtgctcctcttcatacttcttttgcctgtcctgcatcagtgactacagttccatcaatgaataccggtgaagcaccggctctgaaggcagagcaagaaaaaactactctacaaaatcctcctcttcaagatcagatgctggatccagaatactcggaagctcaacaagctcaacattcagcttcaaagtcaccagctgccattttatcagattctgagagtggagatgccaagttaaatacttcatcaaaggttactgatcatgagacgaacaaaacaatttctgagcaccttgattccaacaaaacaaagggaagaaaaccggttgaccgttcctcatgtggttccaacacggcctctagcagcgatgtggaaactgatgcactagagaagggtgagaaagggaaggaagagcctgaaatacctgatgctaaccaattagccattgagtttagtaatcgtcgtagaagcgttagcaaccttactgattcttggaaagaggtttctgaagaggggagactggcctttcaggctctgttctccagagaggtgttgcctcaaagcttttcacctcctcatgctttgaagaatacggatcatcaaatggacaacgccaatgataacaagcaaaacatagatgacaaagatgaagatcttgacggcagcaagaaatgcagttctaattatgaagcgatgcagaaaaacctgctatttgtagaaaataacgagggactgttaaccatagggcttggacaaggaaagcttaagactcatcgaacaggttttaaaccctacaaaagatgttccatggaggccaaggaaaatagggttggagcaagcagcaatcaaggtgaagagcaaggttgtaagagaatacgtttggaaggggagacttcgacttgaggttcgatatatgcagtaacataaaggcaacctttggtttttgcatatcatttctttatccctccaacggtgtacctatattgtatgtttatttctaattctgcagctcacgaaacttgtcgtgtagatgtgtgtaccgtattaaattactgtgtacgctcttttactatctttgtatgatgttaatgctgtttaaaactccgctaaatagacttagataagaaacattaagtattgtttgagccatgaacatcaagtaatttatgatccttcattcagcc

SEQ ID NO: 207 - DNA, 1716 bp, Glycine max
aaaaaaaatttgattattattattgattttatttaactgttgttgttgttgttggagggtgatcgtagtttatgagtgagtgaggttaatggaatgtgaagagtgacgggacggtgatgatagtattgttacgcgtgtatggaattcgatgccgcgattcccgtttctcgagagcacctccctcaagatgcaatgtggcaaattaacttgaggtcaagtgaaacaatggaatcagaaccttatcctgagcatccaggagaaccagattgttcatactacattaggactggcctttgtagatttggagcaacatgtcgatttaatcatcctcctaacaggaagctggctattgccgctgcaaggatgaaaggtgaattcccagaaaggataggacagccagaatgccagtactatttgaagacaggaacttgcaaatttggagccacatgcaggtttcatcatcctagagacaaggctgggattgctggaagagttgccttgaatattttaggctatcctctccgcccaaatgaaccagaatgtggttattatttaagaactggacaatgtaaatttgggaacacttgcaaatttcaccatcctcaaccaaacaatatggtgctttccatgcgaagttctcctgtttatcctactgtccattctccaactacaccaggtcaccagtcatatgcgacaggaattacaaattggtctagttcatcgtatattcctagcccacgttggcaaggcccttcaagttatgcacctttaattctacctcagggaatggtttcagtgtctgggtggagtgcatacagtggtcaaatgggatcagacagtccacagcaaacaatggcaaatggccaaagctatggaacttctcgacaaagtgaaccagcaaattcaggatcccagggggcatattctcaatttcgttctggctctgttcctgtagggttctatgcgttgcagagggagaacatatttcctgagagacctgatcagcctgaatgtcaattctacatgaagactggagattgcaagtttggtgcagtctgtcgtttccatcatccacatgaaaggatgattcctgctcctgactgtgttttgagtcctataggtcttcctttacgtcctggagagcccctgtgtgtgttctattcacgttatggcatatgcaaatttggtccaagttgcaagtttgatcacccaatgggagtcttcacctataacatgtctgcatcacctttagctgatgccccaggacggcgtatgttaggttcttcatcaggaacttctgcattaaatttatcatcagaaggacttgttgagtcaggctcagaaaatccaaggaggctttcattatcagaaactcgacagataccttctggtgatgataacattgatgaagagggataatgatgtctcttggaaatgggtcatttgcttgttacaaatttttttcaggggagaaaaagggtaatctgtaaattgattttcccattgctgaagatgtacagactacagagttcatgtcaagctgattctgtcaaacctgctatttaatgcagttgagagattcagttgttctgaatttcatgctgtcacattgtataaattttacaaatatttgtcacatttggtgaaaacccaatgtgaacatttcttcagtctatctatttaatgttttcctaatatgtaaaaagtgtttttctg

SEQ ID NO: 208 - DNA, 1909 bp, Glycine max
attcggctcgagctacactttcgagttcgaactaaagaaaaaacagtaaagaaagaagaagaaaaaaaaaagatggtttcgtcagtttcgtgggtgagaggcaagtgcgtcggtaagggcgcgtttggggttgtcaacgtggcggtttcgaaaagagataatcgcgttttcgcggtgaagtccgtggattgcggaagggggctttctggtcaggtggaggcgttggagaacgagattgggattctgaaacgagttacctcgccgcacgtggtggcttatatcggcgacgatgtcacgtgcgagggaacggcgtcgttcaggaaccttcatttggagtacatgccaggtggcaccgtcgctgatttggaccgcgctgacgtggacgagcggttagtgaggcgctacgcgtggtgcctcgcgaccgcgctgcgtgacgtccacgcgcaaggcttcgtccactgcgacgtgaaagggaggaacgtgcttctctccggcgacggcgaaatggcgaagctcgccgacttcggcgcggcggtggaaattgaatcctctccggcgatgttgctgttcccgcgggggagtccgatgtggatggcgcccgaggtggtgcgccgggagcggcaggggccggagtccgacgtgtggtcgctcggatgcacggtgatcgagattgccatcgggaaaccggcgtgggaggaccgcggcgtcgacacgctgagtcgaatcggttactcggacgagttgccggaatttccaatccagttgtcggagctagggaaggattttctcgagaagtgtcttagaagagaaccgagtgaacggtggagttgcgatcagttgcttcagcatccatatttgcttccctactacgcccttgttgaatcgtcgcctcggtgcgttctcgaccgggttgactcggagttgaattccgagtcagattataacgaccgtgatcatcaagaagaggtgttttcaatatttactaacatcgaagaaaattcagttattaaaaatagaataagtaaattagcgacagagtcgagggtaaattgggaaacacatggttgggtagtggtgagggaagttgagtccaacggagaaccaacgacaacgggaacagaggaagaaggagcgtgtacgtgtgagcgtgatggtgttggttccaacaaagaaggggtaaattgggaatttcacaatgtggcagagactggtatggtatattcggattctgtaggggcaaatcggagaataagaaagtttggtgggagtaacaccgctggagggggtgttggttgttgctgtcggtatgggtgtggatgggaaaagttgggtaggaatagaggaataatcagcatttacagcttgtattgtaaaaatttcatgtcgtataatttaatattcttaatgtatatcaatatattatgcttttcgattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccccccatttagggccttccccccccggaaattaatttgggcccggcccctggggggcacccattttttttttaaggagggccttaaaaaattgggggaaaaaagggaaaaaattttttcctggggaaaaattttttcggtaaaaaatccacaaaaaataaaaccccgaaaaataaaaggtaaaaacccggggggcctttaaggggggccccaccacaatttatggggtgggcccctctccccctttttaaaaggaaaaaattggtgccccctttttttaaaaataccaccccccccgggaaaggcttttttttatttggcccccggggttttttttttcacag

SEQ ID NO: 209 - DNA, 2016 bp, Glycine max
cctcaatttaattcccattccctctctcagaactcatcatcatggccgttgattctgaggtccctcgtgccgagaggagcgcaaaggctcttcagttcatcgaggaagttacaaaaaacactgactccgtccaggagagagtcctcaccgagattctcacccaaaacgccgagacggagtacctcaaacgcttcggcctcaacggcgccaccgaccgtgacactttcaagtccaaggttcccgtcgtgacctacgaggatctgcaacctgatattcagcgcattgcaaatggtgacagctctcccatcttgtgctctcacccaatctctgagtttctcaccagttctggaacatctgccggcgagagaaagttgatgccaaccattcatgaagaaatggaccgtcgtcagttactgtacagcctgctcatgcctgtgatgaaccaatacgtgtctgatttggacaaaggcaaggcgcttcacttcctgttcattaaggcagaggccaagacacccggcgggttagtggcgcgtccagtgctgacaagctactacaagagcgagcaattcaggaaaagaccattcgacccttacaacgtcctcactagccccaacgaagccatcctttgccccgattccttccagagcatgtacactcagatgctctgcggcctcatcatgcgccacgaggttctccgtgtcggagccgtcttcgcctccggccttctccgtgccataaggttccttcagctcaattgggaacaactttcccatgatatcctcaccggaaccctaaacccaaagatcactgaaccttccatcaaggaacgcatgtccaagatcttgaaacccgaccctcaactcgccgctttcattaaaaacgaatgctccgtggaaaactgggagcgtataattgtgaggatttggcctaacacaaaataccttgacgttatagtcactggagccatggctcagtatattcccacactcgattactacagtggtggcctacctaaaccctgtaccatgtacgcttcttctgagtgttttttcggcctcaacctcaaacccatgtccgaaccctctgacgtgtcttacaccattttacccaacatgggttacttcgagtttttaccccatgatgattcctctcctgttactctctccaaggactcaccgcctcgcttggtggaactcgctgacgtggaacttggtaaatactatgaactcattatcaccacctattcaggtctttgccgttacagggtcggtgacatactccaagtaactggtttccacaactccgaccctcaattccgtttcgtgaggcgaaagaacgttttgctgagcattgactcggacaaaaccgatgaagcggaactgcaaaaggccatcgagaatgcctcggagttgctgaaggagttcaataccagcgttgtggagtacacgagcttcgctgacacgaaatccattccggggcattacgtgatttactgggagctcatgatgaaggactcgtctcaccctccaacgaaccaagttctgaaccagtgctgcttggtgatggaagagtcgctgaactcggtttatagacaagggagagttgcggataactctattgggccgttggagatacgagtggtgaagaatggaacgtttgaggagttgatggactacgctatctcgcgtggtgcgtcgataaaccagtacaaagtgccaaggtgcgtgagcttcacgcccataatggagctacttgactctagggtggtttcttttcattttagcccagctgcaccgcactggaccccagaacgtcgtcgttgaaggaagctagggtaacgtacagcaataacatgcagtagtcatgcataagatctagtataataataaagagagaaaaaatgggtgacagaaaagggtagttgttcattgttgttgttatattatcactgccaaacccgaaagtgtctgtatttgttgatttgatatttccaatgagcttgtttttttcaaaaaa

SEQ ID NO: 210 - DNA, 1038 bp, Zea mays
cccacgcgtccggaagcagccaccactctctccactgtgactccgtgacctgcctgccctgctgcacaagcacagcacacacaccccgcacaccgcaccagctcagcgcagctcaccaagacaatcaatcatggctcacccgcgcagtgtcgctgccgctgcccccctcctcctgctgctcgccgccgccgccgccgccgcagcggggctcgtgtccgccgcgtcgccggcagccagcgacttcgtccgcaagtcgtgccgcacgacgcagtacccgtcggtgtgcgagcagagcctggcgtcgtacggcgggtcgccgccgccgcggagcccgcgggagctggcgcgcgccgcgctgtcggtgagcgcggaccgcgcgcgcgccgcgtcggcgtacgtgggccgcctgtgcggcgccagcaacggcaaaggcgcgaagaaggggtcgggatcggcgtcggcgtcggcgtcggcaggtcccgtgcgcgactgcctggacaatctggcggacagcgtgggccacctccgcgacgcggcgcaggagatgggcggcgccgggatgggccgcgcggggacgccggcgttcaggtggcacctcagcaacgtgcagacctggtgcagcgccgcgctcaccgacgaggacacctgcctcgacggcctctcgtcccgcgccgtcgacgccggcacgcgcgccgccatccggggcaaggtcgtcgaggtcgcgcaggtcaccagcaacgcgctcgcgctcgtcaataaggtcgggcctgggtactaacacggggaggggacccaagatccaggcccaggcccagcccagataccacacccgctactagtatagtactaggcgcctccacggcgttgggtgtttctcgtccgttaatagctcggtttgctttgcttgtgtttgtgtaagatatacattagttaagggcaataagcttgtactattatgagtggcggccgaggagtacagtacgttctcctctgtccgatcatgccatcattaacattaattaatgtgggaaaaaaaaa

SEQ ID NO: 211 - DNA, 1140 bp, Zea mays
gggaagaacaatcgagctactaataaggtcgtatacatatcttctatatactcctctgaaagttgtgaactccggtcgagcttaaaaacagcagcaatggcgaagctttggacattgctgctggctgcagtggtggtcctctcactcctagtgagccccattgcttgcacccgaaagctcaacaaacccaagccgaagccgggcagctacaggcggccggtcaagccgaagccaaaaccggtcacgggcagctacaagccggcgcctgtggccgccagaagaaaccacacagctacacccacgccatcgccgactgtctacggccccggtggctggctgtcaggcgccggcgccacgtactacggcgcgaccaacggcgacgggagcgacggcggcgcgtgcggctaccagacggccgtcggaaagaagccattcgactcgatgatcgccgccgggagcacgccactgtacaggggaggcgagggctgcggcgcctgctacgaggtgaaatgcacgaccaacgccgcgtgctccggccagcccgtgaccatcgtaatcaccgaccagtcccctggcgggctgttccccggcgaggtcgagcactttgacatgagcggcaccgccatgggcgccatggcccggcccggcatggccgacaagctccgcgctggcggcgtgctcaggatcctgtacaggagggtgccgtgcaagtacaccggcgtcaacatcgcgttcaaggtggatcagggcgcgaacccgtactacttcgacgtgctcatcgagttcgaggacgacgacggcgacctcagcgccgtggacctcatggaggccggcagcggcgtctggactcctatggcgcacaactggggcgccacgtggcgcctcaacaacggcaggaagctcaaagcgccgttcgggctccggctcacctccgactcccgcagggtgctcgtcgccaacaacgccatcccggccgcgtggaagcccggcaagacctaccgctccttggtcaactacccctgaaaagagaaataccgacaagtggatggcgtgtattgtgcgtccgggtgttgcgagtggcggcggtgtactactggtgtcggaaaacagaagagaatgaaagaggaggttgaagaagag

SEQ ID NO: 212 - DNA, 940 bp, Zea mays
ccctttcctcctcctcctcttcttcctcctcacctcacctcctatttagccgtccgaattgcttgtcagcatcttcccagcttcttcttcttcttccaaccgcgctacgctctcttgtccccggtgctcgcttggattcttctctcttcataggaaggaaggattggctaccgagatattcctactagtccagggctgtagtgcatcctgcgcgcttggtttattctgcagccagtaccagtaccagtaccccagctgagccggtgaggagaggagatagagagagcgagcgggagcgggagcgggagcgggagcagaggaggagggccatggaaggcgacagcttctccggcggcgccatggccaacggcggcggcggcggcggcggcggcagcgggcaggtggtggacgggaagctgatccacacgttccacaggagcttcgtgcaggtgcagagcctgctggaccagaaccggatgctcatcagcgagatcaaccagaaccacgagtcccgcgcgcccgacaacctcacccgcaacgtcggcctcatccgcgagctcaacaacaacatccgccgcgtcgtcggcctctacgccgacctctccgcctccttcgcgcgcaccatggaccacgcgtcctccgagggcgactcctccggcaccggcaataacggccgcgccggcgccggcgccggccacaagcgcgtccgccccgcctagagctagcttttagtttttttcttcttcttcttctgctgggtctagcttggcgtggcaatcctaggtgttgccattgccactaggaggcgtatttagtcttttctcttgcggttcttcttgttcgccttcttcctttgtgctcgctagctgcgacgaacgccggtgattagtgtatggtaatttagtgtcaaacagagagctgccatgtggatgttgctcct

SEQ ID NO: 213 - DNA, 1231 bp, Zea mays
caagagcaagagcaagagcaattactgcaaaaccctaaattagctacgtatagcttctcttctcacccatggccaagtcaagcagctacggccttgggcttgcttgcttcttcgccattgccgctgcggtcgccggcgggacgcagttcatggtcggcggcgccaatggctggagcgtgcccaccgccggcgccgagcccttcaacacttgggcggagaggacgaggtttcagatcggagactccctagtgttcgtgtaccccaaggaccaggactcggtgctgctggtggagccggcggactacaacgcctgcgacacgtcgtcgtacgtgaggaagttcgacgacggcgacaccgtggtcacgctcgaccgctccggcccgctcttcttcatcagcggcgtcgaggccaactgccgcgccaacgagaagctcatcgtcatggtcctcgccgcccgcagcaacggcaacggcaccggcggcggcgcgcgggctccgagcacggcgccgcagccggcgtcaccggcggcatcgccccctcccgccagctcgaccccgcccccgccgtcgtcgcccgctcccaagggcgcgtcgccgcccccggcctctgctcccacaacgtcaccgggtacgacgccgccccctgctccgagcgcgtcgtcgcctgctccggcggggagcgagacgcggacgaggagacgcggaaccagatgatgcagaacctattcggagaccagtcggaggacgaggacgatgcggacgacgacgacggccagcagcaacagctgcagtcacccccgcaccaccaccacgagatagaggacgacgccgatgaagacggcgacgacgcccgcagcgacgcgcctgcccgccacggcggataccactcggaagaagtggatggagaggcagagaatggaggagaaggtgaaggcgaaagtgaggggcaagttgaaatggaagaggaaagtgaaggcgaagctcatcgtgctgaccttgatcaaggagaaagtgatggggacaaagtccatagctccccagaaagagaactccatgaccagaggatggaatctgatgcaaaaggactggatagtgaagatgaaggctaccagcagaggacagtatctagcagaagaaggggagttgttgcctctgaatcagagggatctgaagataattactatgctgatggagctcaagaagatgaggaacctcgccaaacaaggaaacaa

SEQ ID NO: 214 - DNA, 818 bp, Zea mays
ggacggggcaccactgcctgtcgccctcaagaacccccaccatccccaccgccagcagatcgattcgcgaaagagacgaccgccgccgcatcggaccgtgcccgagccccccttctcctcgctgactcggctcccctcctccgccgtcgccggaggcgaagcaagtggggaccacagaagcattagctgggtgaacccactcaaagggggcagggaattgtgtgctagtttgaatggctgctacaaagcttcaggccctttggaaccacccggctggccccaaaaccattcatttctgggcgccaacattcaaatggggcatcagcattgccaacatagccgactttgctaaaccacctgaaaagatatcttaccctcagcaagttgctgttgcatgcactggactcatttggtcaaggtacagcttggttatcacaccgagaaactggaaccttttcagtgttaacgttgcaatggcgggtacaggcctgtatcagctttcacggaagatcaggcaagattacttatccgatgagaaagatgctgcttcacaactggaagcatagataatgacaacaggcaaagaataacggattggaaagcctgcatcctaggagtctactcttgattttttttttctgggcaagcaaagaataacggatgggtcatgtttgttttcctgttattctgaaatcgtgagcaggctaatgtgaaaatcttccgccaaaaaagaaaaccaatgaagtgatgttttgagcattttttttgtgggaacaagtcatgaaagtacatggtttatctgttaaaaaaaaaaaaaa

SEQ ID NO: 215 - DNA, 1904 bp, Zea mays
attcggctcgagagctacctctccgatccgaggcctgagcgagcgagctgaggactgcagcctatataatatctagactatagtacaccacaacgacgaggcacatatatatacacgcggcggcggccagatccatcttggtatacacgtaatatatatacacgcacgatgggcagcgccggcggcggtggcgagagcaagctggagagcccgctgctgggcgcgtcgtcgacgggccacggcgaggcggtgatcttctcgggccacctcggcacgctcgagctcgccgccgcctcgctcggcaacaccggcatccaggtcttcgcctacggcctcatgctgggcatggggagcgcggtggagacgctgtgcgggcaggcgtacggggcgcacaagtacgacatgctgggcatctacctgcagcgctccaccgtcctgctgatggccacgggtgtgccgctggcggcgctgtacgccttctcccgccccgtcctgctcctgctgggggagtcccccgagatcgcgtcggccgccgccgtcttcgtgtacggcctggtcccgcagatcttcgcctacgccgccaacttccccatccagaagttcatgcaggcgcagagcatcatggggcccagcgcctacatctccgccgccgcgctcgcagcccacctcgccctcagctacctcgtcgtctaccgcctcggcctcggcctcctcggcgcctcgctcacgctcagcgccagctggtgggccatcgtcgccgcccagttcgcatacatcgtcaccagcagccgctgccgcctcacctggaggggcttctcgtggcaggccttctccggcctgcccagcttcttcaggctctccctcgcatccgccgtcatgctctgcctcgagacctggtacttccagatcctcgtgctcatcgcaggcctcctcaaggaccccgagcttgccttggcctcactctctgtctgcatgacaatttcagggtgggtgttcatgatctccgttgggttcaatgcagcagccagcgtaagagtgagcaacgagctcggcgccggcaacccaagggcggcggcgttctccgtggtggtagtgacgctgctctccttcgtcctgtcggtcctcgtctccgccgtcatcctgctgtgccgggactacatcagctacatcttcaccgagggtgaggacgtgtcgcaggcggtctcccggctcaccccgctgctggcgttcacgctcatcctcaacggcatccagcccgtcctctctggggtcgctgtggggtgtggatggcaggcgttcgtcgcgtacgtcaacgtcggctgctactacatcgtcggcatcccgctcgggtgcctcctaggcttctactttgacctcggagcagcgggtatttggagcggtatgatcggcggcaccttgatgcagaccttgatcttgatatgggttacattcaggaccaactggaacaaggaggttgaagaagcacagaagaggataaacaaatgggacgacggcaaggctcctctgctgtcagcgcaagaatgaaacaactcgtctctctggtgcccaaccaaagaacaacgagacgtggatatatatgacctgtagggcttgtttggaagaaagagtattggagaggattgaaggggttataatctcttgctattcaaaattgaataacaagggattatagtccccacaatctccttcaatactcttgtttccaaacatacccgtagggaactagggatgcccctcggcaggctcagcggagacgtcgacggagtttgatgtcaagtagcaattaattccaccatgtcctcaaatggacagaaccagatgcctgaaatagacagaaccagatgcctgatgaaattctacgtactcaaaaaaaaaaaaaaagg

SEQ ID NO: 216 - DNA, 2245 bp, Glycine max
ctaaatctctcacatctcttatctttctctctctctcttataatacaagaccctagtcctctctcacgccccaaccaccgccatcaccaaaccttcctctctcgatttcccttcaattcccttctgggctttgcaattcggccaattgggtccccaaatctgcaaccttttcctctgtctaacgcgaaacggaagagaaacacccacatagagaaagagaaaaaaaaggagaggaagaaacaattttagggtgtggggttaaaacccggggttgaagcattgcagacatcacggctattcaaggagttcgccactctctttctcatgcccgttgtgtccgacgcaagggttgtgtgacggagagcaatccttcgccgcacggcgggcgtggcgctctgccttccgaaggtggcagcccctccgacctcctcttcctcgctggcggtggttcttcccattaacattctaaagtagtattagccattaacattacatcctacaccttcaaaagttctctctattagcggtttctggtttcttttgttcttcttctttggtagttgttaggtttggtgaggtctaagatgttgagcattaagagggttcccactgtggtttcaaattatcaaaaagaagagacaggggaggctgctgccggaggttgtggtcgtaactgcctcaaaagttgttgcattcaaggtgcgagactgcctttgtatgctttcaagaaggtggacaaggtttgtggaaatgaattgcctttgcttggatgcaaggagcagcaccctgtggcctttctggactcgcttgttcttggagagtgggaagatcgcatgcagagagggcttttccgctatgacgttacagcctgtgaaaccaaggtgattcctggggagtatggtttcattgctcagctgaatgagggtcgccacctcaagaagagaccaactgagtttcgtgttgataaggtcctccagccctttgatgaaaacaagtttaacttcactaaagttgggcaagaagaggtcctgtttcagcttgaggctagcaatgatggggaggctcaattctttccaaatgcacctattgatgttgagaattctcctagttttgttgccatcaatgtgagtcctattgaatatgggcatgtgctgctgattccacggatttttaagtgtttacctcaaaggattgaccatgcaagcttcttgcttgcacttcaaatggcagttgaagcaaggaatccatattttaggttgggttacaacagcttgggtgcatttgcaaccattaaccatctccactttcaggcatattacttggctcttccttttccaattgagaaggcccctactaagaaaattgccaagttaagcggtggtgtgataatatctaaactgttaaactatccagtcagaggccttgtctttgagggcggtcatacactagaggatttagcaaatgctgtttcagaagcctgcatctgccttcagcacaacaacataccttacaatgtacttatttcagattgtggaaggcaaatatttctcttaccacagtgctatgcagagaaacaagcccttggagaagtgagtcctgagcttctggagacccaagtgaatcctgctgtgtgggaaattagtgggcacatggtgctgaagaggaagaaggactatgaggaggcatctgaagccaatgcttggaggcttcttgctgaggtttccctctctgaagagaggcttctagaagtcactgctcttgtttttcaagccattacatcatcggttgagatgaatgtcaagcctcaacgtcttgaggaagttgatgccgttagcccaaacgcacagcatgccatggtggctggttcacatgaatgccttgttctccagtaacaaggctatgaacaaattcgtagtgattatgaactaaatattgcttgccatgttacgtttcagttctaataagtgtagtaccttatattatggtccagttactggagtctgaagtatttatgttttaaggacttgaataattgtggtttgtattttattatatggactcgctgtacggtgcttgattgtccttcgtggtctatgtaaaaatacaatgactgttcttctgagccttattcagtggttagtgtttctgtgtttgtggtttgattaatgtgacatactttcatatagtgaggcatgggaatgtgcaagtagcatttatataaatggtgcttgatctttttctattt

SEQ ID NO: 217 - DNA, 2724 bp, Zea mays
gtaaattcatccgtccatccaccgacccagagccctcgatcccctaaaaaaaacccagagccctccattccacagccatcctcccctctgcagtgcactgctgcttgaccaagcaacaacaagaagctaccagcgcgctacctgcagattgcagcacacgcaagtgagagggcaggcaactccccggacgcaaggagttagagggcaagcatggcttcccttggtgacataggcctcgccgcgggtctcaacgtattgaccgccgttgccttcttgctcgcatttgcattccttcggctgcagccaatcaacgacagggtctactttcctaaatggtacctcaggggaatgagagacaatccaatcgtatctggtgcagctgtgcaaaagtttgttaacttagacgccagatcctacttgaagtttttaaactggatgccagctgctctcaagatgccccaggatgagctcattaaccatgcaggccttgattctgtggtctacctacggatatacgtaacagggctcaagatatttgttccaattacagttctggcttttcttgtactggtcccagtcaattggaccaatgacaccctaggacgcatcaacgtagtctacagtcctattgacaaactttcgatatctaatgtacctaatgggtcgaagaggtttatagctcacttgggcatggcttatgccatcacattttggacctgttatgtactgttgaaggagtatgaaattatttctaacatgaggctgcgctttctagcttcagagaaacgccgaccagatcagttcactgtccttgtgcggaatataccaccagatcctgatgaatcaatcagtgagcttgtggaacatttcttccttgtcaatcatcctgatcattatctacaacaccaggtggtttacaacgcaaataaacttgctgatctggttgaaaagaagaagaagatgcgaaattggcttgactattacctactaaagtatgagcgaaattcatcattgaggcctaccacaaagactggctttcttggatgttttggttccaaggtggatgctattgactattacaaatcagagatcgagaaaatcgggaaacaggaagctgaagagcgtaagaatgtcatgaaggatccaaaatcagttgtgccggcagcctttgtctcatttcgctcccgatggggtgcagcagtctgtgctcagacccagcaaacaagcaatccaacactctggttgacagaatgggctccggaacctcgtgatgtttattggaataatctgtccatcccatttgtgtcccttacaattaggagattgatagttgctgtggcattcttcttccttaacttcttttacgtcatcccaataacattcgtacagtctcttgcaaaccttgaaggaatagagaaggcacttccatttctaaaacccttgattgacttgccattcattaaatcattcatccaagggtttcttcctggaattgctttgaagatcttccttatagtgcttccaactatactgatgtttatgtctaaatttgaaggactgatatcgcagtcatctctggagaggcgatctgcatctaagtattacatattcttgttcttcaatgtatttttggggagcgtaattgcaggatctgctctggagcagcttaaaacttatctccatacatcagcaaacgacataccaaggatcattggtgactccatcccaatgaaggcgacttttttcataacatatgtgatggttgatggttggactggaatagctggtgaaatattgagactgaagccgcttatattcttccatctgaagaactttttcttggtcaaaaccgaaaaggacagagaagaagctatggaccctggcagtatctgctttgactcaactgaacctagaatacagttgtacttcttgcttggccttgtttatgctgcagtgacgccgttcttgcttcctttcatattggtgttctttgggttcgcatatgttgtcttccgccaccagataataaatgtctataatcagcaatatgagagcgccgcacagttctggcctagcgttcatgggcgtataatcacagcgttgattgtatcgcaactgctgctcctgggactgatgagcacgaacgactttgagcagacgacacctgtgctccttgttcttcctgtgctgacctttgggttttacaagtactgcaagaaccgctttgagccggcattcgtgaggaacccgctgcaggaggcgatgaagaaggacaccctagaacgcgcccgggagcccaacttggatctgaaggcgtacctggccaactcgtacctgcacccggtgttcaagggggacgaaggcgacgacaggtactcggtgatggacgacgatgggtggatggaggaggaggtgatcgtgccgacgaagcggcattcgaggaggacgacgcccgcgcagagcaagcatgaagggtcggactcgctctctgtgctcgagagttctctacagcggtagtcacagtaggagcttagcctgtacagaatggatgaaaatgatcacggccctgctccattgcttttgctttggttgttggttgttcatgtcacaggggacacacacacacagatagaattcaagagagctgtggggaggactgaggggagagatagtttactgtagcttggacaaagaatctgaatacagcagttacattatctgatg

SEQ ID NO: 218 - DNA, 2138 bp, Oryza sativa
ggcacgagctcgtgccgaattcggcacgaggaaaaatatggggagtatttgtgcgtttttatttttgtttttgggtcgcactgttcgatcgtagcatccatgaccactgtggcatcgctgtctttgctgccgcacttgctcatcaagccttccttcaggtgttgctccagaaagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtggtagaggttcttaatcctttagcaagggagttcaagtcaattggaaccttgaggaaagagcttgcagaattacaggaagaattggcaaaagctcacaatcaggttcatctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtccagtgcagccatacaatcccagtctgaagaacttctggtacccagttgctttctccagtgacctaaaagacgatacaatggtgccaatagattgttttgaggagcagtgggtaattttccgaggaaaggatgggagacctggatgtgttatgaacacatgtgctcacagagcttgccctcttcatcttggctcagttaatgagggcagaatccaatgcccttaccatggttgggagtattcaactgatggaaaatgtgagaaaatgccatccacaaagatgctcaacgtgcgcatccggtcattaccatgctttgagcaagaaggaatggtttggatatggcctggcaatgacccaccgaagtcgactatcccttctctgctgcctccttcaggatttacaattcacgcagagatagtgatggagctaccagtggagcatggacttcttctggacaatctattagatcttgctcatgctccttttactcatacatccacctttgccaagggttggagtgttccaagcttggtgaagttcttgacaccttcatctgggcttcaaggatactgggatccatacccgatcgacatggaatttcgaccaccatgcatggtgttgtcaaccattggcatctcaaagcctggaaaactagaggggaagagcaccaagcaatgttcgacgcatctccaccagctccatatctgtttgccctcctctaggaataaaaccaggctgctctaccggatgtctctcgacttcgctccatggatcaagcatgtccctttcatgcatatactatggtcacattttgctgagaaggtcttgaatgaggatcttcgagtcgtgctcgggcagcaagacggatgtcaatggcgcaaatgtctggaactggccagtatcatatgcaagcttggtatccggtatcggttgtggagagacgccattgagaggggagtagacaggttgccattcagtaaccaaagtgagagtggatcatagtagctgcattgccaatagcctcttttcaattcttgtcgtatttcttggcgagatgaagatgaagatgaagatgatgatggccagaactagtcagtggatgtatatgcacagtttgtttaggcgtgcgtccctgcatggttggttcaccatctccctgagcttcgttgcagattgaattgggttctggagaggaaaggctaatggaaggagagaatgataggcgacgtcattctgtgtaattttaagtgtacactagcgacagcatcacgggatgcaattgtaatctgaggttgatttgtttttcttcttttttttttcctccccttttacccatgtaaaagtcgatcgcatgtcacgctatgatgcatatatatgatcatactattgattattgagccaaaaaaaaaaaaaaaaaa

SEQ ID NO: 219 - DNA, 1276 bp, Arabidopsis thaliana
taatccgattcgtcttcatctgattccctcccttccgagaataataatgtacccgccacctccctcaagcatctacgctcctccgatgctggtgaattgctccggttgccggacgcctctccagctcccatccggcgcccgatctattcgctgcgctctctgccaggctgttactcatatcgccgaccctcgcaccgcccctcctccgcaaccttcctccgccccttctccgcctccccaaatccacgcgcctcccggtcagctgcctcacccccatggcaggaagagggccgtgatctgtggcatctcgtatcgtttctctcgccacgagctcaaaggctgcatcaacgacgccaagtgcatgcgtcaccttctcatcaacaaattcaaattctccccagattcaattctcatgcttaccgaggaagaaactgatccatatcgtatcccgaccaagcaaaacatgaggatggcattgtattggctcgtacagggatgcacagcaggcgactcacttgtcttccactactctggtcatggttcgcgtcaaagaaactacaacggtgatgaagttgatggctatgatgaaacactctgtcctctggattttgaaactcaggggatgattgtagacgatgagatcaacgcaaccattgtacgccctcttccacatggtgtcaagctccattcaattatcgatgcttgccatagtggtaccgttctggatttacccttcctatgcagaatgaacagagctgggcagtatgtgtgggaggatcatcggcctaggtcaggtttgtggaaaggaactgctggtggagaagccatttcaattagtggatgtgatgatgatcagacttcggccgacacatcagcgctgtcgaagatcacgtctacgggtgctatgactttctgttttattcaagcaattgaacgcagcgcacaaggcacaacctatggaagccttctgaattctatgcgcaccacaataaggaatacagggaatgatggtggtggtagtggtggagttgtgacgactgtgctgagcatgcttctgacagggggaagtgcgattgggggattaagacaggagcctcaactgactgcttgccaaacattcgatgtctatgcaaagcctttcactctctagtaaaggacaagtcactttttatgtatagcgagtgtgatttgagaatccgtccatataaccaccttttgtttcttatttttatttttctttcaaaagaataaaggaaaacattgatttggtgattcg

SEQ ID NO: 220 - DNA, 1281 bp, Arabidopsis thaliana
gtgaaacatggggaaggaagttatggtgagcgattacggtgacgacgacggagaagacgccggcggcggcgatgaatataggattccggaatgggaaattggtttacccaacggagatgatttgactccgttatctcaatatctagtcccgtcgattctcgcgttagctttcagcatgatcccagaacgaagccgtacaattcacgacgtcaatcgcgcgtcgcaaatcacgctctcttcgttgagaagcagtaccaatgcttcgtctgtgatggaggaggtcgtggatcgagttgaatcgagtgttccaggatcagatccgaagaaacagaagaaatcggatggtggtgaagcagcggcggtggaggattccacggcggaggaaggagactccgggcctgaagacgcgtctgggaagacatcgaaacgaccgcgtttagtgtggacaccgcagctacacaagagatttgtggacgttgtggctcatctagggattaaaaacgcagtgccgaagacgattatgcagctgatgaacgtggaaggacttactcgtgagaacgttgcgtctcatttgcagaaatataggctttaccttaaacggattcaaggattgacgacggaagaagatccttattcgtcgtcggatcagctcttctcttcaacgccggttcctccacagagctttcaagacggcggaggaagtaacggaaagttgggggttccggttccggttccgtcgatggtgcctattccaggctatgggaatcaaatgggtatgcaaggatattatcaacagtatagtaaccatggcaatgaatcaaaccaatatatgatgcagcagaataagtttggaacaatggtgacatatccttctgttggtggtggtgacgtgaatgacaagtaaatggatcttaaaggtctataatttgctctacagagagatactggttcttggcttatggtttattttcccacttcatgaggttgttgtgacttttaattctccatgttttccacacaagtctttattgcctttgtatagaaaatgatttcgagaaaatcactgggaagcttggtattgttggaggatgaagccttctatgaatgatttagtttcctactgtctccattctttatgaggtaataaagccttcttttgctcatcgcttgtagtcttcttaaattcaagacagcgtcacatgtttgttcggttatgttaattgtttctttctttggataatgaagatagcatcaggtctcatgtctcctcactttgataaa

SEQ ID NO: 221 - DNA, 1002 bp, Zea mays
tctccgacccgatccgacccgacacacaaatatctccacccctgttccggcgacgactacgatttgggaggaaggtaagcgaatgggtgaggaggcggtcgacgactacgagctccacatggtgtgctacggcggcggcggcggcggcagcgaggacgagcgcgtgatggagtgggagtcaggtctcccgggcgcggacgagctgaccccgctgtcgcagccgctggtgccggcgggtctggcagcggcgttccgcatcccgccggaggccgggcggacgctgctggacgtgcaccgcgcgtcggctgccacggtgtcccggctgcgtcgcgcgccgccgccgtcgtcgtcgggcagcggagggagctcctccttcgcgcccttccatccggcggcgaggggggacgaaggggcggactcgtcggcggcgggcggcggggcggcggcgacgacgaacggcaacaataacatgagcagcagcagcaagcggccccggctggtgtggacgccgcagctgcacaagcggttcgtggacgtggtggcgcacctggggatgaagaacgcggtgcccaagaccatcatgcagctgatgaacgtggaagggctgacgcgggagaacgtggccagccacctgcagaagtaccgcctctacgtcaagcggatgcagggcctctccgacgagggcccgtcgccgtccgaccacatcttcgcatccacgccggtgccgcaaagcctggtgcatgaggtgcccatgtacggcaccatggccagcggcggacaggcgtaccacaaccacaacggaatgggaggaggagggtaccagtaccagtaccatcactaccaccacgcccacaaatgactcttctgttggattggatccctcaataatcccatcgatccttttggttttggatctcttgctaattcagttcttcgtgtgagcggtaaatggatctcttttaagaaataaagaaagaaagataagtttcttttcccaaaaaa

SEQ ID NO: 222 - DNA, 1306 bp, Arabidopsis thaliana
aaacccaccaaataactcagagcttttttgcattttttcccattctctattttgttttgtacttttggtctcactttaaaagatcataagttgaaagatttctgcagagaacaatatgttggaaggtcttgtctctcaagaaagcttgtccttaaactctatggacatgtctgtacttgaaaggcttaaatgggtacaacagcaacaacagcaactgcaacaagttgtgtcccatagcagtaataattcacctgaacttcttcagatacttcagttccatggaagcaacaatgatgagttgttggagagtagtttcagccaatttcaaatgcttggatctggttttggaccaaactataacatgggttttggtcctccacatgaatccatttcaagaacaagtagctgccatatggaacctgtggatacaatggaggttttgttgaagaccggtgaagaaaccagagccgttgccttgaagaacaagagaaaaccagaggttaagacaagggaagagcaaaagacagagaagaagatcaaagtagaggctgagacagagtcaagcatgaaaggaaaatcaaacatgggaaacactgaagcatcttcagacacttcaaaggagacatcgaaaggagcttcagagaatcagaaattagattatatccacgtgagagctcgtcgaggccaagccactgacagacacagcttagcagaaagggcgagaagagaaaagatcagcaagaaaatgaaatatctgcaagatattgtgcctggatgcaataaggtcacaggaaaagctggtatgcttgatgagatcatcaattatgttcaatgtctccaaagacaagtcgagttcctgtcgatgaaacttgctgtcttgaacccggaactagagcttgccgtggaagatgtatccgtaaaacaggcttactttacaaatgtagttgcttcaaagcaatcaataatggttgatgtgccattgtttccgttagaccagcaaggatctctagatttgtctgcgataaacccgaaccaaacgacatctatcgaagctccatctggaagctgggaaactcaatcacagagtctctacaacacatctagcctcggttttcattactaagcaagattcattgaaacaacatggttgacatcaatcaatcatcaaaatcagaagcaaattctattacatttgctcatcaaagtagtaatttcgaaatttggttaatgcattatcctttgatccttgttttctgatatttaaaccagaagaactggagatagcaatccaatgatcttgtcacca

SEQ ID NO: 223 - DNA, 3608 bp, Zea mays
ccttccagaaacctccaggatccgactccaatcgaatcgccaaagcagacaggggcgctcgcgggggcgccgagctcgacggggcgagatggccgggaacgactggatcaacagctacctggaggctattctggacgctggcggggccgcgggagatctctcggcagccgcaggcagcggggacggccgcgacgggacggccgtggagaagcgggataagtcgtcgctgatgctccgagagcgcggccggttcagccccgcgcgatacttcgtcgaggaggtcatctccggcttcgacgagaccgacctctacaagacctgggtccgcacctcggctatgaggagtccccaggagcggaacacgcggctggagaacatgtcgtggaggatctggaacctcgccaggaagaagaagcagatagaaggagaggaagcctcacgattgtctaaacaacgcatggaatttgagaaagctcgtcaatatgctgctgatttgtctgaagacctatctgaaggagaaaagggagaaacaaataatgaaccatctattcatgatgagagcatgaggacgcggatgccaaggattggttcaactgatgctattgatacatgggcaaaccagcacaaagataaaaagttgtacatagtattgataagcattcatggtcttatacgcggggagaatatggagctgggacgtgattcagatacaggtggtcaggtgaaatatgttgtagaacttgctagggctttaggttcaacaccaggagtatacagagtggatctactaacaaggcagatttctgcacctgatgttgattggagttatggggaacctactgagatgctcagtccaataagttcagaaaactttgggcttgagctgggcgaaagcagtggtgcctatattgtccggataccattcggaccaagagacaaatatatccctaaagagcatctatggcctcacatccaggaatttgttgatggcgcacttgtccatatcatgcagatgtccaaggtccttggagaacaaattggtagtgggcaaccagtatggcctgttgttatacatggacactatgctgatgctggtgattctgctgctttactgtctggggcactcaatgtacccatggtattcactggtcattctcttggcagagataagttggaccagattttgaagcaagggcgtcaaaccagggatgaaataaatgcaacctataagataatgcgtcgaattgaggccgaggaactttgccttgatacatctgaaatcataattacaagtaccaggcaagaaatagaacagcaatggggattatatgatggttttgatctaactatggcccggaaactcagagcaagaataaggcgtggtgtgagctgctttggtcgttacatgccccgtatgattgcaatccctcctggcatggagtttagtcatatagcaccacatgatgttgacctcgacagtgaggaaggaaatggagatggctcaggttcaccagatccacctatttgggctgatataatgcgcttcttctcaaacccccggaagccaatgattcttgctcttgctcgtccggatccgaagaagaatatcactactctagtcaaagcatttggtgaacatcgtgaactgagaaatttagcaaatcttacactgatcatggggaatcgtgatgtcattgatgaaatgtcaagcacaaatgcagctgttttgacttcagcactcaagttaattgataaatatgatctatatggacaagtggcataccccaagcaccataagcaatctgaagttcctgatatttatcgtttagctgcgagaacaaaaggagtttttatcaattgtgcattggttgaaccatttggactcaccttgattgaggctgctgcatatggtctacccatggttgccacccgaaatggtgggcctgtggacatacatcgggttcttgataatggaattcttgttgacccccacaatcaaaatgaaatagctgaggcactttataagcttgtgtcagataagcacttgtggtcacaatgtcgccagaatggtctgaaaaacatccataaattttcatggcctgaacattgccagaactatttggcacgtgtagtcactctcaagcctagacatccccgctggcaaaagaatgatgttgcagctgaaatatctgaagcagattcacccgaggactctctgagggatattcatgacatatcacttaacttaaagctttccttggacagtgaaaaatcaggcagcaaagaagggaattcaaatgctttgagaaggcattttgaggatgcagcgcaaaagttgtcaggtgttaatgacatcaaaaaggatgtgccaggtgagaatggtaagtggtcgtcattgcgtaggaggaagcacatcattgtaattgctgtagactctgtgcaagatgcagactttgttcaggttattaaaaatatttttgaagcttcaagaaatgagagatcaagtggtgctgttggttttgtgttgtcaacggctagagcaatatcagagttacatactttgcttatatctggagggatagaagctagtgactttgatgccttcatatgcaacagtggcagtgatctttgttatccatcttcaagctctgaggacatgcttaaccctgctgagctcccattcatgattgatcttgattatcactcccaaattgaatatcgctggggaggagaaggtttaaggaagacattaattcgttgggcagctgagaaaaacaaagaaagtggacaaaaaatatttattgaggatgaagaatgctcatccacctactgcatttcatttaaagtgtccaatactgcagctgcacctcctgtgaaggagattaggaggacaatgagaatacaagcactgcgttgccatgttttgtacagccatgatggtagcaagttgaatgtaattcctgttttggcttctcgctcacaggctttaaggtatttgtatatccgatggggggtagagctgtcaaacatcaccgtgattgtcggtgagtgtggtgacacagattatgaaggactacttggaggcgtgcacaaaactatcatactcaaaggctcgttcaatactgctccaaaccaagttcatgctaacagaagctattcatcccaagatgttgtatcctttgacaaacaaggaattgcttcaattgagggatatggtccagacaatctaaagtcagctctacggcaatttggtatattgaaagactaaatctttgatctttgctggtcagcagaggaatcaaagcaggaatgtaggatcgaggagagtgacaggacttcccctctgtgcacttcgccgaaaagtaataatgggattgctatgcatggcccttgttgtacactagaaaattgggcacgcaaacttgtgtcagtttttccgctgttgcgaaattcagtgatggtgtttttgtaactataccaacctgtgtcagttttgccgttgttgcaaaactcagtgatggtgttttttgtaattattatacatccgaataataagactggtgtttccagacagactatgcaagctaaggggaaatcacgattttcct

SEQ ID NO: 224 - DNA, 3328 bp, Zea mays
gcccggcctccccccaccccacccgcacccgcccgcgcgcccctcattcattcgcctcgatctcgccggcgatgtacggcaacgacaactggatcaacagctacctcgacgccatcctcgatgccggcaagggcgccggccccgccaggggccggggaggcggcggcggggaccggccctcgctgctcctgcgcgagcgcggccacttctccccggcgcgctacttcgtcgaggaggtcatcaccggctacgacgagaccgacctctacaagacctggctccgggcgaacgcgatgcggagcccgcaggagaagaacacgcgcctggagaacatgacctggaggatctggaacctcgccaggaagaagaaggagtttgagaaagaggaagccaatcgcttgtccaaacgccgtctagaggctgagaagccacaaaatgatgctactgcagacatgtctgaagatctttttgaaggtgtgaagggagaagacgttggtgatccatctgttgcctacggtgacagcacagctgggaacacacctaggatcagttcatttgacaagctatacatagtgttaatcagtcttcatggcctgatacgtggagagaatatggagcttggccgtgattcagatactggtggccaggtcaaatatgtcgtggaacttgctaaagcattaagttcatgtcctggagtttaccgggttgatctattgacaagacaaatcatagccccaaattttgatcgtggctatggtgaaccagacgagatgctggctttgacaagtttcaagaactttaaatgcgaacgaggagagaacagtggtgcacatatcatcagaataccatttggccccaaagaaaagcatctagctaaagaaaatatctggcctttcattcaagaatttgttgatggtgcactaggtcatattgtgcggatgtcaaaaactttaggcgaagaaactggcagtgtgtgtccagtgtggcctgctgtgattcatggtcattatgccagtgcaggagttgctgctgctctactatctggagcacttaatgtcccgatggtgtttaccgggcattttcttgggaaagataagcttgaagggcttctcaagcaagggagacagacaagagaacaaataaacgtgacatacaaaataatgcgccgaattgaggcagaggagttgtctcttgatgcgtctgaaatagttatcgctagcacaaggcaagaaatagaagaacaatggaacttgtatgatggttttgaagtcatgcttgcgaggaagctccgtgcgttagtcaagcgtggtgctaactgttatggtcgttatatgcctcgtatggttataattcctccaggagttgaattcggccaattgattcatgattttgatatctatggagatgaagataacccatctccagcctctgaggatccatctatttggtttgagataatgcggttcttcacaaatcctaggaaacctatgattctggctattgcccgtccatatgctgagaagaatatcgcaacgcttgtgaaggcatttggtgaatgccatccgttgagggaacttgctaaccttacattgataatgggtaaccgtgaggctatttccaagatgaacaaaatcagtgcagctgttttgacatcagtgcttacattgattgatgaatacgatttatatggtcaagtggcatacccaaagcatcacaagcactctgaagttcctgatatttatcgtttagcagcaagaacaaagggcgcttttataaatgttgcttactttgaacaatttggtgttaccttgatagaggctgccatgcacgggctgcctgttattgcaacaaaaaatggggctcctgttgaaattcatcaggttctggaaaatggtctccttgttgatccccatgatcagcatgcaatcgcagatgccctctataagatgctgtctgaaaagcaattttggtcaagatgtcgagagaatggattgaaaaatatacaccagttttcttggcctgaacattgcaagaattacttgtcaaggatattaactctaggtccaagacatcctgctttcgcatgcaaagaagaccataaagtgcctgtgaagtgcaggaagcatatattcgttattgctgtagactccgttaacaaggaagatttaattcagattatcagaaattctgttgaggctacacgctctggaactatgtcagatttgacaggttttgtgctgtcgacttcactgacaatagcagagttacagtctgtaatagtacgcacaggcatgctccctactgactttgatgcctttatatgcaatagtgggagtgacatatattatccatcacagtctagtgatgtgccaagcaattcccgtgttacatttgcatcggaccataactaccgatcacatattgagtatcgttggggtggagaaggtttaaggaagtacttagttaagtgggtctcttcagtagtagaaagaagggggagaaccgaaaagcaagtcatctttgaagattcggaacactcttcaacatattgtcttgcatttaaagtgattaatccaagtcatttgcctcctttgaaggagctgcaaaaattgatgagaatccagtcactgcgttgtcatgcactgtataaccatggcgccaccaggttatctgtaattccaattcatgcatcgcgatctcaggctctaaggtatttgtctatttgctggggcatagagttgccagatgctgtggtcattgttggtgaaactggtgattctgattacgaggaactgtttggaggtcttcacaagacagtcatccttaagggtggattcaacactcctgccaataggatccatacggttagaaggtaccctttacaggatgttgttgctcttgatagctcaaatatcattgcaattgagggatttagcactggtgacatcaggtctgctatgcaacaacagcttggtatacccacacgatgacaccaagtgcgatctattttgttattaatagaaagaaacaaagaaaaaaaaatggccaatacaaatatacgatacaaacacttcgtttccattctattggaaatgcccgattttgcctgccagtcgtttaatgtatgtgtgccagtgtgtggtctctgcatgggttatgaatgacattcccttggatccatgcactggaaatttttggagcgaagagcatgtcaatggatacatccagctgtacagaagaaacaaatttgttcaaatgttgatagtgaaaacattttatggaagcattttcagcaacaaagcttccaatatacaaagctcacactttc

SEQ ID NO: 225 - DNA, 1569 bp, Zea mays
gtttcgatggcgctgctagtgcggagggcacggagggcggcgaccaaggccgcggtgtccctcgccggcagaaccggcagcgtggagcttgccatcccggcgcacttccggtgcccgatctcgctggacctcatgcgggaccccgtcacggcgccggcgggaatcacgtacgaccgcgagagcatcgaggcgtggctggacacgggccgcgccacctgccccgtcacccacgcgccgctccgccacgaggacctcgtccccaaccacgccatccgtcgcgtcatccaggactggtgcgtcgccaaccgctcccgcggcgtcgagcgcatccccacgcccaagatccccgtcacgcccgtccaggcctccgagctcctcttcgacctcgccgggtccgcgcgccgccgcgatgccgctgcgcggtgcgccgaggtggtcaccaagataaaggtcctcgccagggacagcgagcgaaacaggcgctgcttcgcgtccatcggcacgggccgcgtgctcgccgccgcgttcgagtcgctcgctgctgctgctgctgctgacgccgccgcaccggcggggcgcgtccttgaggacatcctggcggcattggtctgcatgatgccgttggacgaggaggccgccaggacgttggccttgccgacctcgctggggtctctggtcgccattgctgagaacggcagcttggcaggaaggctgaacgccgtgctggcaatcaaggaggtcgtctcatgcgacggggcggtcactgatctgagcgggaaggccgacgagatcgtagacgcgctggcaaagatcatcaagtctccaatctgtcctcaggcaaccaaggccggcatggtcgccacctatcacctggcgctatacgacgagcgtgtcgcggcgcgccttgccgctgccgggctcgtccccgtgctcgttgaggtccttgtagacgccgacaagagcatgtccgagaaggcactggccgtgctcgacgcggtgctcgcctcggaggaaggccgcgcgagcgcgcgggcgcacgcgctcgccgtgcccatgctcatcaagaagatgttccgcgtgtccgacctggctacccagcttgccgtgtcggcgatgtggcggctcggaaaggcgcacagcgacggcgaggatgacggtgcggtgacgcggtgtcttgtcgaggcgctgggggttggggcgttccagaagcttctcctgctcttgcaggtcggctgcagggacgcaaccaaggagaaggccaccgagctgctcaagttgctcaacaagtacaagagcgtaggcgaatgcgtcgacgctgtggatttcagagggctgaataagctgtcatcttaaatcaatgggggctgcgatgtaaaaaatgtgtattttgtaaaacagagagacgatttaacttgtaagtagatgcagataggctagttgcaattttgttgggcgtgcttgcatgctatttcagcagcttagtttcaaacggaaacttagatccgaattccgttttatgaagaacttcagtgtaaatttcttgttttaaaagatgtttttttttctttt

SEQ ID NO: 226 - DNA, 1539 bp, Glycine max
gcaaaaagaaagaaagaaacaaagatcgttcattgctttgtagtaagatcagatcatcaaaaatggttttgtcttggtcaagaaggaacgttttccgccgtgccaagaaggagaagtcacaaactcaattggaagtggaggttgtgattcccaaccactttcactgcccggtgagtctggagctgatgacagacccagtgactttatcaaccggcatcacctacgaccgtgtgagcattgagaagtggatcgagggagggaacagaacctgccccgtcaccaaccaggtgctgacaaccttcgacatcatccccaaccacgccattcgcaggatgattcaggattggtgtgtcgaaaatagttcttatgggattgatagaatccccacacctcgtattcctatctcggcatacgaggtttccgacacgtgtaccaggatcttgtcggcttgccagcgtggagatgacaagaggtgtcaggagttggtcgggaagattaaggtttggagtagagagagtgagaggaacaagaggtgcatagttggtgctggtgctggtgctgttcttgcatatgcctttgattgtttctcaagtaactctattgaaaaacatgtggtgcttttggaggaggttttggaggtgatgacatggatggtcccacttggggaagagggtgtttctaaattgagttcaggagcttctttgaattcgttggtatggtttctagaggggaaagaccttgcatcaaggcaaagtgctgctttgttgcttaaagaagtgtgtgttcaagaattggccaaggttggagaagttgttgaagctttggttaagatggttagggagcctattgggagcacttccaccaaggcttgtttggcaacaatttttaacttggtgtcgttggctgcgaatagagagggaattgctcaaagatttgtggagttgggtttggtttcacttttgctagaggctattgttgatggagagaaaggggtgtgtgagaaggcacttggggtgttggattgcatttgtgattgcgagaaggggaaggaggttgtgaagagcaatgctctagccttgcctcttgttgttaggaagcttttgagggtgtcaccattggcttcaggttttgctgtgtctattcttaggaagatttgtgacaagagggaggaagggattctgattgaggcacttcaagttgggctttttcagaagctcttggttctgctgcaggttgggtgtgatgagagccccaaggagaatgctaccgggttgttgaaactgttgaatggttacaggaacaaagcggagtgcactgactcatcattgaatttcgagcatcttaagaagccattttaattagtgatgaatggcaactagattcatttattctttttttttttttgtgtaggtcaatttattgatacagaattctttgctgtaaaaagatacacacatcaattgattctttgaattcattctttggaaaattgattcgaagtaattagttagatataataatcatggttgtggcaaatac

SEQ ID NO: 227 - DNA, 2054 bp, Escherichia coli
ggcctttataggcggtcctgttggacaacggcgaacagtataaccgaatcattgtgcgataacaggtcttgacaaaggaatttacgcaaacgattaccttcaggctacgcaaggctttggagaataaagagcttgcaaccggaaacggatttcttttcaggtttgtgatgcaaatttttcacttcatcacattctttctgaaaaacaccaaagaaccatttacattgcagggctattttttataagatgcatttgagatacatcaattaagatgcaaaaaaaggaagaccatatgcttgacgctcaaaccatcgctacagtaaaagccaccatccctttactggtggaaacggggccaaagttaaccgcccatttctacgaccgtatgtttactcataacccagaactcaaagaaatttttaacatgagtaaccagcgtaatggcgatcaacgtgaagccctgtttaacgctattgccgcctacgccagtaatattgaaaacctgcctgcgctgctgccagcggtagaaaaaatcgcgcagaagcacaccagcttccagatcaaaccggaacagtacaacatcgtcggtgaacacctgttggcaacgctggacgaaatgttcagcccggggcaggaagtgctggacgcgtggggtaaagcctatggtgtactggctaatgtatttatcaatcgcgaggcggaaatctataacgaaaacgccagcaaagccggtggttgggaaggtactcgcgatttccgcattgtggctaaaacaccgcgcagcgcgcttatcaccagcttcgaactggagccggtcgacggtggcgcagtggcagaataccgtccggggcaatatctcggcgtctggctgaagccggaaggtttcccacatcaggaaattcgtcagtactctttgactcgcaaaccggatggcaaaggctatcgtattgcggtgaaacgcgaagagggtgggcaggtatccaactggttgcacaatcacgccaatgttggcgatgtcgtgaaactggtcgctccggcaggtgatttctttatggctgtcgcagatgacacaccagtgacgttaatctctgccggtgttggtcaaacgccaatgctggcaatgctcgacacgctggcaaaagcaggccacacagcacaagtgaactggttccatgcggcagaaaatggcgatgttcacgcctttgccgatgaagttaaggaactggggcagtcactgccgcgctttaccgcgcacacctggtatcgtcagccgagcgaagccgatcgcgctaaaggtcagtttgatagcgaaggtctgatggatttgagcaaactggaaggtgcgttcagcgatccgacaatgcagttctatctctgcggcccggttggcttcatgcagtttaccgcgaaacagttagtggatctgggcgtgaagcaggaaaacattcattacgaatgctttggcccgcataaggtgctgtaatttgatgttgccggatggaaacatccggcaacccttgacgcggtttaaattgccgcgtcgtcctcttcaccggtacggatgcgaatgacccgtgccacgtcaaagacgaagattttaccgtcaccgattttgccggtttgcgccgtgcgaataatggtatcgacacaggtatcgacaatgtcgtccggtacgacaatctcaattttcactttcggcagaaaatccaccatatactccgcgccgcggtacagctcggtatggcctttctggcgaccaaagcctttcacttcggtcaccgtcatgccggtaataccgacttcggccagtgcttcgcggacatcgtccagcttgaagggttttataatcgcatcaatctttttcatgctattccttgaaaaggtcgcctgtcttttgatctgctaaacgtaacacataacgccaattcattccttgaaatcgtttgcatccagctcgtgtcgggaaagcagtttataaaattctgtccggttgcgccccgccattctcgccgcgtgggtgacgttgcctttggtgatttgcagcagcttacgca

SEQ ID NO: 228 - DNA, 2493 bp, Nostoc PCC7120
tccattaccacaaagcacgaattggttcttttgcttggttggtgtcactagatacggtgtctcttgattgaacttctgtagtactagtatctgatgtattgtcagaagatgatgaatcagtggaattgttattttgagccacactagtctgttaccagtggatctgcgctcttcctgattgctgttgcctctttcttcagtattagtgttgaaattatcttgcgctacaccacttctgttttcattggtagtagcattggtgcgattgcgattggcagaggagctattaacattaatgttagctgggagtactttcgatgctttgcctcctggagcattattactagttgaagtattgttactagctgtttgttgctggccgcccattgggaagttaatgcctagcaatgttcccatgagaattgccaagcctccggccataagaattagcggtgtccatctacccatcttgatttctccttgttaacctaaccttctggttgccacactagctgagaaccttgaccccaaaatccgtcaaattttgttatcttcacatcacctaatacctgagtctgacaagctaaacgcaggtcttttgtaggagaatgaggaggaagcgaacgccgtgcttgatctcgccaattcgccacagacacttcaccttctacttggacagcacaggtaccacaacttaccaataccccgacagtttattaccttagcaccgctattgtagaggtcaatacccactttttagcagaactttgcgtaaattctctccgcgatcgcactcaattgttttacccctgagctaataccttaaggcatattttaatcagcaaactggcgttttgttgtatcttggcacattgcctttacagttgtctccaaagtcttagtcttatgaccaaaaatccctcaccccacatttggctttatgacaccacactacgggatggcactcagcgcgaagggctatcaatttctacagaagacaacgtacgcattgcccacagactcgatctggttagatatataaacgaagctactagaaattaggagtcaatgcaatgaaaaaagtagaagctattatccgcccatttaagctagatgaagtgaaaatcgctttagtcaacgcgggtattgtgggtatgactgtttctgaagtccggggttttggacggcagaaaggacagacagaacgctatcgcggctctgagtacactgtggagtttctgcaaaaactgaaggtggagattgtagttgaagataaccaagttgatatggttgttgacaaaatcattgctgctgctcgtacaggcgaaatcggtgatggtaaaatctttatctcacctgtagaacaagtaattcggattcgtactggagagaagaatacagaagccgtgtaagtaaggattattgttagtgttagcagggcgttatgctcgtgctgagtcttggtagagacgcgtttaatcgctgtctctacagaaaattttttacgcaaaacataatttcattcacagtcatcagcaggactcgatactaagttaagaattttatggtaatactgaaaagcaggcgtgatgacagccgttgagtaagagagcagatcatgactctggtttggcaagcagatttttatcgcagtcctcggcaagatttagatggaaaaatcttgtgggagttattaatttgtgatgtaaatcgtggtttcgagtatacggcgacttgtccccagtcagaagctaattctagttggttgactacccaaattcaattagcagcaggtgaaaaactaccagatattatccaagtttttcgcccccagtctttgagtttgattgaggcggctggacgcaatttggggattaatgtcgaaccgcaacgccaaaccccagctttgaaacaatggttacaagaaaagcaatattccatagcaatagataagccaccacctacaccgttaccggacaacttatggggcgatgagtggcgctttgctagtatccaagctggtgacatcgtggatttgtttagcgatcgcccaattcccattttatctttaccagaacccctcaaaccaattaatttaggcttggcatcaacagtggcgattcctggtgtggtaatttatggtggtaagcgatcgctaaatctagctagatggattgcccaaacccgcccagtagccttgaattatattgccggtgcgcccgatggtttgatactagaagctggtttggtggatagatggattttagttacttttgaagatgcagaagtaacggcggctgcaaaagtttatgaacaacgtcaaaaacaaagtcggggattacattttttattagtacagcctgatgattcaggtatgacttacactggcttttggttgttgcaagcaatatgatcttgactacctcatccaaataaaaacttcacccacaaggggatggaagtttgtcaagtggtcagtggtcaagtaccgta

SEQ ID NO: 229 - DNA, 880 bp, Brassica napus
gaattcccgggtcgacccacgcgtccgattttactactctcatcaatcatggcggcttcaatcgcgaaacccatctctgcaacctctctccgtttctactccgaccgaaagaacaacatttccttctcagattgcatctcgatatcttctgggttccgacattccccaccgtcttccctcgatttggtcgcaaaaccaccaccgaccaaggctcgcgtttcccatctcgttagagcccaaagctcttatgattatattccagactcaaagttttacaaggtggaagcaattgtcaggccatggagaatccagcatgtttcatcggctttactgaaaattgggattcgaggtgtgacggtttctgatgtccgagggtttggtgcacaaggtggatccaaagagagacatggtgggtctgagttctctgaagacaagttcgttgctaaagttaagatggagatcgttgttaagaaagaacaagtggagtctgtaatcaacaccataatcgatggagcaagaacaggagagatcggagatggcaaaatattcgttttgcctgtgtcagatgtcataagggttcggacaggtgagcgtggagaacaagcagagaagatgactggtgacatgctttcgtcatcttaggcacaaacaagagcttaagaatggcgtaataataaaatgaatggatgtgtttagttttctgttttgttgctgagttgatcaagatgtgtgtttaaactgtacatgaatgatgcagaaacatctgtcttggttctcagactgttcctagtaaaaacatgtagtccctgtttcatgtccttgtccgattatgaatccactagtatctatgttgtcaaaaaaaaaaaaaaagggcggccgc

SEQ ID NO: 230 - DNA, 2123 bp, Arabidopsis thaliana
ttcatagaacattatgtttatgaaacaaaaatgtaaatcaatcggaaactttggtggtatacaagtaaataatttggaaaaatacatgtttaagcaaaagtaattgttactaatatcctaatttctacaattgttgtttcgatggtccctttctttaggtgaggattgagacaatcttttagaatctttgattccactcttcgctccaaactctactttgctataacaacaacttcaaaatagattagttaagcgaatcaggttacattttaaagaaaacgatatagagagagcaactttgtatataattttaaaattcttcacctgaaagcctttaaaaaccagttcaagataaacccatctcaccaaactttagtaatcacaaaactaattaacgtcaaacaataacaattttttcacaaatttaattcttttattcctttattcgttgctcttatatttccatcgatctttctccttgtctcacaaacattctgacattttagagagcctcgacagagaattatttttttcttttttattttcgtttacaagtttcaattcttctctatatattaaaaaaacaaacagatgcaaccttggagaagaaaatttccattgttcgaaacaggagttacaatgaaacagaggaagaacagtaatctctcaatcttcgtcgtagtcttctctgttttcctcttcgggatcttcatgtacaatgaagacgtcaagtccatcgcagagtttcctttctccacctcaaaacctcacgacgtccacgacgaagcgacaccgatcacagagatcacaacactaccggttcaagagtcgatcaagaactcagacccaattcaggaatcgatcaaaaacgcagactcagttcaagattcagttaaagacgtagcagaaccagttcaagaggaggtatcgaaaacagaggaagttaaaaagattgagcttttcgctgcgacggaggatgaagaagacgtggaattgccgccggaggaatgcgatttgttcaccggagaatgggtttttgataacgagacgcatccattgtataaagaggatcaatgtgagttcttgacggcgcaagtcacttgcatgagaaatggaagaagagattctctgtatcagaactggagatggcaacctagagattgttctttaccaaagttcaaagcgaaattgctgttggagaagctaaggaacaagagaatgatgttcgttggagattccctaaaccggaaccaatgggaatcaatggtttgtttggttcaatcagtggttcctcccggtcgaaaaagcttgaacaaaaccggttctctctccgtcttccgagtcgaggattataatgcgacggtggagttttattgggcaccatttttggtggaatcgaattcagatgatccaaatatgcatagtatacttaaccgtataataatgcctgagtccattgaaaagcatggagtcaactggaaaggcgttgactttcttgttttcaacacttacatttggtggatgaacacattcgctatgaaagtcctacgaggatcgttcgataaaggagacaccgagtatgaggagatcgaacggccagtagcgtataggagagtgatgaggacttggggagattgggtggaacgaaatattgatcctctacgtaccactgtcttctttgctagcatgtctcctcttcacatcaagagcttggattgggagaatccagatgggatcaagtgtgcattagagacgacaccaatcctaaacatgtcaatgccattcagcgtaggaacagactacagactgttttcagtagcggaaaacgtcacgcattctcttaatgttccggtttactttctcaacattaccaaactctccgaataccggaaagatgctcacacttcggttcacacaatccgacaaggcaaaatgctgacgccggagcaacaagccgatcccaacacttacgccgattgtatccattggtgtcttcccggtttacctgacacgtggaatgagttcctttacacacgtatcatttcccgttcgtgacctacaaaatatttgaaatatctctttttcaatattttttcccactttgctccatccaatggaagagc

SEQ ID NO: 231 - DNA, 1927 bp, Glycine max
ctaagctccttgtgcggccaccattcttgttggagatttcaactctttctccttcagacttcttgggtttatgtgatgatggctctcaatatctcttctcctgctgaagtcaagtccatttttttcgctgattacttcaagtctaactgcatcactgcaaagttcacaggtggttttgcttttaagagaaaagagcgtggagctgcatctggagggcgagtttgttgctcagtgctggcaccaccaccaccaccggcctggccgggacgagcggttccagaacaaggtagcaagacttgggatggaccaaaacccatttcaattgttgggtgtactggttcaattggaactcagacactagatattgtggcagagaatccagataagtttaaagttgtggcacttgcagctggttcaaatgttactgttcttgcagaccaggtaaaaagatttaagcctcaacttgttgctgttagaaatgagtccctaattgctgaacttaaagaggccttgcatgacgttgaagaaaaacctgagatcatccctggagagcagggaatcattgaggttgctcgtcacccagatgcagtcagtgtagtcacaggaatagtaggctgtgcaggactgaagccaacagttgctgcgatagaagcagggaaatacatagctttagccaacaaagagacattgattgctggaggtccttttgttcttcctcttgctcagaagcataatgtaaaaatacttccagctgattcagaacattctgccatctttcagtgtatccaggggttgccagagggtgcacttaggagagttattttaactgcatctggaggtgctttcagggattggccagttgataaactgaaagatgttaaagttgctgatgcattaaaacatcctaactggaatatggggaaaaagataactgtggactctgctaccctttttaataagggtctagaagtaattgaagcacattacttgtttggagctgactatgatcatattgagattgtcattcatccacaatcaatcatacattcaatgattgaaacacaggattcatctgttcttgcacagttggggtggcctgatatgcgtttgccaatcctctatacattatcatggcctgacaggatttattgttctgaagacacttggccctgccttgatctttgcaagattggttcacttacatttaaaactccagataatgtaaagtatccatccatgaatcttgcctatgctgctggccgtgctggaggcacaatgacaggagttcttagtgcagcaaatgagaaagctgtagagatgtttattgatgaaaagattagctatttggatatattcaaagttgtggagctaacatgtgagaagcatcaaaatgaattgttatcctctccttcccttgaggaaatcattcactatgacctgtgggcgcgagaatttgctgctagtttgcaagactcttccagcttcactcctattcttgcatgaggatatgattaaactagggatgtggctgctggtgcttcccaattgcctgctttcaccataatttcttcaggcaattgaacaatttagaatgatgcattccctcagatgttgaaaaataaatagttttttttttttttgtttatggaatgttggtgttttaacacctttcaattgatcttataggtttgtcgtaatttcattgaaaacaatgtctttttaatagtgaataggagcctaggaggttggttgcctatgaatgtgtcaaagtcaagaaggggggtggatgttctcatgttcaaaatttacatgacgtggtcaactagaagttttgtatttcgctttttataataggattgaataagtgagtcttataaaacttaatagagatagataaaaaagttgaccaatcatcaaaaaaaaaaaa

SEQ ID NO: 232 - DNA, 1301 bp, Synechocystis sp. PCC 6803
gctcctccttggttcaatcctgggggagttttttcttctcagatgggcggcaaccccgtaagattgggaagattagttttagcttaagcaacggcggtaatggtgaaacgcatttctatcctcggctccaccggttccattggtacccaaactctggacattgttacccatcatcctgatgcttttcaggtggtcggtttagcggctgggggaaatgttgcattactagcccaacaggtggcggagtttcgcccagagattgttgcgattcgtcaggcagaaaagttagaggacctaaaagcagcagtggccgaactaactgattaccaacccatgtacgtggtgggggaagaaggggtggtggaagtggcccgttatggtgatgcagaaagtgtggtcacaggtattgtcggttgtgcgggattattacccaccatggcggcgatcgccgccgggaaagatattgctttagccaataaggaaacgttaattgccggagctccggtggtgttacccctggtggaaaaaatgggggtgaagttattgccggcggattcagaacattcagccatttttcaatgtttacagggggttcccgaaggggggttacggcggatcattctcaccgcttccgggggagcattccgggacttgccggtggaaagattaccgtttgtaacagtacaggatgccctcaaacatcccaactggtctatgggacaaaaaatcaccattgattccgccacattgatgaacaagggtttggaggtgattgaagcccattatctatttggcttggactacgatcatatagacattgtcattcatccccaaagcattattcattctttaattgaggtgcaggatacttctgtgctagctcaactggggtggcctgatatgcgtttgccgttgctctatgccctatcttggccagaaagaatttacaccgactgggaacctttggatttagttaaagccggtagcttgagttttcgggagccagatcacgataaatatccctgcatgcaattggcctatggggccgggcgagctgggggagccatgccagcggtgttaaatgcggccaatgaacaggcggtggctttatttttgcaagaaaaaattagctttttggatattccccgtctgattgaaaagacctgtgacctctacgttggtcaaaatactgctagccctgatttagaaacaattttggcagcggatcaatgggcccggcggacggtgttggaaaatagcgcctgtgtggctactcggccataaagtctagttggcttcaa

SEQ ID NO: 233 - DNA, 1251 bp, Agrobacterium tumefaciens
gggttttcgcgagtagagcctaattctgccaataaaaccgacgggctgaagatgacgaatgccagtgaaatgccacgcaagctgaccatattgggttcgacgggttccatcggcaccaatactctggatgtcgtgcgtcaactgggtggccgcgacgggttcgagatcatggcgctgaccggcgcgggaaacatcgcgcttctggccgaacaggcgcgggaatttggcgcgcagctcgcggtcactgcggacgatgataaatatgaagcgctgaaatcggcgctggcaggcaccggcatcaaagtcgccgcaggcatggccggccttgaagaggcagcctcgatggatgccggctgggtgatggccgcgattgccggcacccccggcctcgccccgacactgacggccgcccggcgtggtgccgatattgcacttgccaacaaggaatgcctcgtttcggcgggcgatgtttttctgcgcactgtcaaacagggcggcggccggctgatcccggtcgacagcgaacacagcgcaatcttccagtgcctgacgggtgaatacaaacaggcggtggaacgcatcgtgctgacggcttccggcgggccgttccgcacctggtcgcgggacgagatgtccaacgtcacggcggatatcgcccgcgcccatcccaactggtcgatggggctgaaggtctcgatcggcagtgcctccatgttcaacaagggcctggaaatgatcgaggcgaaatatctcttcgatctcaggcctgatcaggtggacgtgattgtccatccacaatcgatcatccattcgatggttggctacactgacggctcctatatcgcgcagctcggctctcccgacatgcgcaccgccatctcctatgccctcacctatcctgagcgcggcaatctaagcgtcgagcgcctggatttcgcgaaactggcacggctcgatttcgaagcaccggacgaagcccgcttcccggcgctgcggcttgcgcgcatggcgctggagcgtggcggtttgcagggcgcggccctgaacgcagccgaggagaccgcctttcacgcctttgtcgctggtggcatcggttttctcgacatggccgaaattgttgaaacggtgatggaccgtatgcatgacggccgcaccgccgagacgatggacgacgttttttcggcagacgaagaggcccgccgccatgcactggaactcatcgccacaaaagaaaaggccgcgtgaacgcgg

SEQ ID NO: 234 - DNA, 2589 bp, Zea mays
cacccattgctctcactcgctcccgccggttgctcgtccccggacccgccgcactactgctataggcgcatccccggcgccttcgcacactctctccccggccacttcccaaatccgcccgccattcatgcacccttctgtgcactgtcagcgccaccattagctcgcagctcaagctcgccactaccattttggtcggttcttgaggaaatcgatcgaaccgttggagtgccaccactggcagaggctgttgcattcttgagttgagcaggaagaggagaggaagcaatggctctgtcgacgttctctgtcccaaggggattcctcggtgtgccggctcaggactcccatttcgcttcggcggtcgagctccatgtcaacaagctgctccaggccaggcctatcaatctcaagcctcggcggaggccggcatgcgtgtcggcgtcgctgtcgtcggagcgcgaggcggagtactactcgcagaggccgcccacgccgctgctggacaccatcaactaccccgtccacatgaagaacctgtctgtgaaggagctgcggcagctggccgacgagctccggtccgacgtcatcttccacgtctccaagaccggcggccacctcgggtccagcctcggcgtggtggagctcaccgtcgcgctgcactacgtcttcaacgcgccgcaggaccgcatcctctgggacgtcggccaccagtcgtacccgcacaagatcctgacggggcggcgcgacaagatgccgacgatgcggcagaccaacggcctggcgggcttcaccaagcgcgccgagagcgagtacgacagcttcggcacgggccacagctccaccaccatctccgcggcgctcgggatggcggtgggccgggacctcaagggcggcaagaacaacgtggtcgcggtgatcggcgacggcgccatgacggccgggcaggcgtacgaggccatgaacaacgccgggtacctggactccgacatgatcgtcatcctcaacgacaacaagcaggtgtccttgcccacggcgacgctcgacgggccggtgccgcccgtgggcgcgctcagcagcgccctcagcaagctgcagtcaagcaggccgctcagggagctcagggaggtggccaagggagtgacgaagcagatcggtggctcagtgcacgagctggcggcgaaggtggacgagtacgcccgcggcatgatcagcgggcccggctcctcgctcttcgaggagctcggtctctactacatcggccccgtcgacggccacaacatcgacgacctcatcaccatcctcaacgacgtcaagagcaccaagaccaccggccccgtcctcatccacgtcgtcaccgagaagggccgcggctacccctacgccgagcgagccgccgacaagtaccacggtgtcgccaagtttgatccggcgaccgggaagcagttcaagtcccccgccaagacgctgtcctacaccaactacttcgccgaggcgctcatcgccgaggcggagcaggacagcaagatcgtggccatccacgcggccatgggcggcggcacggggctcaactacttcctccgccgcttcccgagccggtgcttcgacgtcgggatcgcggagcagcacgccgtcacgttcgcggccggcctggcctgcgagggcctcaagcccttctgcgccatctactcgtctttcctgcagcgcggctacgaccaggtcgtgcacgacgtcgatctgcagaagctaccggtgcggttcgccatggacagggccgggctggtcggcgcggacgggccgacccactgcggtgcgttcgacgtcgcgtacatggcctgcctgcccaacatggtcgtcatggccccgtccgacgaggccgagctctgccacatggtcgccaccgccgcggccatcgacgaccgcccgtcctgcttccgctacccgagaggcaacggcgttggcgtcccgttgccgcccaactacaaaggcactcccctcgaggtcggcaaaggcaggatcctgcttgagggcgaccgggtggcgctgctggggtacgggtcggcagtgcagtactgcctgactgccgcgtccctggtgcagcgccacggcctcaaggtcaccgtcgccgacgcgaggttctgcaagccgctggaccacgccctgatcaggagcctggccaagtcccacgaggtgctcatcaccgtggaggaaggctccatcggcgggttcggctcgcacgtcgcccagttcatggccctggacggccttctcgacggcaaactcaagtggcgaccgctggtgcttcctgacaggtacatcgaccatggatcgccggccgatcagctggccgaggctgggctgacgccgtcacacatcgccgcgtcggtgttcaacatcctggggcagaacagggaggctcttgccatcatggcagtgccaaacgcgtagaacttgtgctgatctgggcctatagagatgattgtacattttgtcgttaactagagtgtctgaacttgggagattagtcttctttggatgaaagtgtcgccggaacaacagttaccgtttctttttttgaaagagaaaggc

SEQ ID NO: 235 - DNA, 2001 bp, Agrobacterium tumefaciens
aaggccgaacgaatgaccggaatgccacagacaccattgctcgaccgggtgaattttccctccgatctcaaggagatcgatgatcgcgacctgccggaactggcacgggaactgcgcgacgagatgattgacgcggtgtcgaagaccggtggccatctgggtgccggcctcggtgtggtggaactgacgattgccattcacaaggtgttcaacacgccggaagaccggctgatcttcgatgtcggccaccaatgttatccgcacaaaatcctgaccggccggcgtgaccgcatccgcacgcttcgacaggaagacgggctttccggtttcacgcggcgggccgaaagcgaatatgacgattttggcgccggccattcctccacctccatttccgccggtctcggcatggcggtggcggcggggctcgatggcagcgaccgcaaggtcatcgccgtgatcggcgacggttcaatgtcggccggcatggcgttcgaagcgctcaacaatgccggtgcactcgatgcgcggctgatcgtcatcctcaacgataacgacatgtcgattgcgccgccgacgggtgcgatgagcgcctatctggcgcggctggcctccggccgcacctatatgggctttcgcgatttcggcaagaaactgaccgcctatctcggcaagaccatcgatcgcgccattacccgcgccgtgacccatgcccgcggttatgtgaccggcggcacgctgttcgaggagcttggtttctatcacatcggcccgatcgacggtcattccttcgatcaccttttgccggtgcttcgcaatgtgcgcgacaaccagaaaggccctgtcctgatccatgtggtgacgcagaagggcaagggttacgccccggcggaagcggcagcggacaaatatcacggcgtcaacaagttcgacgtcatcaccggcgcgcaggcgaaagccaagccaaatgcgccgagctataccagcgtgtttgccgaagcgctgatccaggaagcgaccctcgacgagaagatcatcggtgtcaccgctgccatgccgaatggtaccgggctggacaagatggccgagcttttcccgtcccgcaccttcgatgtcggcattgccgagcaacacgcagtcaccttcgcggcgggacttgcggccgatggttacaagccgttctgcgcgctttattccaccttcctgcaacgcggttacgaccagctggtgcatgatgtggcgatccagagcttgcccgtgcgtttccccatcgatcgcgccggcttcgtcggcgccgacggaccgacccatgccggctccttcgacacgacgttcctcgccaccctgcccggcatggtggtgatggcggcggccgacgaggcggagctaaaacatatggtccgcacggcggcggcttacgatgaaggcccgatttcattccgttatccgcgcggcgaaggtgtcggcgtcgaaatgccggcacgcggtgagattctccagatcggcaaaggccgcatcatcaaggaaggcaccaaggttgccctcctctccttcggaacgcggcttgcggaatgccttgcggccgccgaagatctcgatgccgcgggcctttcgactacggttgccgatgcgcgcttcgccaagccgctcgatctcgatctcatccgccagcttgccgcccatcacgaggttctggtaacgatcgaggaaggttctgtcggcggttttggtgcgcatgtgctgcatttcatggccagcgccggcctactcgaccatggcccgaaggttcggaccctgaccctgcccgaccagtgggtggagcaggccaagcctgagaccatgtatgccaatgccggcctcgaccgcgccggcatcgtttccaccgtgtttaatgcgctcggccagcgtcaggccggcgtcggtttcgccggctgacaagattgccgggacaggaggcgggactatcccgcctctttctcaggatacagcgccatcgagaaaacc

SEQ ID NO: 236 - DNA, 2101 bp, Xylella fastidiosa
cattttctgaagtgttgttgtttttgaggttccggtgatgcgcattaggtcagtcatcaatgtcatctttatgcttcaccggattgcttgctcgggtccattatggggaggacaatggtgcttccgttgtaatgccaagacgatgattgattccacttgttatccacgcttgtcgcgtatccaaatcccagaggatctccgcacttttcaggagtcggagttgcgtgcggttgccgatgagttgcggaattatctgatcgaatcagtaggcctcagtggcggtcactttgctgctgggttgggtgtggtcgaattgacgatcgctttgcattatttgtactgcactcctatcgatcatcttgtctgggacgtgggtcatcaaacgtatccgcataagatattgaccggtcgccgtgacaagattagtacggttaagcatcaaggtggtttggcaccgtttccgaagcgtgaggagagtatctatgacacgttcggtgtcggtcattcttctacttctatttcagctgcgcttgggatggcgattgtggcgcagcgtcatggggatgagcgtaaggtggtggccatcatcggcgatggtgcgatgacggcagggatggcttatgaggcgctgaatcatgctggcgggatgagtcctgcaccgaatcttcttgtgattcttaacgacaatcgtatgtcgatttccgaagcggtcggtgggcttaccaagatgcttggtcgtgcgactggcagcaaagcattgaatgcgatccgtgagggtggcaagagaatttttggggataagaaaaccaatgcaaccgcgcgttttttacgtcgctgggaggagcattggaaggggatgtttgtgccgtcgacgttgttcgaagagatggggttccattataccggcccgatcgatggccatgatttgccggcccttcttggtgcgttgaagacgttgcgtacgttgaagggtccacagttgttgcatgtgatcacaaccaaagggaaggggtatgagctggctgagggagaccagattggttaccacgccgtcgccccgtttgatccgcaaaagggtctgattaaggcgggagcaaagaagcaaacatatacggacgtgtttagtgagtggttgtgtgatatggcagcggtggaaccacgtttgctggctattacaccggcgatgcgtgagggatcggggttggtgcgttttagtcaggagtatccgcagcgctattttgatgtggccattgctgagcagcacgcgataacgttggcggctggtatggcgactcaaggtgctaagcctgtggtggcgatttactcgacctttttgcagcgtggttacgatcaattggttcacgatgttgcgttgcagaagttggatgtgctttttgcagtagatcgcggtggtgtggttggtccagatggtgcgacgcatgcgggtaatttggatctcagtttcctgcgttgcgtgccaaacatgatgttgatggctcctgccgatgaggcagagtgccggaagatgttgagtaccggtttccactattctgggccagtagcggtgcgttatccgcgtggtacgggtcctggggtggtgccgtccgctgagttggatgtgttgccggttggtgtggcgcagttacgtcattctggtacacggatcgctctacttggttttggggtgtgtgttgctcctgctgaacaggtggggcgtaggcttggtttgactgtggtcaatatgcgttttatcaaaccgttggatcgaacgttgctgttggagttggcgcgtactcacgaagggtttgtcacgattgaagataatgtggttgctggcggagctggctcaggggttgcggaattacttaacgctgaaggcatcgttttgccgattgtgcatcttggtcttccagatgcgttccagcaacacgcttcccgtgaggatttactggctgaggcgggtattgatgcggctggtgtgtatgctgcgctgttaagtcgttggcctgatttggcggtacagaaccatccgctgagtgcggtgagttgagctcagtactgtttctgtttcatcttctgtaattgagctgtacgagatcat

SEQ ID NO: 237 - DNA, 1153 bp, Zea mays
cgtccgctggctctgcatatcccgcgcccgactcccgttgctgcgtgcggcggcccgactagtcgcgccgcgctgcgcttggcttgattgaaccggccgggatgggggtgttggaagacctcgtggcgagagcgggcgggtgcgcggtcatcgacggcggcttcgccacgcagctagaggcgctcggcgccgacatcaacgacccgctctggagcgccgcttgcctcatcaccaggccgcacctcgtcaaggaggttcatatgcagtatcttgaagctggtgcggacgtcatcatttcatcatcttaccaggcaacaatcccgggtttcatagctagaggaatgtctgtcgctgaggcagaagatttactgcgaacaagtgtaaaactggccaatgaagctcgagatgaattttggaagtcaacactgaggaagtccaaacctatttacaaccgtgctctggttgctgcatccattggtagctacggagcctatcttgctgatggatcggagtacagtggatcatacggtgctgacatcacagccgagaagctgaaggacttccacaggcgccggctgcaggttcttgcaagtgccggtcctgacctgattgcgtttgaggccattcctaaccaaatggaggcacaggcattggttgagcttctggaggaagagaaagtccagatcccttcctggatctgcttcagctccgtggacggtaagaacctgtgctctggggagagttttgcggactgccttaagatcctcaacgcgagcgagaaggtggccgttgtaggcgtgaactgcacacctcctcagttcatcgagggcatcatatgtgaatttaggaagcaaaccaagaaggcgattgcagtttacccgaacagcggcgaagtttgggacgggagagcgaagaggtggctgccggttgagtgcttgggtcacaaaagcttcgacgctctcgcgaagagatggcaggaggcgggggccagcctcatcggagggtgctgccggacaacgccttcaactattagggctgtttccaagatcctcaaaggaaggacggggcattgatttgtttattataattgagctgttgttgcattatgtcactagccagaataacattcagaatatgtatcctgttgctcttc

SEQ ID NO: 238 - DNA, 1526 bp, Zea mays
ccctcaccctggtctggtctcctctccaagcgggcagcgctcctccaaactgaaccctatcctagcacgagtgcacgtcggtggcagcaggagatggtggggacggcggaaggcggcgcggagagggcggtgcggcggtgggtggacgccgccggcgggcgcctggtcctggacggcgggctggccacggagctcgaggccaacggcgccgacctcaacgacccgctctggagcgccaagtgcctcctctcctccccgcacctcatccgcaaggtccatatggactacctagaagctggggcgaacattataatcacagcatcgtatcaggccactatccaagggtttgaatcaaagggcttttcaaaagaacaaagtgaaaacttgttaacaaagagtgttcagattgcactggaagcccgtgagatgttcttgaaggaacatttggagaaatccactcctatacagcatcctattctggttgcagcagctctagggagttatggggcttatcttgctgatggctctgagtacagtggggattatggtgaagctggtacgaaagagttcctgaaggactttcatcggcggaggcttcaggttcttgctgaagcaggcccggatttgattgcttttgaaacgatccccaacaaattggaagctcaggcatatgttgaactccttgaggaatgtaacatcaatatcccttcatggctttccttcaactcaaaagatggagtgcatgttgtgagtggtgattcgttaattgaatgcgctactattgctgacaagtgtgcaaaggttggtgcagtcgggataaattgcacacctccaagatttattcatggactgatactctccattcgaaaggtcacagacaagcctattctgatatatcccaacagtggtgaaagatatgatggtgaaaaaaaggagtgggtggaatccactggtgtgtcagatggtgattttgtttcgtacgtaaatgaatggtgcaaagatggggctgcgcttatcgggggctgctgcaggacaactccaaacactatcagggccatacacagaactcttaaccaaggctgccacaagcatcagttacctgtagcatagatctgtgctccactcctgatgctctcctcccagcagtaccttgagctgtatccccgagattccttaaccagcgcgaaccaatatactgttgcgtgttctcctgcaaatgagatgttctgcacctatgtttgtaatgttgtatttctgggtttttaagctatccaacttggagatacaaccggtgaggaagcagcaacaataggtagttctacttctgagtgaggaaaaacaacttgcggctgagttaatgaagcttagtagctaccaccgttgtatgacagttgctcagagatgttatcttcattaagtgcttatattaccgctagttcgctgtgaaatttgttaaaccattatatgtaagttttgtttgacaagactgcatctcctgaaactaagatcttagtttcctgctaaaa

SEQ ID NO: 239 - DNA, 1001 bp, Escherichia coli
cgcaaaacaggagccagaacatgtcgcagaataatccgttacgcgctcttcttgataaacaggatatcctgctgctggatggcgcgatggcgacggagctggaagcgcgagggtgtaacttagccgacagcctgtggtcagccaaagtgctggtagaaaacccggagcttatccgcgaagtgcatcttgattactaccgggcgggggcgcaatgcgcgatcactgccagctatcaggcgacgccggcgggcttcgccgcgcgaggtctggatgaagcgcagtcgaaagcgctgattggcaaaagcgtggagctggcgcgtaaagcccgtgaagcgtatctggcagagaacccgcaggcgggaacgcttctggtggcgggatccgtcgggccttacggcgcgtatctggcggatggctctgaataccgtggcgattatcattgtagcgttgaggcatttcaggcgtttcatcgcccgcgcgtggaagccttgctggatgccggggccgatctgctggcctgcgaaaccctgccgaatttttccgagattgaggcgttggccgagctgttgaccgcatatccgcgtgcgcgggcgtggttctcatttaccctgcgcgacagcgaacacctgagcgacggtacgccgctgcgtgacgtggttgcgttgctggcgggttatccgcaggtggtggcgctaggcattaactgtattgcgctggaaaacaccaccgctgcgttgcagcatttacacggtttaacggtgctgccgctggtggtgtatccgaactcgggcgagcattacgatgccgtgagcaaaacctggcatcatcacggtgaacattgcgcgcagctggcggattatctgccgcagtggcaggccgctggcgcacggttgattggcgggtgctgtcgcaccacgcctgcggatatcgccgcgttaaaagcgcgaagctgagggtttatcgggtctacatcgttcattgtaggcctgataagcgcagcg

SEQ ID NO: 240 - DNA, 1101 bp, Saccharomyces cerevisiae
agaagaaatctgaatcagcaacttttagtgtgcaacttgaaaaagtaatcaaaaaacagatgaagcgcattccaatcaaagaactaatagttgagcaccccggaaaagttcttatccttgatggtggacagggtacagaattggaaaacagaggcattaacataaatagtccggtatggtctgcagctccttttacgagcgaatccttttgggagccatcttctcaagagcgaaaggtggtagaagaaatgtacagagactttatgattgctggcgcaaacatattaatgacaattacttaccaggcaaactttcaaagcatatctgagaatacctcgattaaaactctggctgcttacaagcgttttctcgataaaatcgtgtcatttactcgtgaatttattggtgaggaaaggtacttaatcgggagtattggcccatgggcagcacatgtatcctgtgaatatactggtgactatggtccccatcctgagaatattgattactacggctttttcaaaccccagctggagaacttcaaccaaaatagagatattgatcttattggttttgaaacgattccaaattttcatgagttaaaggctattttatcctgggatgaagatattatttcgaagcccttttatattgggttgtcggtggatgacaatagtttgctacgagacggtaccactttggaagaaatttctgtccatataaaaggcctcggaaataaaattaacaagaatctcttattaatgggagttaactgtgtcagtttcaatcaatcggcattaattcttaaaatgttgcacgagcatctacctggcatgcctctgctagtttacccaaacagtggagaaatctacaatcccaaagagaagacatggcaccggccgactaataagttggatgactgggagaccacggttaagaaattcgttgataatggtgcgcgcattattggcggttgttgtagaacgtctcctaaagatatcgccgaaattgcatcagctgtagataaatactcctaattcaatttcttttaacaaatatcttgtatctacaaaactaaaagcagtgtatatacgtcaatgtgcg

SEQ ID NO: 241 - DNA, 705 bp, Zea mays
ctccaaacgcagcagagcccctagcgccgccggtctcttcagcctcgcagcacaccgccgccagcccgagtgaccgctgcagcctagggtttccggcggcgatggcgggtaagggagggaagggtctgctggcggccaagacgacggcggccaagagcaccgacaaggacaaggacaggaagaaggcccccgtgtcgcgctcctcccgcgccggcctccagttcccggtgggtcgcatccaccgccagctcaagtcgcgtgcctccgcgcacggccgcgtcggcgccaccgccgccgtctattccgccgccatcctcgagtacctcaccgccgaggtcctcgagctggccggcaacgccagcaaggacctcaaggtcaagcgcatcaccccgcgccacctgcagctcgccatccgcggggacgaggagctcgacaccctcatcaagggcaccatcgccggtggcggcgtcatcccgcacatccacaagtcgctcatcaacaagaccgccaaggagtgaatccaggccgtgctgctgcttctgcctgactacagtcccatctcgttctgtacttgtgctatcttagtttaagtgcatgttggcacagttctagtaaactcatcttgttcacctatgttaatttaagctctcttccgcgagctttttggattgctggtatcgtgattaacgggttcgtaaaattagt

SEQ ID NO: 242 - DNA, 673 bp, Zea mays
aatcaatccttcaagcgcaagctgcctcctcctcgtcgtccggtcgtgagaagggatggcgggccgtggcaaggctatcggcgctggcgccgcgaagaaggcaacgtcgaggagctccaaggccggactccagttccccgtcggcaggattgctaggttcctcaaggcgggcaagtacgctgagcgcgtcggcgccggcgcccccgtgtacctcgccgccgtcctcgagtacctcgcggctgaggttctcgaacttgccgggaacgccgcgagggacaacaagaagacccgcattgtgccgcgccacatccagcttgctgtgcgcaacgacgaggagctgaccaaactgttgggtggtgccaccatcgcgagcggaggtgttatgcctaacatccatcagcatctgctccccaagaaggctgcctcctccaaggccagtgtcgacgacgacgacaactgagactgcttcctgcagaaatgatccgaccaccgccttgttttgtaggaataggatgatgttgtcttcgatcggggaggagtcgggtatgctgggaaggagaattagattagtatctgtttttttgaatgggatgtgaacgtggctgtgaatctcaggattgtatgctcgttgagaaagaaatggaaggacttcgtgatgcacgatgttgatgcc

SEQ ID NO: 243 - DNA, 706 bp, Zea mays
ctcatcttttctcgtttagaacctctaaaatttcccccactcgccagtcgcagcagcacctgtagcagccatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgttctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggtggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcatgctctagtatcgtccttgtgtcttattgtatgttcgtcttcatcgagaagatcttcagcagtcagagctcgttgtgtactaatgttccccc

SEQ ID NO: 244 - DNA, 854 bp, Zea mays
ccacgcgtccgagcacgggggcttgatcgaagatggatgccggagcaaaggtggtgaagaaggccgcggcggggcgtcgcggcgggggcggccccaagaagaagccggtctctcgctccgtgaaggccggcctccagttccccgtaggccgtatcggccgctacctcaagcagggtcgctactcccagcgtgtcggcaccggcgcccccgtctacctcgctgccgtcctcgagtacctcgccgccgggctcctcgagttggcggggaacgcagcgcgggacaacaagaagaaccggatcatcccgcggcacgtactgctggcgatccgcaacgacgaggagctcgggaagctactggccggcgtcaccatcgcacacggcggggttctgcccaacatcaaccctgtgctgctccccaagaaaaccgctgtcgctgctgccaaggaaggcaaagagaagaagtcacccaagaaggccgccgccgccaagtcgcccaaaaaggtggccgcctcgtaggtccctggcaatgctgatgcactgtctctctctgtcctctctgaactgaaacgctcctagctgtcgttgtcggtcatggtcgttgttgtttgatgcgcttttattgtggttgttcgtgtgtaattgcttgcctttcgcccatttggcatgcactgtgtagggtcacactggtctaggttttcaatctgggaaacaccggtttagattcaaggagcgtgaactgtgaaggcaggtgagagggtgggatctgtgaatcattaggtgctgtttgtaataagattgcaaagatgtgtaaaatttgttttgtgcttccattcaaaaaaaaaaaaaagggcggcg

SEQ ID NO: 245 - DNA, 2492 bp, Zea mays
  unsure (1)..(2492): unsure at all n locations
cacgcatccgcagccgccggaagcaagcaagagctgcgactgcgagcaggctgtattaagcgaagcgacgacctccgttccattgcgaacaggctacatacagatcagagtgaggaagaagaggaagccgaatttcttttcactcttccgactgacctttcgcgggtgcgcacgccacctcgggtcgggagcgcgtcgatcgagtccgtggcggtggcggcgtgggacggtgaccggtaagtttgtacaatataaagcgcggcggccacacagtcacacacactgacacacacacaccagctgggagctscggagatgcancagcggcgcaagtcggtgttcgcgtccgcgccgttcgcgatgaagcaggcggcgctgggagccggcgtggcggcgcgcaagaacggcgcgccgctgtcgctggccgcggtggtgttcgcgctcttcgtcttcgcgacgttcctctacaacgaggacatcaagtccatcaccgacttccagttcagctccggcgccatccgcgccaagtcccccgacctgcacctcctgcaggaggccgaggccgcggcgcacgccgccgtgaacaccctggccaagcgcggggaggaggtgatcgtgcgcgtcctcgaggtcgaggcgccgcccgtcgtcaacactagcagcgtgctggcggccgccgcgaaggccagcgccaaggccaacgcggtggacgtggggcaggagaaggagcgggacgtgacgctcccgacggtgacggggggccgaggcggggccgacgaggcccggcggcgcgctgacgaggaggtcgctgagaaggccgcgtcggcgaaggcggcggcggccaccgccgctctgcgcggcgtggtgagcgtgccgcagacgtgcgacctgtaccggggcagctgggtgtacgacgaggtgagcgcgccggtgtacaaggagggcgagtgcgagttcctgacggagcaggtgacctgcatgcgcaacgggcggcgcgacgactcgtaccagaagtggcggtggcagccggcgggctgcgacctgccgcggttcgacgcgcggctgctgctggagcggctgcggaacaagcggctgatgttcgtgggggactcgctgaaccggaaccagtgggagtcgatggtgtgcctggtgcagtcggtgatccccgacagggggcagaagacgctgacaaagttcgtcaacggcgggtccagcaacgtgttctacgcgcacgagtacaacgcgacggtggagttctactgggcgcccttcctggtggagtccaactccgacaaccccaaggtgcacagcgtccccgaccgggtcatccagtggcacgccatcgccaagcacgcgcgcaactggatcggcgtcgactacctcgtcttcaacacgtacatctggtggctcaacacgctcgacatcaaagtcctgaagcaggggtcgtccttcgatgaccagggctccaccgactacgtggaggtggaccggcccgtggcgtacaaggaggtgctgacgacgtgggcgaaatgggtggaccgcaacatcgaccccaacaggacgaccgtcttcttcatgggcatgtctcccaaccacatcacgcctgaggcttggggcaacaagggcgggatcaagtgcgccatggagacgctgccgatcgcgagcaaccgcagcgcggcgctggacgtgggcacggactggcgcctctacgcgggggcgcgggaggtgctgcccacgctgcgccgggtgcccgtccacttcgtcgacatcaccgcgctgtcggagctgcgcaaggacgcgcacacctcggtgcacacgctgcgccaggggaagctgctcaccccggagcagcaggccgaccccaagacctacgccgactgcatccactggtgcctcccgggcctgcccgacacctggaaccagttcctctacgcccgcatcgcatccagcccatggcccaacgacgcccaggcccagcagtagggaccctgcacctgctcctccttctatcttcctcattcgccgcgggccggcgcctcacgacacaaaagggaggcctgggctgcaacggcccgcccatcgacgagagctctggcgtttctgcttcaagctagctgatcagccaaaagggggcgaaagacggcgtttctgctcgccgtctttgttttctttccttttttttaaacgatttttctttctcttttcgttgcataaaaggaaactggtccgtgttgttcaccttcgattctttggtccaaacacaagtggatggtctggggtaaatgagggtgtgacgagcttagttgctcgctcatttggtttcttctcctaccaacgatgcctagggggaaagcaagagttgagcatgaagatgtgatgggggagaagcaaagctggggggagtacatgtaaagaagaatttttgcgttgtatttttatatgctgctgcagtgcacccaaggttaagagaggtataaagagcatttgttctt

SEQ ID NO: 246 - DNA, 912 bp, Zea mays
gaaagcctgaactgaaataagaacgaagtggaataggacgaaggaaggttctgcatctcagattgaatgtcggaaggaaagaagtacttgattgtgttggctcaccatgagcccaagtcgctgaatcactctttcgctcaacgtgctcaacaggtgctcacggctgctggaaacgaggtcaagctgatcgatcttcatgccgtcaacttcaacccggtctcggatcgacgcaacttcaagacgacggccaacccggagtttctcaaacaacagatcgaggagcgacatgctaccgaacacgatgggttcgctgatgacatcaaggagtccctggaggcagtcgactggtgcgatgtattgattctccagtttcccttttggtggttcagcatgcccgccatcctcaaaggatggatcgacaaggtctgggccagtggaagagtctacggtccgaacaagaagttcaccgctggagtgtggaagggcaagaaggccttcctctccatcacaacgggctcttccgagccgacctacgcgggacctgactctcgcatgggagatatcaacagtctcctcttccccatcaaccatggcatcttagccttcgttgggttcacggtcttgcctcccttcatcgcctactcagcttcgcatgccaccgaagaccagaggaagcagttcctggatgagtacgaacagagacttctgaacctggagaacctcaccccgatctcctatcctcccaacgaagccttcgactccaccggaatcctgaaagcagactggaaggctgctcaagctcaccagaactcgaaccctgctccacgcgaaggctgaaagcctccctcattccctccttccatctgaatgaaaccagctgttggcataccgaggtagcaacttcgaaacatc

SEQ ID NO: 247 - DNA, 3009 bp, Oryza sativa
  unsure (1)..(3009): unsure at all n locations
cgacgagtatcccgaccaccactctctctctctctctactctccctcctcgccgcgccgcgccgccgccgccgccatgagcgcgggctggaggacgctgctgctgcggatcggcgacaggtgcccggagtacgggggctccgtcgaccacaaggagcacatcgaaacttgttatggtgtgctttgtcgagaatacgaacactccaaagatgcaatgtttgagtttctcctccaatgtgcagatcaattgcctcacaagattcctttctttggagtattgataggtttgataaacttggaaaatgaagatttttccaagggtattgtcgatacaacacatgccaatttacaggatgccttgcataatgaaaatcgtgacagaatcaggatattgctgcgntttctctgtggcctgatgtgcagcaaagttgtcctgccaaattctattattgaaacatttgaggcactattatcatctgctgcaacaatattagatgaggaaaccggaaatccttcgtggcaaccacgtgctgatttctatgtttattgtatcttggcttcccttccatggggtggctcagaattgtttgagcaagttccagatgaatttgagagagttctggttggtatacagtcttatataagcattagaaggcattttgatgatattgctttctcagtctttgaaacagatgaaggcaactctcccaacaaaaaggatttcatcgaagatttatgggagcgtattcaagttctttctcgcaatgggtggaaggttaagagtgttccaaaacctcacctgtcgtttgaagctcagctggtagctggagtttctcaccgtttctccccaattagttgcccccacctactatctcgcaatgcatcctctgaaatagtaaaaggtcaagaaaagcatgaagctgatctgaagtatcctcaaaggcttcgtaggcttcacatatttccaacaaataaagctgagaacatgcaacctgtagatcgttttgttgttgaagaatgcatattggatgtgctacttttcttcaatggatgtcgcaaagaatgtgcattttatctggtcagcttacctgtgcctttccgttatgaatacctgatggctgagaccatattttcacagctactgttattgccgaatccccctttcaggccaatttactataccttggttattatcgacctttgcaaggcattgccaggtgcatttccttcagttgtggtaggagcagtacatgctctttttgacagaattagcaacatggatatggagtgccgcacccgacttatcctatggttttcacatcacttgtcaaattttcagttcatttggccttggcaggagtgggcttacgtcaaggaccttccaaaatgggctccacagcgtgtttttgtccaagaagtattagaaagggaaattcgcttgtcctactttgacaaaattaagcagagcatagaggatgctgttgaattggaagaactgttacccccaaaagctgggcctaacttcagatatcatagtgatgaaggcaaagaaagcactgatggccacagactctccaaggaacttgttgccatggttagaggaaggaagacacaaggtgatattatttcatgggtagacgaaaaaataattcctgtaaatggtgccaaatttgcacttgatgtagttagccagacacttctggacattggctcaaaaagtttcacccatcttatcactgttttggagagatatggtcaaataatatcaaagctgtgcccgaatgaagaaatgcagttattgttgatggatgaagtcagtgcttattggaagaacagtacccagatgattgccatagctattgataggatgatgggttatcgcctactttccaatctggctatagtcaaatgggttttttctcctgctaatgttgatcaatttcatgtttcagatcgtccatgggagattcttagaaatgctgttagtaaaacatacaatcggatttttgacctccggaaagaaattcagacactcaggaaaggtcttcaagctgctaaagaggccagtgaaaaggccgccagagagttggaggaggctaaatctattattgagattgtagatggccaacctgtgccatctgaaaatccaggaaggctaagacgacttcaagcgcgtgctgacaaagcgaaagaaggagaagtaaccactgaagaatctttagaagcaaaggaggccctccttgctcgagggcttgaagaaagcaaggaattgcttaggttactattcaagagctttgttgaagtgctaactgaacgtttgccacctatttctgctgatggagatgttcctaatttacgtgctggagacccgaatgtaaattcttcagcccgtgaccctgaagcaacaaccatggaaatagacaatgaaaatggaggagataacgatagtcagctgaatggtcaaaacaagaaaatcagtcacaatgttggagagcttgagcaatggtgtctctgcacattgggctatctcaagtcgttttctcgtcaatatgctactgagatctggtcccatattgccatgttggatcaggagattttcgttgggaatattcaccctcttatccggaaagctgcttctccggtttgtgcagacctaccagtgaagggtctcacctttgattttgacccttccagtgagttggagtttacctgtattatacgcgacaaatttttcatcatgctatcactaactggacatgcccaaaagtactctgatgtgtactcaggaactccatcgattctcctgtaatcctggccccgaggaacacccttggtggaaagcactgtaacgactttaggtgattaaattatcagttaggtttatttgaattgtagtggactaattttcttgggtgagtaattgctatggtctagctttcttaattccctctgcctgtgttagacaacgccgtgtttattgataagctgatctgaagctgtgattatcttt

SEQ ID NO: 248 - DNA, 4223 bp, Saccharomyces cerevisiae
atcgataaaaagggaaactgaattagaagaaagaatacggctgtatgaaaccaataattcagcaccatcttttgacgattcttcgagtgtgtctttttctgactttgaaaaggaactgagaaaaaaatccagtaaaattgtgcaattgatccagcaattaaatgacgagagattaaagagattcattgcggaggagcagttattactccaagaaaatggcaccaaaccaagttctatggaactagtaggaagaattgaaaacttgaataaacttattgatgagagagattcagaaattgaaatgcttaaaggacgtttacagtagatgaatgatgtattttattgtatatatcgcttagtgcaccaaaatcatactacgtaagtataaaatcactttacacgtagaagatgctttttcagattgttcttgaaaaagttgaaaaaaatataattcacactcagcaacaggtgaaagtgtataatgggtaaaaaaggaaggacagaaggtatattgctaatcaaaacgactttggtatacgcgtttggggctacaattgcattttaaatatatttaagatgtttaatagaaaaagaagaggaggtatgttttaaaaccaatgttttccagaagtttcgttctagagtgtgtatatcaagaccaattaggatggtatttccattttttgtcagttagtacggtgtgacagaaaagtgtacttttgtggcacagagaagtggagaaacggtacacgtagaatacataacggcaagtaacctctcttattttactctccatctttactttgttttacattcctaggattattaggttagcttggttttacaaaaactcaattattcagtttcattcaaattactaacatacccaactttgactaccttgcatatgattttaccgttagacttcgatgaagatgaaaattaccgtgattttaggcctcgcatgcctaaaagacagagaatcccacctgttgtacaactgtgtaaagaaatgatgcccgatattcgcactattggtgaatctgttaaagcttttgaagatgatatcaaattcttgagtgaagctataatgaatgagtatggccatgaggactactttaataatgctttactgagcactttaaacgctgttgttgtggagcaaccacagaagcaagctgctatcgctctcttaaccatggttgttaattcgaaaaataatgttgccggaaagagtattatcaattacttcttcgaagaattacaaaaatggtgcaagcaaacatataatgatgaattcaagagtacgtcaaatgaaactgggccatggaacaagatcaagttaatcctgagatttttatccattctatcgcccatgtttttagttgatgaactaatcaatatctacaagagcttatttgaattgagtatcgaattaaacaatctggatccaggtaacagagttcctttatctgaagcaatttacaccaatacattattaaatatcccgtatttgttcttttttaataggaataatgacggtttgaggacaaaagtggaggagttacttgcatacgttgaacaaaactatctagttaaaacaacggatataaacctattaagagaatacaatggtgaacctccatatgaaatggtagaacttgtccgagtcgtattaccaaacgtcaagaaggcgctaatcaataacttggaacagctgaatgaattatttcctgattggaatcatttattaactccccaaaccggtgatgaagggttcaatgacgctttaacccttccatcagtagatgatctaaagtctttcgtgcgcttgaataaaaactttggttcagttgatagcatgtggaagacaccaaggtatgcttttcatgtttacttgccaaactccgctggtaatttcgaaacagttgtaccaatcagcacttatgctggtcaattattcaacgatatcattattgatctggtggaaagtttagaattcaatagaaaggaagtagctagacaagtgataactttggatctttttttcaaagcaggtatatttacagaacctggtgaatctattgcccaattaattgccacttatgaagagaacccattggctcctacatttaagatagaagatttggctattgaaaccattttgggacttatttttaaattacctagtgtttcccagccttttgcatacttttacactttattggtggatatttgtcaaaattctccaaaagcaattgctcctgtctttggtagagcctttaggtttttttatagtcatttggattcattagattttgaactaaaattaagatatttggactggttttcaattcaaatgagcaactttaatttttcttggaagtggaatgaatgggaagacgattcgatcaaatttggcaagtatttttataatccaaaggtaaattttgctaaaaatttgattcaaaaagaactacgattgacctctaacttttcagaagtagaggacagcctaccacaagaattcacgaaatatttggatacttcttacattccaagagatcaactgattaactactatcaatcattattcaccggttatacggtagaagaagattccgttagaaaaaatgatctatattttagacaagaaggtgtacctatggaaaacacagtccgtaaaattttagattatacccacaaagcaaacaattctagggaagttactgaattagaaagtattctaggtgagttaaagaatgagtatggttccataatttccgactttaacagatttgttatcatattgttagtccaggccgttacagactctggtagtagatctttatcacatgctaataaatatattaatgatttaaaagaagatctcaaaaccatatttgcgaagattgaattggatatcgagacaaaagagtatatcataattgaagccgtcctaacattttggaacgccaaccctcagacaggtttcttagtagcagatgcattcaaatatgcaggtttacttacttccagaaccatttttacatttatatttaacgaaactggtttgaagaataatggtttgattgaagctacagcaattgaagcggtctttagaaatttatctcaacaaatctcggaagagaacgaaagtggaaataattttgagttcgttttcgaaagattatgtaccatcgccaacagtactatagacttactagatgtcaatgctgatgaagatattgagatacctaaagtcaacggggaaatggacatcgacgatattgaagatgataaactggatttgaaatggaaatattttacagtgattgggtttattaaaagtatattaagaaggtattcccacgaatatcgtgagttagcagacaaattcattgccaacattgataacgctattccacacgaatccactaggagaacaatttcgaattggattcaagaaacaaaggaagtttaaaaagattcggaggatggactacattcgttatcactccgctttttaatttttaatcaatgttacatacctagcgtaattttcctatatataaaatatcagctttatataaatatattattgaaactgtacctataataataaatttaaaattaagtaaatacaaatgcttcaaaatttgttagtattgttttcttcaatcatctttacttaattgtcatcgcaataattaaattaatattttattgttgttgcgtatataatacaacctgaatggtatgctacactatgttacactatgctattgatcagagtttctaatgacgaattacacttctataactatccgctttggaaagtttgagacgaagggcgttacaatcagaatccgtatccaaaggatgttcttcagaattagtcagatctacacctgatgaaacatgccttgcgacagtacttatgctactttctctaaccaaatgtgtaggcggttcgggaaagtaatgcatatcatcctgcgcgtattcgttttcatcaaatgggtttattgaatattttgattcagttcttccaatgttatttgaactgccatttaatctaaaattatgtaaatttgcaaatgaagtgtctcttgttaatgacacttcaccgaaatagagacaaaacttaacaaactttatgaactggtctctagtaacgtccttccctgaaaatctaattgtttcatataaatcggggatcc

SEQ ID NO: 249 - DNA, 927 bp, Zea mays
gcccacaatggcgtcccttttcaaggacccgagcaagctctcagcgtacagggaccgccgattcaagggcacacaggaggagtatgaggcaacgctgcatgcgtcgacaacgctgtacattgggaatatgtccttctacaccacggaggagcaggcctacgagctcttctcccgcgctggcgagatcaagaagatcatcatggggctcgacaagaactctaagaccccatgcggtttctgcttcgtactgtactactccagggaggatgctgaagatgctgtcaaatacatcagtggaacgatgcttgacgatcgtccaatccgtgttgatttcgattggggctttgaagaaggcaggcaatggggccgtggacgaagtggtggacaagtgagagatgagtaccgtacagattatgatcctggtagaggtggttacggtaagatggttcagagggaactagaagcacaaagagaactagttgactatggtggatctttccaaccaaatgcaccacctccctatgagagaggtgagcggaagagaggatacggggactctcataggaatgccagaggagattaccagcggaaacgctaccggagcagcgatgaccggtcagcaccagaggagtccaagagagcgcctgactctgatccagcggataagaatcctagatttcgcgagaaaggtgactctgatgaagaagatgatgactacgacaagagacgtcgtcgctaaagctgtgtggaacagtcgttgctacatgcagctgttctggtgtccagtcgctgcagaagagtccacagcgagcagcagtatccggatttcgccctgctgtgcctgtactgttcctccttttcgggctagtttggagccacaaaagtagagcagattggagggcccaaaatacacttattcaaaatttg

SEQ ID NO: 250 - DNA, 3235 bp, Saccharomyces cerevisiae
ctgttgctaagattggttttgcctggaaagcacattggtttttaggcctcttatccttcatttggaaactttttgtcctatgatttgtttttttcattttatttttcattttatttttcattttattttcatttagttaacattattatgcagttatttttttttttcccaccttcatggcctcgtttatgtcttttatcaatatattttttacgtttataagtcatttactcgactttttttacctttgatatgcaatcatattattcttccctccattatggctaaataaatgataattataatctatagttttcaagcgttcatattttgacagataagattatgcaacaacttggaagggcggaaggaagcaaaaagaaaactccgatacggggagtcgaaccccggtctccacggtgaaagcgtgatgtgatagccgttacactatatcggacaataattggacagaaaattttgttaaagtgtcagcctaatcggcgtaatacgtatatatgtatattatctgcatattattacgataatatacaacaaaacggattaaaacaatcggtatatttcaatttgatatttgggataaggtaaaataaaaaccgaagatcagtaagctcttgttacttttttgttggaatagaggatcaagaagcatttattgctagtatccaaattattagtatatcatcatgttttcaaaaaaaaatgatgtaaaaattgagaaacagtcaccagtcatcatgaaaagtgcactgcaaggattaataacgtaataaaacaagaacgacagtacataaacgaaagaagagataactatattattgtatagaattatcgattctcttttagaattcttttattctccaggaaaactacttgtacattctgtttagctaatattgtagcctttaaccacaataaaatgcactccaagtataacccaaaattcattgttttcaaatttatattaatgagatattggtaacctaaacatcaaaaatatttttactcaaattctcttttctgaaaacgctgaaggaaatgtgcaggaaaaatgtttggccatcaacttttattcctagtaccacaactaacgtcacattctatcgaggcaaatgctaattggcaactaacactatcttaacggtttgataatgtcaacacaaaattcacctattattacaaacgaatctaccggaagttgaaatgcctgacaataatcatacaattgcatgaataattgcgaacagatggcagcaaaggatgaactaatcataattatacattgccgctgtaggtttcctcccataaaaatccaaatttccaagaaaaagttcttgtgtcttcatacacttaatattgttatccttcttcaagaccggactatataaagaaaaaattttgtaatgctattatatttcaacttcaaattattttctactagtagacataatggaacttcgctctcagataatctatggcgatagatggacaattgacaatcttctgaaagaatttatataataagatgtgaccatgacctaaacctgctcacgctcatgaaaggatacaggtaatttggcgaaacattcccaagcttcgctgatagacctatcccagaaagtgtctgtttaaaactacaagtatttgcagttttcgttatccagtttcgttcaagagcattaatgcacaagccacttatattatataaatttaaactttgggaaaatatcatacacctattgtaccagtaaatgttggaataaaaatcaactatcatctactaactagtatttacgttactagtatattatcatatacggtgttagaagatgacacaaatgatgagaaatagtcatctaaattagtggaagctgaaacgcaaggattgataatgtaataggatcaatgaatattaacatataaaatgatgataataatatttatagaattgtgtagaattgcagattccctttcatggattcctaaatccttgaggagaacttctagtatatctatatacctaatattatagccttaatcacaatggaatcccaacaattacatcaaaatccacattgtctacagtaaaagtataccactaatagatttgtaattggtgtatgaagtagtgtatggtataaacgttaataagtgcttatcaaagtattacccgctttaacagtttttgtgtttttttcaagaaaaatattatatgtatgaatatagaacatgagtttatatggagaaagtgtctcgacagcttttaaagtcccgaaaggactaatatcgaataaaagttgcatccattaatataccaataaataaagggaaagatgtccctggaagaatttgacgaagttaaatatgatcattcaactaaacgcctagatacaccatcaaggtacctgctgcgcaaggctagaagaaaccctaacgggctacaagaactgcgtgagtcgatgaagtcatccacaatttatgtaggaaatctttccttttatacatcagaagaacaaatttacgaattattcagtaaatgtggcacaataaaaagaataattatgggtttggaccgttttaagttcacgccatgtggcttctgttttattatatatagttgtccagatgaagcattgaatgccttaaaatatttgtccgatacaaagttagacgaaaagacaattaccattgatctagatcctggttttgaagatggaagacagtttggtcgtggtaagagcggtggtcaagtcagcgatgaattgaggttcgattttgatgcatccagaggtggcttcgccattccatttgcagagcgtgtcggcgtaccacattccagatttgataacagtagctcacaatctaatacgaataattatatccctcctcctgatgcaatgggtactttcagaccaggtttcgatgaagaaagagaagatgataactacgtacctcagtagaatcaatcaatttatatctgagaaagattctacacacagatatatatatatatatatatattattgtatatatacatacctacattatttttaaaggcttgcatgatgctgttatgtaaaaaaaaaaaaaaaaaatcagtgtaacataatagacgtaacacgttcaatgacatgataatactatatatagtaacgataaaatgtaaatggtaatagatataattatatgaatatttaagtaatgcattgataagtga

SEQ ID NO: 251 - DNA, 3801 bp, Oryza sativa
ctgcagagtgtgatacaagtatagcaacaagctaagatggtactgttgaattcagaagaagtctcttgcaatgatcatcatcaggtagatgttgttgcagcagccgggctgcagtgcagtggtgacatgctgggagacaagcagcttgtaagccaagtgatattggaaggtttggagattgaagagcctcctgcagatgagatggaggctgcagagaagaaggcagggatatctaggttaatggctggctatgtgcagcacctccaacataggtctgcctaccatctcggtatggtaatttaattatccacagctattaattcacatattgtatatatcgatcaataatacatataaatgtatagcttatagattcagcatcatacagaatcttttctctgcatatatgccataataaatagtacatgtgtaggccaatatgcattgggttattaataggaacatggcagattggcctacatatatactgattaatctttttagcaagtcaaattggagttggattataataattaatataactgaaggacttaagcagttatatatatgcatggtcaattgcaactatttcttatgccttgagtttggatatatgttccatatatatacatattacattttattaatatttgcattaagatggataaagtggtttggttgtgtgcttattgatagaggccggagatgcgaactatttctattatctaaaaaaaatatactggctattctgttgatttatttttctagttatatctttaggtaactagtgtttacataattgattagtgttataaaaaagagagttgtggaagtttgttctagtttctcctcttttgagatctttaagccacatccaatcaattttgttatatagcagatgttttaaaatgaaatattatatattcattaaactaggtaataaagtttttgttgtgctattctttgtttcagtaaatatgtattgattaattcacttgtatttttaggttatccactcaactttgactacgactttagccccctcgcaccttttctgaacttttccctcaataatgctggtgatccatttgctaaggtcaacaacagtgttcactcaagacaatttgaagttgcagtattgaattggtttgctaatttttgggatgtacaaagagaccaattctggggatacatcactagtggtggaacggaagggaacttatatgggctattggttgggttagtacttcttcaatatatattgtgggcaagctttctctcaaatttcattacatttcttaccacttgaaggtataaataatctaatatatgtttttcaaaaaattacatctatcgtatatatatatgtgaacccccattttacatggactgattggtgtgctacctgatttttcgtttcaaaaaaaataaaacaagttgaatccttattactttatcactacagaacagatttaatcccagatgctccagcagaatcaattaaattagtggccaattactaaaactttcattaatttagtctatctttacttcttttgtgttggcttgtttgcaaactaacggttgcattgtactacaggagagagctttttcccgatgggatcttgtatgcttcaaatgattcacattactctgtcttcaaggcagctaaaatgtatagagttaagtgcatcaggattgccactacagtttctggagagatgaattatgcagacttaaaatctaagctacaacataacaccaacagcccagcaattataaatgccaatattggttagatttcaaatccagtgatattcacttgtctaattttatttgtttttaccaatctttccatgttctagtaacactaatattgactgattatgccctgattttttgggtgatctataggtactacctttaaaggagctgtagatgatatcgaccagataataagtacacttgaaaaatgtggatttcaaaatcgttactacattcattgtgacagcgctctctctggaatgatgacgccctttatgaaacaagtaggttccatttttctttttgtgtgtgcttagatgattaacaatatagtgaactgcactcaaataattatgtttttatttgattgacaaaatactatcaacaaccatgatttttccaataaaactcactataccatctcaaaacagacccttactatatatacagcacaaaacaaccactattgcacaagggcaataaagtattacaatacgttgtatatattttgtatttgagtactaattatgcccatgtcgcaaaaatatttatgtgaagatatcttttgattgagatttagttaaagaactatcattatgtgataatatgtttcgttttcttattaaatcaactaaactaatggttcatttcgcttaggccccaaaggtgtcattcaaaaaaccaattggctctatcagcgtgtcagggcacaaattcttgggttgtccaatgccatgtggtgtagtcatcaccaggttggaacatgccgaagtcctgtcaacagatattgagtacatagcttctagggattccactatcactggaagccgaaatggtcatgctccaatcttcctctggtatacattaagcaaaaaagggtacaaaggacttctgaaagaagtacacatatgtatgggaaatgcacgatacctcgaggtattattgaaacaagttggtataagcgcatcttgcaatacattaagcaacatagtggtgtttgaaaggccaaaggatgaaagaattgtgtgtaggtggcaacttgcttgtgagggaaatttagcacatattgttgtgatgccaaatgtcacttttgaaaagctcacagtttttgttgaagagcttgctgagaagagaaaagattggtatcaggacaagggattcgatattccatgccttgcggttgacattggcaaggaaaattgttattgcaacctgcacgcaaaaaagttaagaattcctaaaatgtgactgtagaagtgttgcaagttacatattctttgtaacttggttgttttttttttacaagtgtaaccttatgataaacattacaaatgtagcttgttcttctttttttatggaaataacttgttattcctttcctcaaagcattaagaaaaaaatcattcttaggaaatatctttcttatttatcaccaacacaacacatcacactgcaggatatttaataaagaggattatatatattaaatgagtttctttaagctttacaaacttctatccaacaatacatgtttgaatattgtcatctataaataaaaaaaaagaaatacactcctgtgcatattcttgtttcttcattacattattgtaacgatatcactcattataggtgcataactcagctttatattataaattgaggagataggaatagcacagctaggggcatcggatcatggtcctacctccgatcggagcactttggtgctagggctccatcctatcactatcaatgtgatcacaactcctttcacctagccacccagtggtggatctagaaaactgcagatatgtcaatatcataacgtacttaccgatgtcttaatgtgatagccatacttaaaccagggtgctattttctatgtgtaggtatgctgtttaattggtcatagattttgcctaagtcattgtgggggcacttgacactgaccttgtactgtagctccactcctacaaccacctctgccatggaaacaactagaggaggtggcagtggtttcttataattaagtttgcc

SEQ ID NO: 252 - DNA, 1569 bp, Zea mays
ccgccgcggagacgctcccgatggagctggatccgtcggaggccttagttgccgctgcggtggaggcgaagggcgaggaggctgccaacgggaggagggagttcgtgatggggaggaacgtacacacctcctgcttcgccgtgaaggagcccgacgcggacgacgaggaaaccggcgagcgggaggcaaccatggctagcgttctcgcgctctaccgccgctcgctcgtcgaacgcaccaagcaccacctcggttacccatacaatctggactttgattatggtgcactgacccagctgcagcacttctcaattaacaaccttggtgatcccttcatcgagagcaactatggtgtccattcccggcagtttgaggttggagtgctggattggtttgctcgcctctgggagttagaaaaggacgagtactggggatatattactaactgtggtacagaaggaaatctgcatgggattcttgttgggagggaggtgttccctgatggaatattgtatgcttctcgtgagtcccattattcagtattcaaagcagcaagaatgtacagaatggattgtgtcaaagttgacacccttatgtctggggaaatagattgtgctgatttccagagaaagttattgcagaaccgagacaaacctgccatcattaatgttaacattggaacaactgtgaagggggcagttgatgatctagacttggttatcaaaacccttgaggaaaacggctttaaagatcggttttatattcattgtgatggtgccctttttggattgatgataccatttgttaagaaggcacctcaagtgacatttaaaaagcctattgggagtgtcagcgtctctgggcacaagtttgtcggatgccccatgccatgtggtgtccagataacaaggttggagcacataaatgccctttctagcaatgtggagtatctggcgtcaagggatgcaacaatcatgggaagcaggaatggtcatgcccctatcttcctctggtacaccctcaacaggaagggctacagaggcttccagaaagaagtccaaaagtgcttgagaaacgcgcactacctaaaagatcgcctcaaggaagcaggaatcggagcgatgcttaacgagctcagtagcacggtcgtgtttgaaaggccaaaggatgaagaatttgtccgaaggtggcagctggcttgtgaagggaatattgctcacgttgtggtgatgcccagtgtcaacattgacaagctagactatttcctgaatgagttagttgagaaacgagcgacttggtaccaggatgggataagccagccaccctgcattgccagagacgtaggtgttgagaactgtctctgtggccttcacaagtagcgagccttttgctttgcaagtgggttcattcttgagtcgagttaaaagtgttatgttgtactgtgttcattcttgagttgagttaaaaagtgttatgttgtactgtgtccatgcgttctgcttctgtgttgtccacagtgtagcttatttgttgccatgggaataaaattccttctattaaattgaaaaa

SEQ ID NO: 253 - DNA, 1668 bp, Glycine max
cgctttattgcatctcagaggccaattctttcgccgcttcttctctctttccaacgcttccccctgtggtgttctcgtgttgctggtaacaatatggttgttgacgctttgaatgaggatttgagaatcaacggagcagttgaaccgttgcctgaggactttgatgcaacagctgtaatcatagatcccgtgcctttggcagttgtagacaatggcattgtcaaggaggaggcgcagatcattaaaggaaaagagaaaagagaaatagtactgggaagaaatattcatacctcgtgtctagaagtcacagagcccgaggcagatgatgaggtcactggggaccgggaagctcatatggcaagtgtgttggccagatacaaaagagctttgactgaaaggacaaagcatcatttagggtacccctataatttggatttcgattatggtgcgctcacgcaacttcagcacttttccataaacaaccttggagatccatttattgaaagcaactatggtgtccactcccggcagtttgaagttggtgttttggattggtttgcccgattgtgggaactggagaaaaatgagtactggggctatataacaaactgtggtacagaaggcaatctccatggcatcctagttgggagagaggtctttccagatgggattttgtatgcttcacgggagtcacattattctgtgtttaaagctgctcgaatgtacagaatggaatgtgagaaggttgatactctttggtctggggaaattgattgtgatgatttcaaggccaagcttcttagtcaccaggataagccagcaattataaatgtgaacataggtacaactgtgaaaggggctgtggatgatcttgatctggtcataaaaaaacttgaagaagctggattttcgcatgacagattctacatccattgtgatggggctttgtttggtctcatgatgcctttcgtgaaacgagctccaaaagttacttttaagaagcctgttggcagtgttagtgtttctggccacaaatttgtagggtgtcccatgccttgtggtgtgcagataacaagattggaatatgtaaatgctcttgccagggatgtggaataccttgcttctagggatgccacaatcatgggtagtcggaatggccatgctcccatattcctctggtataccttgaatcggaaaggatatagaggttttcagaaagaagtacagaaatgcttgcgaaatgcacactacttcaaaggccgccttgttgaggctgggattggtgcaatgcttaatgaactgagcagcacggttgtgtttgagaggccacatgatgaggaatttatacgcaagtggcagttagcatgcaaggggaatatcgcacatgtggtggtgatgccaaacatcactattgagaagcttgatgattttctgaacgagcttctggagaagcgtgctacctggtttcaagatggcaaggatcaaccctactgtatatcatcagacgtaggtgaaaagaattgcctttgtgctttgcacaagtaattgcagcatcccatctagtgtttattgctgtagttggtttttggagtgtttatccagtgtacgtcactatgttctatcaggactttgatgcaattaataacatttagaatcttctttgctgtc

SEQ ID NO: 254 - DNA, 1719 bp, Saccharomyces cerevisiae
atgctatcaaaatcagaaaaaaatgtcgactacatggcaggcaatatgagcaatttgagtttcgatgggcatgggactcctgggggcactggactatttcctaaccaaaatataacaaagaggaggacaaggcctgcgggtatcaatgattcaccttcgccggtaaaaccatccttttttccttacgaagatacttccaacatggacatagacgaagtatctcaacctgatatggatgtctcgaactctcccaagaagcttccaccaaagttttacgaaagagcaacttcaaataaaacacagagagttgttagtgtttgcaaaatgtactttctagaatattactgtgatatgtttgactatgtaattagtagaagacaacgcacgaagcaagttctagaatatctgcaacagcaaagccaacttccgaattctgaccagattaaactcaacgaagagtggtcctcttacttacaaagggaacatcaggttttgagaaaaagaaggttgaaaccaaaaaatagggattttgaaatgatcacacaagtaggtcaaggtggttatgggcaagtttatttagccagaaagaaagacacaaaagaggtgtgcgctttgaaaattttaaacaaaaaactattgtttaagctcaacgagacaaaacacgttttaactgaaagagatatcctaaccacgacaaggtctgaatggttagtaaaacttctgtatgcattccaagaactacaaagtttatacctggctatggaatttgtaccaggcggtgattttcgtacattattaataaatactagatgcttgaaaagtggccatgcgagattttacatcagtgaaatgttttgcgctgttaatgcgttacatgatttaggctatacacatagagatttaaagccggaaaacttcttaatcgatgccaagggacatataaaattaacagattttggtttggctgctggtacgatttctaatgaaagaattgaaagtatgaagataaggttagaaaaaatcaaggacctggaatttccagcgtttacagagaaatctatagaagatagaagaaaaatgtacaaccagttgagggagaaggaaattaattatgcgaactccatggttgggtctccggattatatggctttggaggttttagaaggaaagaaatatgactttactgtggattactggtcgttgggttgtatgctgttcgaaagtttagttggttatacaccatttagtggatcatcgactaatgagacctatgacaacttaaggcgctggaaacaaactttaagaagaccgagacaatctgatgggagggcagcattctccgatagaacttgggatttaataacaagattgattgccgatccaatcaatcgattaagatccttcgaacatgttaaacgcatgtcttattttgcagatataaactttagtactttgaggtcaatgatcccgccttttacaccccaactagacagcgaaactgatgccggttattttgatgacttcaccagtgaggctgacatggccaaatatgccgatgttttcaaaagacaagacaaattaacggctatggtagatgactcggcagtatcatcaaaacttgttgggttcactttccgacatagaaatggtaaacagggttccagtggcatcttattcaacgggctggaacactcagaccccttctcaaccttttactag

SEQ ID NO: 255 - DNA, 1695 bp, Saccharomyces cerevisiae
atgttttcacgaagtgatcgagaggtagatgatttggctggtaatatgagtcatttagggttctatgatttgaatattcctaaacctacttctccacaggcgcaatataggcctgctagaaagagcgaaaatggaagattaactcccggacttccaagatcatataagccgtgtgattcagatgatcaagataccttcaaaaatcgcatttcattgaatcactcaccgaagaagctacccaaggattttcacgagcgtgcttcccaaagtaaaacccagagagttgttaatgtatgccaactttactttctcgactattactgtgacatgtttgattatgttattagcagaagacaacgtacgaagcaggtgctaagatatcttgaacagcaaagaagtgtcaaaaacgtttctaataaggttttaaatgaagaatgggctttgtatttgcaaagagaacacgaagtactgagaaaaaggaggttgaaacctaagcacaaggattttcagatactgacacaagttggacagggtggttatgggcaagtttatcttgcaaaaaaaaaagacagtgatgaaatttgtgctttgaaaatattaaacaagaaacttttattcaaactaaacgagacgaatcacgtccttactgagagggacatactaaccacaactagatctgactggcttgtgaagttgctttatgcatttcaggatccagagagcctatatttagcaatggaatttgtacctggtggtgattttcgcacattgttaataaatacaaggatattgaagagcggtcacgcaaggttctatatcagcgaaatgttttgtgccgtgaacgcgttgcatgaacttggttacactcaccgggatttaaagccggagaatttcttgattgatgctacagggcatatcaagctgaccgattttggtctagcagcagggaccgtatcaaatgaaagaatcgaaagcatgaaaatacgcttagaagaagtaaagaatttgcaatttcctgctttcacagaaaggtctatcgaggatagaagcaaaatatatcataacatgaggaagacagaaattaattacgctaactctatggtcggttcgcctgattatatggccctagaagttctggaaggtaaaaaatacgattttacagtggattattggtcattaggctgtatgctttttgaaagtttggttggatatacaccttttagtggttcttctactaatgaaacttacgagaatttaagatattggaaaaaaactttaagaaggccccgtactgaggatagaagagcagcattctcagatagaacctgggatttaattacaagactaatagctgaccccatcaacagagtacgatcttttgagcaagttcgcaaaatgtcttatttcgcagagatcaattttgaaaccctaagaacaagttctccaccatttattcctcaattagatgatgaaacggatgcaggttatttcgatgacttcacaaatgaagaagatatggctaaatatgcagatgtcttcaaaagacagaacaaattatctgcaatggtcgatgactctgccgttgattccaagcttgttggatttacttttaggcatagagatggaaaacaaggttcaagcgggatactttacaatggttcagaacattcagaccctttttcaactttttattaa

SEQ ID NO: 256 - DNA, 729 bp, Arabidopsis thaliana
atgggaagaggtagggttcagctgaagaggatagagaacaagatcaataggcaagttactttctcaaagagaaggtctggtttgctcaagaaagctcatgagatctctgttctctgcgatgctgaggttgctctcatcgtcttctcttccaaaggcaaactcttcgaatattccaccgactcttgcatggagaggatacttgaacgctatgatcgctatttatattcagacaaacaacttgttggccgagacgtttcacaaagtgaaaattgggttctagaacatgctaagctcaaggcaagagttgaggtacttgagaagaacaaaaggaattttatgggggaagatcttgattcgttgagcttgaaggagctccaaagcttggagcatcagctcgatgcagctatcaagagcattaggtcaagaaagaaccaagctatgttcgaatccatatctgcgctccagaagaaggataaagccttgcaagatcacaacaattcgcttctcaaaaagattaaggagagggagaagaaaacgggtcagcaagaaggacaattagtccaatgctccaactcttcttcagttcttctgcctcaatactgcgtaacctcctccagagatggctttgtggagagagttgggggagagaacggtggtgcatcgtcgttgacggaaccaaactctctgcttccggcttggatgttacgtcctaccactacgaacgagtag

SEQ ID NO: 257 - DNA, 756 bp, Zea mays
atggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaa

SEQ ID NO: 258 - DNA, 1755 bp, Zea mays
ggcagaggtgcgcttccccgtgagccgggcaactggtgggtgtcgtcctcctctttgcgcagcagagtaatggattaatgctttaagcaaggtaatgaaatgtaccagaagtgacttatggaaaggaaggagcttgttcactgttctgaatgaggaagtttaatctgatgcagtctcaaaagagcagagttttgggagcaatgtcatcctctttgcctattctgccaaatcctttgaaagggagcttcccaaggcctcataacccccagcatattcctatgttgaggcagcttcctgatgactctatgcccttgtgtattgacacacatcagtctgttagtttgcacccaagagctggtgttatcggggtaccatattcaggctacactgctagtccacttgattctgtgtctaaccttgatagccagacaatggctgcaccctttatttctcagtcatccaattttgaagctctccagtctctatctgataataccccagaaacacacactaaggcagcctggttcacatcttctatggatgtttcaccactcaacacagataatattgctgcttctgatgttaatcaaatccatagtatacgtcctgctatgacatctgatgagagtgctacacaaaatgattggtgggcagatataatgaatgatgattggaaagatattcttgacgcaacagctactgattcccactcaaaagccatgattcaaatttccaactcagctacatcactacctgcagtaaatcagtcagcttcatctcatagtagggagatttgtcctgttgctagtcctcccaatagcagcaatgcttcagttgccaaacaacggatgagatggaccccagaactccatgaatgttttgtagatgctgtaaatcagcttggcggtagcgaaaaagctactcctaagggtgtgctaaagcttatgaaagttgatggtttgactatatatcatgtcaaaagccacctgcagaagtaccgcacagcccgctataaaccagacctgtcagaaggtacatcggaaaaaaggacagccactgaagagctggtcctggacctgaaaacgagcatggatcttactgaagcgctgcgccttcagatggaagtccagaaacggcttcatgaacagcttgagattcagagaaaattgcagttgcggattgaagagcaaggaaagtatctgcagatgatgtttgaaaagcagagtcaatcgagcacggagaaagtccaggatccatcctcaagggatacaacagctaaaccgtcatctaatcagagccagtctacaaacaaggatagtggtgcaaccatggacccaaatggaacaggagacatcgcacggactgcagaactgggagaacgttcgtctgaactaggtgtaaaacagaaactcgtagagatcgaatctggtaccgaagtagccacaggcgacagatctaagatctaccaagagaagcggcgcaaactgcaagatagttaacatatcggttgcactattcagacatagctgttcaaaccgtttgcttggtgaaaaattggtaatctgtgtgtcgaattcgactattgatccgtaagtccattggtgagttgtaccgctcttcagttagccatatatatttataaaggatccaaaggaggaccaaaggagaacttcctggcagccgtgtttataacattagcaataagagctatccccgaagttatggggtaaaataaggtcttgaaatttagctttc

SEQ ID NO: 259 - DNA, 1929 bp, Zea mays
ccacgcgtccggccacgcgctgcccgcagcggaggtgagacacaataatcttagatggagaggttaagcaccaaccagctctacagttctggtgttcctgtaaccgtaccaacatctctgccttgtataccagtctctctggatgagagcttcccgaggcttcccgatgcacagagtgttttgatggagagagaattgaggagcactccactaccacctcaccagacaactgttgctcctatccgtggtctgtttcactccaatactggatctgttggtcctttgtgctcacctccgtctgtaaggttctcttcacattcaaatcctgagcaataccccaaccacaattcatacaattctcaagtaccaagcactgcaagttcctcaacgctgaattatgggtcacaatatggaggctttgaaccatccataaccgatttcccaagagacattgaaccaacttggtgccccgatccagttgagagcattcttggatactctggtgatgtccctgctgggaataatttgactgggaccactgctattggagcttcagatgatcttactaagcaaactgaatggtggacagagtttatgaatgaggattggaaggacatggttgataacccgacttccacagaaactcaaccggttgggcaacctgtgcaatcatccaactcagttcaccaatcagctacccaacaaacagtttcatctcaatctgttgaaccgttggcagttgtggcaccctcacccactgctggctccaatactggcaaggcacgcatgagatggactcctgagcttcacgagcgctttgtggatgctgtcaatatacttggtggcagtgaaacaactcctaagggtgtcctgaagctaatgaaggcagacaatttgaccatttatcatgtaaaaagtcatcttcagaaatacagaacagctagatacagaccagagttatctgaaggctcttctgaaaagaaagtggcatcaaaagaagatataccatctattgacttgaaagggagttttgatctcactgaagcacttaggcttcagttggaacttcaaaagcggcttcatgaacagcttgagatacaaagaagtttgcagctaagaatcgaggaacaagggaagtgtcttcagatgatgctagagcagcagtgcatacccggggcagaaaaggcgcaggatgcttcaaccgctgcagatgaattgaggtcaccttctgagattccagaatcttctaccctcaaggaagttccagaaaacagtcaaaatggatcaaccaagcaaacaaaataagctaagggccgatgaagttgcaagcatgaaatgtgtttcatgatccgattggctgtttccaggcttaaatcaagttgtttttgtccttccgtgggaacagatgaacgctatagttaacttccttgcaaagcctggctaggtgcatgtaactaggagttagttgtatattacctaccctcacggtatcactgaatcccagtgttatgcggatgatgtagtcttcagaagacagcgcaagcacattgtcaggggtttgacttgttttgccccccattacttaggtatcaagtagcgtctcctaggcatttgattatgggctaattcaagtgtttacaataatgtttagcacctgttgtttaaaacatgtcatggtaccaaatatgacgaagatgtattgcatttatatgagagaatgagagatttgaactgctttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaagggatccaattttacttccccgggtttgcaaggtaaaagtttttttttggggcccccaaatttaaattaa

SEQ ID NO: 260 - DNA, 1101 bp, Nitrosomonas europaea
gggagaggatatttagctctttttttcatacgctcgttatggttgccaaaccagtataattgacgcttttttaatttctcgagaggaaagctgatgcataccggtactacccttacccagttcatcattgaagagcagcgtcacatcgcgggagcgagcggtgatttcaccgcattgctgaacgatatcgtgactgctatcaagaccatttccaatgcggtgaacaagggggcgctgattggtgtgatgggggcgctggatacagaaaacgttcagggtgaaacccaaaaaaagctggatgtgattaccaatgaaatcatgatccgcaacaatgaatgggctggtcatctttctggcatggcatcggaggaaatggatgatgtctactcgattccgtctccttatccactcggcaaatatctgctggtatttgacccgctggatggttccagtaacgtggatctcaatatttccgtcgggacgattttttcgattttgcgctcgccagtgccaagccgggctgccagtatggaagatttcctgcaacccggcgtcaaacaggtttgtgcaggttatgcattgtatggttcatccaccatgttggtgctgaccacaggccatggtgtcaatggttttacgctggatcgtgatatcggtgaattcgtgctgacacatccaaacatgaggattcccgccgataccagggaatttgccatcaatgcctccaaccagcgtttctgggaagcaccggtacagcgttatgtggcggagtgtctggcaggaagtaccgggccgcgcggtcgcgatttcaatatgcgttgggtggcttcgatggtggcagaggtgcatcgtatcctcactcgcggtggtattttcatgtatccgcgcgataccaaagatccctccaaacccggcagactgcgtctgatgtacgaagccaatccgatgagttttatcgtcgaacaggcaggcgggttatccaccaccggctacgagcgcattctggatgtcgtgccgcaggatctgcatcagcgtgtaccggtgattctgggctcgaagaacgaggtcgaggtggttctggagtatcacaatgcctgatgc

SEQ ID NO: 261 - DNA, 2000 bp, Oryza sativa
aactcagtgcagtagtagtagcatgcaaaggatttgccctgctcactgctcggtcactcactcactcaccatgaagtccatgaggctttcctacatccctcctgctgcttctgctgctccacagagccccagctatggcaggaagaagaacgcctccgccgctccgccatcggctgccgcctccaccaccgttctcacctccccgctggtgaccaccacccgcactccgaagcagaccgagcaagaggacgagcagttggtagccaagaccaagactacgagaactgttattgctacgacgaatggcagggcggcgccgagccagtctcggcctcgccgccggcctgcccccgccgccgcggcgtcggccgcttcgctgccgatgacgttctgcaacgcgctggaggaggtgatcaacacgttcatcgacccgccggcgcttcggccggcggtggacccgcggaacgtgctgaccagcaacttcgtgcccgtggacgagctgccgccgacgccctgccccgtcgtgcgcggcgccatcccgcgctgcctcgccggcggcgcctacatccgcaacgggcccaacccgcagcacctcccgcgcgggccgcaccacctgttcgacggcgacggcatgctgcactccctcctcctcccgtcgcccgcgtcgtccggcgacgaccccgtcctgtgctcgcgctacgtgcagacgtacaagtacctcgtggagcgcgacgccggcgcgcccgtcctgcccaacgtcttctccggcttccacggcgtggccgggatggcgcgcggcgccgtcgtggcggccagggtcctgaccgggcagatgaatccgttggagggcgtcgggctcgccaacaccagcctcgcctacttcgccggccgcctctacgcgctcggcgagtccgacctcccctacgccgtgcgcgtccacccggacaccggcgaggtgaccacgcacggcaggtgcgacttcggcggccgcctcgtcatgggcatgaccgcgcaccccaagaaggaccccgtcaccggcgagctcttcgcgttccgctacggccccgtgccgccgttcgtgacgtacttccggttcgacccggccggcaacaagggcgccgacgtgcccatcttctccgtgcagcagccgtcgttcctgcacgacttcgccatcaccgagcggtacgccatcttcccggagatccagatcgtgatgaagcccatggacatggtggtgggcggcggctcgcccgtggggtcggaccccggcaaggtgccccgcctcggcgtgatcccgcgctacgccaccgacgagtcggagatgcggtggttcgaggtgccgggcttcaacatcatgcactcggtgaacgcgtgggaggaggccggcggcgaggagctggtgctggtggcgcccaacgtcctctccatcgagcacgccctggagcacatggagctagtgcactcctgcgtcgagaaggtgcgcatcaacctccgcaccggcgtcgtcacgcgcaccccgctcgccgccgggaacttcgacttccccgtgatcaacccggctttcctcggccgccgcaacaggtacggctacttcggcgtcggcgaccccgcgcccaagatcggcggcgtggccaagctcgacttcgaccgcgccggcgagggcgactgcaccgtggcgcagcgcgacttcgggcccgggtgcttcgccggcgaaccgttcttcgtggccgacgacgtcgagggcaacggcaacgaggatgacgggtacttggtgtgctacgtccacgacgaggccaccggcgagaaccggttcgtggtgatggacgcgcggtcgccggacctggagatcgtcgcggaggtgcagctgcccggacgcgtcccctacggcttccatggcctgttcgtcacgcaggccgagctccagtcacagcaccaatgatacaaaccaacgtagcaatgtatagaattcacgtatacattttccatacgaaattacgagt

SEQ ID NO: 262 - DNA, 2100 bp, Oryza sativa
tcgcagtttacaggcggaatctgtaatttgttttgttattagtctacgtttaatacttcaagtgtgtgtccgtatatctgatgtgacacgctaaaattttacatctctgaatctaaacacagccttactctggcgatctatatatagttgcatacattgtaatattattgctgaattcatattcccatctgagccaaccatgcattggtgttttgcataatggaggtacccattgctgccatgacttttgcccacccagccaatgttatgactctggcttcaaggcagccaaagagtaaaaggtcccatatctcccctgctaccacggctcaccgtaatctacagactcgcctggctcaccaccaccatgcaacaccagcttcattgcctatggcaatctgcaacacagtagacaaagtgatcaataggttcattgacctgccggagcagcgaccaacggtggatccgcggcgtgtgctctctggcaacttcgctcctgttgatgagctgcccccgacaagctgccatgtcatccgcggctccatcccaagctgcctcgccggtggggtctacatccgcaatggtcccaacccacagcaccggcttccccagcgaacacaccacctcttcgatggtgatggcatgctccactcccttctcattccctcggcctcgtcaacactgttgtcggagcctgtgctttgttcacgctatgtgcacacgtacaagtatctcttggagcgtgagaccggaggaccggttttaccaaacttcttcgctggcttccatggagtggccggcttggctcgtgcagtggtcatgatcgcaagagtgcttgctggtcaaattaacctgaacaagggcttcgggctggccaacactagcatcactctttttgcagattgcctatatgcgctatgcgaatctgaccttccctactccatgcacatcaacccagccaacggagaagtcaccacacttggtcgatgtgactttggtggtgatctttcttttaggatgacagcacaccccaagaaggacccggtcaccatggagttgtttgcttttcgctacaatgtcttccaaccattcataacatacttctggttcgatcgagcaggcagcaaggtcgcagatgtgcccatcttgtccttgcagaaaccatcggtgatgcatgactttgcaataacagagagatatgcaatctttccagagtcacaactcatcgttaatcccatggacatggtcatgcgggggagctcgttggtaggattggaccgtaccatggtgccacggattggcgtgcttccaaggtacgccaaggatgagtcagacatgagatggtttgaggtgcctagatttaatatgttgcacacgacgaatggttgggaagaggctgatggagaggagattgtgctcgtggcacccaatatcctatctatcgaacacatgctaggaaacatggagctcatgcgagctcgtgtcgacatggtacgtatcaacctctgcaccggtgacgtgtcgtgcactgcactctcaccggagagccttgagttcggtgtcatccaccaaggttatgttggtcgcaaaaatcgctatggctactttggtgtaagtggtccgttgcccaagatcaaggggataagaaagcttgactttgatctcgtcggctctggtgattgcacggttggacgtcgtgactttggtctagggtgctttgctggggaaccattttttgttccagacaacatcgacgggtatggaaacgaggatagtggttatgtggtgtgctacacccatgaagaggacaccggagagagttggtttgtggtgatggatgcaaagtctccagagctagacattgttgcagaagtgcaacttcctagtcgtatcccctatggctttcatggtatttttgtcaaacaggccgaacttctcgcacaacaataagcatgtttgtgaaaaaccttacccactactctacgtataaagataatacttcataacttcataagcgagatctgctacaaatgtactttccagcatttgatttagaatggtcataagagaagtattatagtctggttgtcatttcacatc

SEQ ID NO: 263 - DNA, 1929 bp, Oryza sativa
atggccagcggcggcggcagcagcaactggttaggcttctcgctctccccgcacatgccggccatggaggtgccgtcctcctctgagccatcgactgctgctcatcatcatcatcatcatcatccacctgctgctgctgctgctgccggagccatgtcgtctcctcccgacagcgccacgacctgcaacttcctcttctcccctcctgcagcacagatggtcgctccttcacctggctactactacgtcggcggcgcctacggagacgggaccagcaccgccggcgtctactactcgcacctccctgtcatgcctatcaagtccgatggctccctctgcatcatggaaggcatgatgccgtcgtcatcgccaaagctcgaggacttcttggggtgtggcaatggcagtggccatgacccggccacctactatagccagggccaagaagcagaggatgcaagcagggcggcctaccagcaccaccagctagtcccctacaactaccagccattgacggaagcagagatgctgcaagaggccgcagcggcgccaatggaggacgcaatggcggcggccaagaacttcctcgtcaccagctacggcgcctgctacggcaaccaggagatgccgcagccgctcagcctctccatgagcccagggtcccagtccagcagctgcgtcagtgcagctccccagcagcatcagcagatggcggtggtcgctgcagctgctgctgctggtgatggccagggaagcaacagtaatgacggtggcgagcagcgtgtcgggaagaagaggggcaccgggaaagggggccaaaagcagcctgttcaccggaagtccattgacacgtttgggcagaggacatcgcagtataggggcgtcaccaggcacaggtggactggaagatatgaagcccacctctgggataacagttgcaaaaaggatggacagacaaggaagggaaggcaagtatatctaggtggttatgacactgaagataaagctgcgagggcttatgatctggctgcgctgaaatactgggggctatctacgcatataaatttcccgttagaaaactaccgagatgagatcgaggagatggaaaggatgacaaggcaagaatatgttgcgcacttgagaaggagaagcagcgggttctctcgcggtgcttccatctaccggggagtaacaaggcatcaccagcatggaagatggcaagctcggattggcagggttgctggcaacaaggacttgtatctcggcactttcagcactcaagaagaagcagcagaggcatacgacattgctgccatcaagttccgtggcctgaacgcggtgacgaactttgacatcacaaggtacgacgtggacaagatcatggagagcagctcgctgctgcctggtgaggcagcgcgtaaggtgaaggcgatcgaggcagcgccggaccatgtgccaataggccgcgagctcggtgcgaccgaggaagcgagcgctgctactgtcacgggcaccgactggagaatggtgctccatggatcacagcagcagcaagctgcagcgtgcaccgaagcaacggcagatcttcagaagggcttcatgggtgacgcgcactcggctctccacggcattgtcgggttcgacgtcgagtcggcggcagctgacgagatcgatgtcccgggagggaagatcagtggcatcaacttctcgaactcgtcttcgctggtgactagcctgagcaactcgagggaggggagccctgagaggcttggcctcgccatgctctacgccaagcatcatcccaccgccgtcagcctcgccgccatgaacccctggatgccgatgccggcgccggccgcagctcacgtgatgaggccgccgagtgccattgctcatctccctgtttttgcagcctggacagatgcttaa

SEQ ID NO: 264 - DNA, 1038 bp, Nostoc PCC7120
atggaaaatacacttggattagagattattgaggtagttgagcaagccgcgatcgcatccgcaaagtggatgggtaagggcgaaaagaatactgctgaccaagtagcagtagaagcaatgcgcgagcgcatgaataaaatttatatgcgcggtcgcatcgtaattggggaaggggaacgtgatgacgcgcccatgttgtatatcggggaagaagttggtatttgtacccaaccaaatgctgaccaattatgtaaccccgatgaattagtagaaattgatatcgctgttgacccctgcgaaggtacaaacctcgtagcttatggtcaacccggctcaatggcagttctggctatttccgagaaaggtggattattcgctgcgcctgacttctacatgaagaaattagccgcacctccagccgctaaaggcaaagtagacattaacaagtcagctacggaaaacctcaagattctttccgagtgtctagaccgttctattgacgaacttgtagtagtcgtcatgaaacgcgatcgccaccaaggtttaatcaaagaaatccgcgacgctggcgcaagagtacaactgatttctgatggtgatgtaggcgcagcaatatcttgtggttttgcggggactaacgttcatgcgctcatgggtattggtgctgcacctgaaggtgtcatttccgcagccgctatgcgtgctttgggcggacacttccaaggtcaattgatatacgatccagaagtagtgaaaacaggcttgattggggaaagcaaacaagcaaaccttgaccgtctcagctctatgggtatcaatgaccctgataaggtttacgatgctcatgaactagcatcaggtgaaaatgttctcttcgccggttgcggtatcacctctggtaatctcatgcaaggtgtacgcttcttccacggcggtgctagaactcaaagcttggttatttccagccagtcacaaactgctcgttttgtggacacaattcacatggctggacagcccaagactgtgcaactgcactag

SEQ ID NO: 265 - DNA, 1038 bp, Nostoc punctiforme PCC 73102
atggaaaatacacttgggttagagattattgaagtagtagagcaagccgcgatcgcatccgcaaagtggatgggtaaaggcgaaaaaaacatcgctgaccaagtagctgtggaagctatgcgggagcggatgaataaaatctatatgcgcggtcgcattgtgattggagaaggcgaacgtgacgatgcgcctatgttatacatcggggaagaagttggtatttgtactcaaccaaatgccgaagctctctgtaaccctgatgaattaattgaaattgatatcgccgttgacccctgtgaaggtacgaacttggtagcttatgggcaacctggttcgatggctgtcttggcaatttctgaaaagggtggattatttgctgctcctgacttttacatgaagaagttagcagcacctcccgcagctaagggcaaggtagacatcaacaagtcagcaacagaaaacctcaagattctctctgagtgtctagagcgctctattgaagaactcgtaatcgtggtcatgaagcgcgaacgccacaacgatttaattaaagaaatccgtgaggctggagcgagagtcgccctaatttcagatggtgacgtaggtgcagctataagctgcggttttgctggaactaatatccacgcgttgatgggtattggtgcggctcctgaaggcgtaatctcggcagcagcaatgcgtgctttgggtggacacttccaaggtcaactgatttacgatccagcaatagtaaaaacgggtctgattggagaaagcagagaagccaacatcgatcgcttaaagtctatgaatatcaatgaccctgataaggtctatgatgctcatgaattggcatctggtgaaactgttctgttcgctgctagcggcattacgagtggtaatctgatgaatggtgtacgtttcttcaacggcggagctagaactcaaagcttggtaatttccaaccagtcgaaaactgctcgatttgttgacacaattcacatgtttggtgaacccaagactctccaactgaactaa

SEQ ID NO: 266 - DNA, 1278 bp, Nostoc PCC7120
atgttccaaaataaaaaacatcggatcgcacttatttctgtttctggagatccagccgttgaaataggtcaagaagaagccggtggtcagaacgtatatgttcgagaagtaggctatgcactagccgaacaaggttggcaagttgatatgttcactcgccgtatcagtcccgaccaggccgagattgtccaacatagtcctaattgccgcactatccgcttacaagcggggccggttgaatttatcggacgtgatcacgtatttgattatttaccggaatttgttgccgaattccaacgcttccaaaagcgccaaggttataactatcaactcattcacacaaattactggttgtcatcttgggtgggaatgcaactgaaaaagcaacaacccttggtgttggtgcatacataccactcattaggagcaatcaaatatcaaacgatcgcagatatacccgccattgcgaatcagcgattagctatagaaaaagcttgtttagagagtgtagacacagtagttgccaccagcccccaagaacagcaacatatgcgcgccctggtttctaagaagggacgcatagagatgattccttgcgggactgacattaataacttcggaaacattgaaaagtcggctgcacgggaaaaactgggaattgagcctgatgccaagatggtattttatgtaggtcgttttgatccccgtaaaggcatagaaaccttagtcagagcggttgctcagtctaggttgagaggtgaagcaaacctccagttagtaattggtggtggtagccgtcctggtcaaagtgatggcagagagcgcgatcgcattgcgaatattgtggctgaactagaactgaacgattgcaccaccttcgctggtcgcctagatcatgaaatcctcccttactactacgctgcggctgatgtttgcgttgtccccagtcactacgaaccctttggtttagttgctattgaagcgatggctagcaaaactcccgtaatcgccagtaatgtaggtggattgcaatttacagtagttccagaagtcacaggtttacttgcacctccacaagatgagtcagcttttgctacagccatagaccgcatattagccaacccaacttggcgagatcagctaggcacagccgcccgccagcgagtggaaaccaccttcagctgggccggtgtagcatcccaattgagtcagctatacactcatctgttaactcaaaatgcgccagaaaagaaggaaaaagaggctgttgcagcgtag

SEQ ID NO: 267 - DNA, 1269 bp, Nostoc PCC7120
atgaactctaacactgaaaaacgcatagctttaatttcagttcacggagacccagcaatcgaaattggcaaagaagaagctggagggcaaaatgtttacgtgcgcgaagtgggtaaagcattagcccaactgggatggcaagtggatatgtttagccgcaaagtgagtcctgaacaagagttaattgttcaccatagcccactttgtcggacaattcggttaacagcagggccagaagaatttgtaccaagagataatggctttaaatatttaccagaatttgtacaacaactgcttcgattccaaaaagaaaacaacgttaattacccattagtgcatacaaactactggctttctagttgggtgggaatgcagttaaaagcaatccaaggaagcaaacaagttcatacttatcactctttaggagcagtcaagtacaaatctatagatacgattcctttggttgctactaaacgtttatcggtagaaaaacaagtattagaaacagcagaaagaatcgttgctaccagtcctcaagaacagcaacatatgcgatcgctagtttctactaaaggttacattgatatcgttccttgcggtacagatattcaccgctttggttcaattgctagacaagccgcaagagcagaattaggaattgatcaagaagcaaaagtggtcttgtatgtaggacgctttgatcaacgtaaaggcatagaaaccttagtacgtgccatgaatgagtctcaattgcgtgacacgaataaactcaaactaattattggtggtggtagtactcctggtaatagcgatggcagagagcgcgatcgcattgaggccattgtgcaagaattgggcatgacggaaatgactagtttcccaggccgcctcagccaagatgtcctccctgcttactacgctgcggctgatgtttgcgttgttcccagtcactatgaaccttttggattggtggcaattgaagcaatggcaagtggtacacctgtagtagccagcgatgttggtggacttcaatttacggtagtttccgagaaaaccggtttattggtaccaccaaaagatattgctgcgttcaacattgcaattgatagaattttgatgaatccacaatggcgggatgagttaggccttgctgcgaggaaacacgttacccacaaatttggttgggaaggagtagctagccaactggatggaatatacactcaattattgacacaacaggttaaagagccagcattggtaactaaatag

SEQ ID NO: 268 - DNA, 510 bp, Arabidopsis thaliana
atggctcaggaacaagcgactagctctttagctgcaagctctttaccatcaagcagcgagaggtcatcaagctctgctccacatttggagatcaaagaaggaattgaaagcgatgaggagatacggcgagtgccggagtttggaggagaagctgtcggaaaagaaacttccggtagagaatctggatcggcgaccggtcaggagcggacacaggcgactgtcggagaaagtcaaaggaagcgagggaggacaccggcggagaaagagaacaagcggctgaagaggttgttgaggaacagagtttcagctcagcaagcaagagagaggaaaaaggcttacttgagcgagttggaaaacagagtgaaagacttggagaacaaaaactctgaacttgaagagcgactctctactcttcagaacgagaaccagatgcttagacatattctgaagaacacaacagggaacaagagaggaggtggtggtggttctaatgctgatgcaagcctttag

SEQ ID NO: 269 - DNA, 954 bp, Arabidopsis thaliana
atggcggtggagctcatgactcggaattacatctccggcgtcggagctgatagcttcgccgttcaagaagcagctgcttcaggactcaaaagtatcgaaaatttcatcggtttaatgtctcgtgatagctttaactctgatcagccatcttcttcttccgcctccgcctccgcctccgccgccgcagatcttgaatcagctcgtaacacaacggcggacgcggctgtttcaaagtttaaaagagtcatatctctcttagatcgaactcgaaccggacacgcccggtttagacgtgctccggttcatgttatttctccggttcttttacaagaagaaccaaaaacgacgccgtttcagtctcctcttcctcctccgccgcaaatgatccgaaaaggttcgttttcttcatcgatgaaaacgattgatttctcatctctctcctctgtaacaacggaatcagacaaccagaagaagattcatcatcatcaacgtccctctgaaacggcgccgtttgcgtctcaaactcaaagcctctccacgacggtctcgtctttctcaaaatcaacaaagagaaaatgtaactctgagaatcttctcaccggaaaatgcgcttccgcttcttcctccggtcgttgtcattgctcgaagaaaagaaagataaaacagaggagaataattagggttccggcgataagtgcaaaaatgtccgatgtaccaccggacgattattcatggaggaaatacggacaaaaaccaattaaaggatctccacatccaagaggatattataagtgtagtagcgtaagaggttgtccagcacgtaaacatgttgagagagcagctgatgattcgtccatgttgattgttacttatgaaggagatcataatcattctctctccgccgctgatctcgccggagccgccgttgctgatcttattttggaatcgtcttag

SEQ ID NO: 270 - DNA, 513 bp, Arabidopsis thaliana
atggcgactcaagattctcaagggattaaactctttggcaaaactattgcatttaacactcgaacaataaaaaatgaagaagagacacacccgccggagcaagaagccacaatagccgttagatcatcatcatcatcggatctgacggccgagaagcgtccggataagatcatagcatgtccaagatgcaagagcatggagacaaagttctgttacttcaacaactacaacgttaatcagcctcgacacttttgtaaaggctgccaccgttactggaccgccggtggtgcactccggaacgttcccgtcggcgccggtcgtcggaagtccaaaccacctggtcgtgtcgtggttggtatgcttggagatggaaatggtgttcgccaagtcgagcttataaatggcttgctcgttgaggagtggcagcatgccgcagccgcagctcacggtagtttccggcatgattttcccatgaagcggctccggtgttactccgacggtcaatcgtgctag

SEQ ID NO: 271 - DNA, 813 bp, Arabidopsis thaliana; identical to SEQ ID NO: 22

SEQ ID NO: 272 - DNA, 1059 bp, Arabidopsis thaliana
atggtgcggacaccgtgttgcaaagctgaactagggttaaagaaaggagcttggactcccgaggaagatcagaagcttctctcttaccttaaccgccacggtgaaggtggatggcgaactctccccgaaaaagctggactcaagagatgcggcaaaagctgcagactgagatgggccaattatcttagacctgacatcaaaagaggagagttcactgaagacgaagaacgttcaatcatctctcttcacgcccttcacggcaacaaatggtctgctatagctcgtggactaccaggaagaaccgataacgagatcaagaactactggaacactcatatcaaaaaacgtttgatcaagaaaggtattgatccagttacacacaagggcataacctccggtaccgacaaatcagaaaacctcccggagaaacaaaatgttaatctgacaactagtgaccatgatcttgataatgacaaggcgaagaagaacaacaagaattttggattatcatcggctagtttcttgaacaaagtagctaataggttcggaaagagaatcaatcagagtgttctgtctgagattatcggaagtggaggcccacttgcttctactagtcacactactaatactacaactacaagtgtttccgttgactctgaatcagttaagtcaacgagttcttccttcgcaccaacctcgaatcttctctgccatgggaccgttgcaacaacaccagtttcatcgaactttgacgttgatggtaacgttaatctgacgtgttcttcgtccacgttctctgattcctccgttaacaatcctctaatgtactgcgataatttcgttggtaataacaacgttgatgatgaggatactatcgggttctccacatttctgaatgatgaagatttcatgatgttggaggagtcttgtgttgaaaacactgcgttcatgaaagaacttacgaggtttcttcacgaggatgaaaacgacgtcgttgatgtgacgccggtctatgaacgtcaagacttgtttgacgaaattgataactattttggatag

SEQ ID NO: 273 - DNA, 663 bp, Arabidopsis thaliana
atggctagaatgacaagagatggaaaagaacatgaatacaagaaaggtttatggacagtggaagaagacaagatcctcatggattatgtccgaactcatggccagggccactggaaccgcatcgccaagaaaactgggctcaagagatgtgggaaaagctgtaggttgagatggatgaactacttaagccctaatgttaacagaggcaattttactgaccaagaagaagatctcatcatcagactccacaagctcctcggcaacagatggtcgttgatagcgaaaagagttccgggaagaacagacaaccaagtaaagaattactggaacacacatctcagcaagaaacttggtctcggagatcattcaactgccgtcaaagccgcatgcggtgtagagtctccaccgtctatggcccttataaccacaacgtcctcctctcatcaagagatctccggtggaaaaaattcaactctaaggttcgacactttagttgacgaatccaaactcaaaccaaaatccaaactagtccacgcaacaccaactgacgtagaagttgcagctacggttccaaatctgttcgataccttttgggttcttgaagacggcttcgagcttagttcactcactatgatggattttactaatgggtattgcctttag

SEQ ID NO: 274 - DNA, 945 bp, Arabidopsis thaliana
atggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacctattttcttcttcttcttactataatcctcatgcatctttattcccttcacattccacaacctcttacccggatatttattctggatccatgacctatccatcttcattcgggtcggatcttcaacaacccgaaaactaccaatctcagttccattaccaaaacactatcacttacactcaccaagacaacaacacttgcatgcttaacttcattgagccgagccaaccgggttttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgataccggcgaatatggtcctattcaagctgccgtagacgctaaactagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtag

SEQ ID NO: 275 - DNA, 597 bp, Arabidopsis thaliana
atggaaaatggtatgtataaaaagaaaggagtgtgcgactcttgtgtctcgtccaaaagcagatccaaccacagccccaaaagaagcatgatggagcctcagcctcaccatctcctcatggattggaacaaagctaatgatcttctcacacaagaacacgcagcttttctcaatgatcctcaccatctcatgttagatccacctcccgaaaccctaattcacttggacgaagacgaagagtacgatgaagacatggatgcgatgaaggagatgcagtacatgatcgccgtcatgcagcccgtagacatcgaccctgccacggtccctaagccgaaccgccgtagcgtaaggataagcgacgatcctcagacggtggttgctcgtcggcgtcgggaaaggatcagcgagaagatccgaattctcaagaggatcgtgcctggtggtgcgaagatggacacagcttccatgctcgacgaagccatacgttacaccaagttcttgaaacggcaggtgaggattcttcagcctcactctcagattggagctcctatggctaacccctcttacctttgttattaccacaactcccaaccctag

SEQ ID NO: 276 - DNA, 396 bp, Arabidopsis thaliana
atggatcaaggaggtcgaggtgtcggtgccgagcatggaaagtaccggggagttcggagacgaccttggggaaaatatgcagcagagatacgagattcgaggaagcacggtgaacgtgtgtggcttggaacgttcgatacggcagaggaagcggctagagcctatgaccaagctgcttactccatgagaggccaagcagcaatccttaacttccctcatgagtataacatggggagtggtgtctcttcttccaccgccatggctggatcttcctccgcctccgcctccgcttcttcttcttctaggcaagtttttgaatttgagtacttggatgatagtgttttggaggagctccttgaggaaggagagaaacctaacaagggcaagaagaaatag

SEQ ID NO: 277 - DNA, 546 bp, Arabidopsis thaliana
atggcacgaccacaacaacgctttcgaggcgttagacagaggcattggggctcttgggtctccgaaattcgtcaccctctcttgaaaacaagaatctggctagggacgtttgagacagcggaggatgcagcaagggcctacgacgaggcggctaggctaatgtgtggcccgagagctcgtactaatttcccatacaaccctaatgccattcctacttcctcttccaagcttctatcagcaactcttaccgctaaactccacaaatgctacatggcttctcttcaaatgaccaagcaaacgcaaacacaaacgcaaacgcagaccgcaagatcacaatccgcggacagtgacggtgtgacggctaacgaaagtcatttgaacagaggagtaacggagacgacagagatcaagtgggaagatggaaatgcgaatatgcaacagaattttaggccattggaggaagatcatatcgagcaaatgattgaggagctgcttcactacggttccattgagctttgctctgttttaccaactcagacgctgtag

SEQ ID NO: 278 - DNA, 861 bp, Arabidopsis thaliana
atggctttgtcatcagctaagcatcagagaaaccatagactctctgctacaaacaagaaccagactctcaccaaagtttcttccatttcatcctcatcaccatcgtcttcttcttcatcgtcatcaacctcatcatcatctcctttaccttctcaagactctcaagcccagaagagatctcttgtcaccatggaagaagtttggaatgacatcaaccttgcttccatccaccacctaaaccgacacagccctcatccacaacacaaccacgagccaaggttcaggggccaaaaccaccacaaccaaaaccctaactcaatcttccaagattttctcaaaggatctttgaaccaggaaccagcacccacaagccagaccacgggttctgcgcctaatggcgattccaccacggtcactgttctttacagctctccttttccacctcctgcaactgttctgagcttgaattccggcgctggcttcgagtttctcgataaccaagatcctcttgttacctcaaactctaatcttcatacccaccatcacctctcaaacgctcatgccttcaacacctctttcgaggctctggttccatccagttcttttggtaagaaaagaggccaagattccaatgaaggttcagggaatagaagacataagcgtatgatcaagaacagagaatctgcagctcgttcccgcgctaggaaacaggcttatacaaacgagttagaacttgaagttgctcacttgcaggcagaaaatgcaagactcaagagacaacaagatcagttaaaaatggctgcagcaattcagcaacccaaaaagaacacacttcaacggtcttccacagctccattttag

SEQ ID NO: 279 - DNA, 864 bp, Arabidopsis thaliana
atggctatgcaggaacgttgtgagagtttatgttctgatgaacttatatcttcctcagatgccttttacctcaagacaagaaagccttataccatcactaaacaaagagagaaatggacagaagcagagcatgagaagtttgtagaagcattgaaactctatggcagagcttggagacgaatcgaagaacatgttggaacaaaaactgcagttcagattcgaagccatgcgcagaagttctttactaaggttgctcgcgattttggtgttagctctgagtccattgagatcccgcctccaaggccaaagagaaagccgatgcatccttaccctagaaagcttgtgattcctgatgcaaaagagatggtatacgctgaactaaccggatccaagctgattcaggatgaagataaccgatctccaacatcggttttatcagctcatggctcagatggattaggttccattggttcaaattcacctaactcttcttcagctgagttatcatctcacacagaggaatcattgtctctagaagcagagaccaaacagagccttaagctctttggaaaaacttttgtagttggtgattacaactcttcaatgagttgtgatgattctgaagatggcaagaagaagctatactcagaaacacagtctcttcaatgttcttcttctacttcagaaaacgctgaaacagaagtggtagtgtcggagttcaaaagaagtgagagatcagctttctctcagttaaaatcgtcggtgactgagatgaacaacatgagagggttcatgccatacaaaaagagagtaaaggtggaagaaaacattgacaatgtaaaattatcatatcctttgtggtag

SEQ ID NO: 280 - DNA, 1560 bp, Arabidopsis thaliana
atgggtggtggtggtgatacaacagataccaatatgatgcagagagttaattcttcttctggtacatcgtcttcttcgatccctaaacacaatcttcacttgaatcctgctcttatccgctctcaccatcacttccgtcaccctttcaccggagctcctccaccgccgattccacccatttctccttactctcagatcccggcgactttacaacctagacattctcgctctatgtcgcaaccgtcttctttcttctcctttgattcattgccgccgttaaatccttctgctccgtcggttttggtgtcggtggaggagaaaaccggtgccggatttagtccttcgttgcctccgtcaccgtttacgatgtgtcattcttctagctctaggaacgccggagatggagagaatctacctccgagaaagtcgcataggcgttcgaatagtgatgttacttttgggtttagttcaatgatgtctcagaatcaaaagtctcctcctttgagttctttggagagatcgatctctggtgaagatacatcagattggtctaatttggtgaagaaagaaccgagagaaggcttctacaagggaagaaagccagaggttgaagcagctatggacgatgttttcacggcttatatgaatcttgataacattgatgtcttgaattcttttggaggtgaagatggcaagaatgggaatgagaatgtggaggagatggagagtagtagaggtagtggtacaaagaagacgaatggtggaagtagtagtgattctgaaggagatagcagtgcgagtgggaatgtgaaggttgcgttgagttcttcttcttcaggcgtgaagagaagagcaggtggagatattgctcctactggtagacattacaggagtgtttctatggacagttgtttcatggggaagttgaatttcggcgacgaatcatcgctaaagcttccgccttcttcatcagctaaagtttccccaaccaattcaggtgaagggaattcaagtgcttatagtgttgaatttggaaacagtgagtttactgcagctgaaatgaagaagattgcagctgatgagaaactcgctgagattgtaatggctgaccctaagcgtgttaaaagaatcttggcgaaccgcgtatctgctgcacgttcaaaggagcggaagacgcgatacatggcagagttggaacacaaggtgcggacacttcagactgaagctactacattatcggctcagctcacacatttgcagagagattctatggggttgacaaaccagaacagtgagctgaagtttcgtcttcaagctatggagcagcaagcacaactccgcgatgctctgtcagagaaactgaatgaagaagtccagcggttgaaactggtgataggggagccgaaccgcaggcaaagtgggagcagcagcagcgaatcaaagatgtcactaaacccggagatgtttcagcagcttagcataagtcagttacaacaccaacagatgcagcattccaatcagtgtagcacaatgaaagcaaagcacacttcaaacgactag

SEQ ID NO: 281 - DNA, 1350 bp, Saccharomyces cerevisiae
atgggtctctgcgcatcttcagaaaagaacggcagcactcctgacacgcagaccgccagcgctggtagtgacaacgttggcaaagcgaaggtaccaccaaagcaggagccacagaagactgtgagaacagtcaacacagcaaatcaacaagaaaagcaacaacagaggcagcagcagccgtctccgcataatgttaaggaccgcaaggagcaaaacgggagcattaataacgcgatatctcccacggctacggcaaatacaagcggatcgcaacagatcaatatcgactctgccctgagagacaggtcgagtaacgttgcagcacaaccatcattgtcggacgcttcaagtggcagcaacgacaaagaactgaaagtgctactgctgggtgccggtgaaagtggtaagtccacggtattgcagcagttgaagattttacaccagaacgggtttagcgagcaggaaattaaagagtacatccccttgatctatcagaatctattggaaattggcaggaacctcatccaggcgagaacaaggtttaacgtcaacttggaaccggagtgtgaactgacgcaacaagacctgtcgagaaccatgtcctatgaaatgcccaataactacacgggccaattcccggaagatatcgcgggcgtaatatctacgttgtgggccttgccctcaacacaagatttagtcaatgggcctaacgcatcgaagttctatctaatggactcgactccttacttcatggaaaatttcaccaggatcacttcgcccaattacagacccacccagcaggacatattaagatcgagacagatgacgtcagggatttttgacaccgtcattgatatggggtcggatatcaagatgcatatttacgacgtgggtggacagcgttccgaaagaaaaaaatggatacactgcttcgacaatgtcactctggtcatattttgcgtttctctatcggagtacgaccagacgctgatggaggacaagaaccagaacaggtttcaggaatcgctggtgcttttcgataatattgtcaacagtagatggttcgcgcgcacgtctgtcgtactctttctgaataaaatcgacctttttgctgaaaaactaagcaaagtgcctatggaaaattacttcccagactacaccggcgggtcagacatcaacaaggctgctaagtacatactctggaggtttgttcagttaaacagggcgaatctaagcatatatcctcacgtgacacaggccacagacacgtcgaatataagattagtatttgccgccatcaaagaaacaattttggaaaatacattgaaagactctggagtgttacaatga

SEQ ID NO: 282 - DNA, 661 bp, Oryza sativa
tgctcctcaaacgagaccaagaaatcaatcgttccagcgaagaagaagaagaagaaggaggaatccatggcggcgaggacggtggcggtggcggcggcgctcgccgtgctgctgattttcgccgcctcgtcggcgaccgtggccatggccggccggccaacgcctacgacgtctctcgacgaggaagcggctcaggcggcggcgcagtcggagatcggcggcgggtgcaaggaaggggaaggggaggaggagtgcctcgcgaggaggacgctgacggcgcacaccgattacatctacacccagcagcatcacaactaattaatcttatcgatcaatcaataatcaatcaatcaatcagtcgcttcctcttcgatctaccaatactagtattggtatataattaaaactgcaaatccgtcatgcatgcatggtatgcccatcgatccatccatgattatctctagttagatgtagtaacaaactgcatgcgcgtgttgtgctcatcagtgttaattttggccgcccccctgttgataaacagttcttgatcgatgagagctagctttcgttttgttttgatttgttggttggttggttgatttgagagttgagacagatcgatctctgcttgaatggtacctgtcccaaaaaaaaaaaaaaa

SEQ ID NO: 283 - DNA, 795 bp, Oryza sativa
  unsure (1)..(795): unsure at all n locations
agcaaaatctcttctcctcctcctcctcctcctcatcatcatcctcctctcgcccttcgacaacgcaccatagtttaacccaagctagaagaagaagacgatagatatgagcactactcgcggcgtctcctcctcttctgctgctgctgctcttgcgctgcttctcctcttcgccctctgcttcttctccttccacttcgccgcagctgctcgcgccgttcctcgtgatgaacaccaagagaatggcggtgtcaaggcagtagcagcagttgcagctgatcagcttgtgctccagctggaaggtgacaccggcaatggcgacgaggtctccgagttgatgggagcagctgaggaggaagcagcagcatgcgaggaggggaagaacaacgacgagtgcgtgcagaggaggctgctcagcgacgcccacctcgactacatctacacgcagcacaagaacaagccttgatcgatcgatccatccatccatccatccaactacacgctgaaatccaaagctaatacaaggaagatcgagatcgagataaattaaccaactctatatgcatatctatctatccatctacctctgcatgctgtttttactgcatcgatcgctactgttctgcagtgccaatcactgtccgtttctgtacaatctgtgatactactagctagtagcagtacatggcatcgttttccttcaagtgttcgttgggcttttacttaggtccggtgagtgcttgtggggttatttctgacgaggggagtgtgatcagtaccgcgtactaannggat

SEQ ID NO: 284 - DNA, 708 bp, Oryza sativa
gaagaagcagcagcaaaaaagttgatcagttaattagcaagtgtgttcttctttcttttggtgagagagagagagagagagagagagagagagatctcagaatggtgaatccaggaagaacagctagggcactctgcctcctatgccttgctctcctcctgctaggtcaagatacccattccaggaagctcctgttgcaggagaagcacagccatggcgtcggcaacggcacaaccaccacccaggaaccaagcagagagaatggaggaagtacaggttccaataacaatgggcagctgcagtttgattcagccaaatgggaagaattccacacggattatatctacacccaagatgtcaaaaacccataatggctgttcatttatgatttgaactagtactagtagcttataccttctgcgcgtcttttgttcgtttggagaggggattttcttgggatttagcatatgaactaattaaattaaatcccaggcaaatcccactcagcccattttgtgcagaagttgtcagtgtgcactgtataattatttagtcatacacaactactcctggtaactactcctatcttcgatgaattttctggttttgccagacgtgacaatagtccagtagcatgcagtaccctctcagaatccctgtaatttttagcaaaaaaaaaaggaagaaaagaaaagaagcttccctact

SEQ ID NO: 285 - DNA, 681 bp, Oryza sativa
cgatagatatgaggccgactggtcgtcgttcttctccgccggtggctgctgctcttgccctgcttctcctcctcgtcctcttcttcttctcccactgcgcctcagctgctcgcccactgccagcatcagcagcagcagagctagtgcttcaggatggcgccaccggcaatggcgacgaggtttccgagttgatgggagcagctgaggaggaagcagcaggattatgcgaggaggggaacgaggagtgcgttgagaggaggatgcttcgcgacgcccacctcgactacatctacacgcagaagaggaacaggccttgaaatcttgaatcataatctccaagtcgatacaaggaggaattaatcagtagtaaacctacataaattaatctactatctgcagcctgttttcaactgcatgtatcagtgtattagtcgatctaggataatattttgcatgtgtactcaagtaaactgtcgtctgtataaccccgttatgtacatggttgtatttctttctccaaagtgttatcgaactctctgttgatctctgatacatctgtatgtgtagcatcagagaaaagatcgagcacttgtgggttatgatctgacgatcgagtgtatgaacagtgctaatggtgtagtaagtttttgcttaaaaaaaaaaaaaaaaaaaaaaaaaaaa

SEQ ID NO: 286 - DNA, 1542 bp, Arabidopsis thaliana
atgggagcctatgaaacagaaaaaccaactaaagatgcggcggctctagagacacagtcgccggaagatttcgatcaaccatctccgcttcgtaaaatcatctccgtcgcttccatcgccgccggtgtacagttcgggtgggccttacagctctctcttcttactccgtacgttcaactcctcggaatccctcacaaatggtcatctctcatttggctctgtggtccagtctccggcatgattgttcaaccaatcgtcggtttccacagtgaccgatgtaggtccaaatttggtcgacgtcgtcctttcatcgccaccggagccgcactcgtcgccgtcgctgttttcctcatcggttacgctgcggatttcggttataaaatgggagataaactcgaggagaaggttaaagttcgagctatagggatctttgctctcgggttctggatcctcgacgtagccaacaacaccttacaaggaccttgccgtgctttcttagccgacttagccgccggtgacgctaagagaacgcgagtcgcaaacgcgtttttctctttttttatggcggttggaaacgttttgggttatgcggctggttcgtacactaacctccacaagatgtttccgttcacaatgacaaaagcttgcgatatctattgcgccaatctcaagacttgtttcttcttatccatcactctcctcctcatcgtcaccgtcacgtctctttggtacgttaatgacaaacaatggtctccgccgccgcgaaatgccgacgacgacgagaagacctcaagcgttcctttgttcggtgaaatctttggagcattcaaagtcatgaaacgtcccatgtggatgcttctaatcgtcacggccttaaactggatcgcttggttcccatttcttttgttcgatactgattggatgggtcgtgaagtgttcggtggagattcagatggaaatgaacgatcgaagaaactatacagtcttggagtccaatctggtgcaatgggattgatgtttaactctatagttcttggtttcatgtcacttggtgttgaatggattggtcggaaattaggaggagctaaacggctttggggtattgtcaatttcatcctagccgctggtttggccatgacggttctcgttacgaaattcgccgaggatcaccggaaaaccgccggtgatttagccggaccgagcgctagtgttaaagctggagctttaagtctctttgctgttcttggtatcccattagctattactttcagtactccttttgctctagcatccatattctcaagctgctccggtgcaggccaaggactttcattaggagttttaaatttggcgattgtgataccacaaatgatagtctcactaggaggtggacctttcgacgccttgttcggcggtggaaacttaccggcgtttatcgttgcagcaattgcagcggcgattagtggagtattagcgttaaccgttttaccttcaccaccaccggacgcacccaaggcaacgaccatgggaggattccactag

SEQ ID NO: 287 - DNA, 1776 bp, Arabidopsis thaliana
atgagtgactcggtgtcgatctcggtcccgtataagaatttgaggaaggaaattgaacttgagacggtcacgaagaatcaagacggatctggttcttcgtcgttctcttcttctcctttgaatcatcctgaatctgctgatggtgaatctgtgtcgaagaattgtagcttagtgacgttggtacttagttgtacagtcgctgctggtgttcaatttggttgggcattgcaactttctcttcttactccttatattcagacccttggaatatcgcatgctttttcttcgtttatttggctgtgcggcccaattacaggccttgtggtccagccttttgttggcatttggagtgataaatgtacttcaaagtatggaagaagacgaccatttattctagttggatcattcatgatctcaatagcagtgataataatcggattttctgcagacattgggtatctgttaggagattcaaaggaacattgcagtactttcaaaggcacacgaaccagggcagctgttgtctttatcattgggttttggttgttggatctagcaaacaatacagtacagggacctgctcgtgctcttctagctgatctatcaggtcctgatcagcggaatactgcaaatgctgtgttctgcttgtggatggctattgggaacatccttgggttttctgccggtgctagcggaaaatggcaagaatggttcccttttttaactagtagagcatgttgtgctgcatgtggaaatctcaaagcagcgtttcttcttgcagtggtctttctcactatatgtactcttgtcacaatctattttgctaaagagattccttttacaagcaacaagcccacccgcatacaagattctgcacctttgttggatgatctccagtccaaaggccttgagcattcaaaattaaataatggtactgccaatggaatcaagtatgagagagtggaacgtgatacggatgaacagtttggcaattcagagaatgagcatcaagatgagacctacgttgatggccctggatctgttttagtgaatttgctaactagtttaaggcatttgccaccggctatgcactcagttcttatcgtcatggctcttacatggttatcctggttccccttctttctgttcgatacagattggatgggaagagaagtttaccatggggatccaacaggagatagtttgcatatggaactctatgatcaaggtgtacgtgaaggtgcacttggtttgctactaaactctgttgttcttgggatcagctcatttctcattgaaccaatgtgtcagcggatgggtgctcgggttgtatgggctttgagcaattttactgtatttgcctgcatggcaggaacagctgtaatcagcttgatgtctctcagtgatgacaaaaatggaattgaatacataatgcgtggaaacgaaacaacaagaaccgcagccgtaatcgtttttgcactccttggttttcccctagctatcacatacagtgtccctttctctgtcacagcagaagtcactgctgattccggtggcggtcaaggtttggctataggagtgttgaatctcgcaatcgttattccccagatgatagtatcacttggagctggtccgtgggatcaattgtttggaggaggaaacttaccggcgtttgttttggcgtctgttgctgctttcgctgctggagttattgcattgcaaaggcttcccacgctatcgagttctttcaagtccaccggtttccacatcggctaa

SEQ ID NO: 288 - DNA, 1533 bp, Arabidopsis thaliana
atggctacttccgatcaagatcgccgtcacagagccactcgcaaccgtccaccaatacctcgaccctctaattcatcatctcgtcccgttgtacctcctcctcgatcaaaagtttcgaagcgtgtgcttctccgtgtagcttccgtcgcatgcgggattcaattcggatgggcgcttcagctttcgcttctcacaccttacgttcaagagctagggatcccacacgcttgggctagtgtgatttggctttgcggtcctctctctggtttgttcgtgcaaccgctcgttgggcatagtagcgataggtgtactagtaagtacggtcgtcggagaccgtttattgtcgccggagctgtggcgatttctatctctgttatggttattggtcatgcggcggatattggatgggcatttggggatagagaagggaagattaagccgagggcgattgttgcttttgttttagggttttggattcttgatgttgctaataatatgactcaaggtccttgtagagctctcctcgctgatcttactgagaatgataatcgcagaacccgggtggcaaatggctacttctctctctttatggctgttggcaatgttcttggctatgctactggatcatacaatggttggtacaagatcttcacttttacgaagacagttgcatgtaatgtggaatgtgccaatctcaagtctgccttctacatagatgttgtctttattgcaataactacgatcctaagcgtttcagcggctcatgaggtgcctcttgcttcattgacttctgaagcacatgggcaaaccagtggaacagacgaagcttttctttctgagatatttggaactttcagatattttccaggaaatgtttggataatcttgcttgttacagcattgacatggattggttggtttccatttattctgtttgatactgattggatgggtcgagagatctatggcggtgaaccgaacataggtacttcatatagtgctggggtcagtatgggtgcacttggtttgatgttgaattctgtttttcttggaatcacttcggtgctcatggagaaactttgcagaaagtggggggctggttttgtttggggaatatcaaatatcttaatggctatttgctttcttggaatgataatcacctcatttgttgcgtctcaccttggctacattggccatgaacaacctcctgccagcatcgtgtttgctgctgtgttaatctttacaattctgggcattccattggcgataacttacagcgtcccatatgcgttgatttccatacgtattgaatccctgggcctaggtcaaggcttatctttgggtgtgctaaatttggcgatagtcatcccacaggtaattgtgtctgttggcagtggcccatgggatcaactgtttggaggtgggaattcaccggcacttgcagtaggagcagctacaggcttcattggcggaattgtagctatcttggctcttccacggacaaggattcagaagcccatccctctcccatga

SEQ ID NO: 289 - DNA, 2036 bp, Oryza sativa
tttcttggcctctcctcctctgacacaggggtgtgcaggtttgtgtttgtgcgtggcgcgtccgccatggctcgcggcagcggggccggaggaggcggcggcggtggtggcggggggctggagctgtcggtcggggtcggcggcggcggcgcgcgtggtgggggaggcggtgaggcggcggcggcggtggagacggcggcgccgatcagcctcgggaggctcatcctctccgggatggtcgccggcggcgtgcagtacgggtgggcgctccagctctccctcctcaccccctacgtccagacactcggactgtcgcatgctcttacttcattcatgtggctctgtggtcctattgctggcatggtggttcaaccatgcgtgggtctatacagtgataggtgcacctcaaaatggggaagacgaaggccatatattcttacaggatgtgtgttgatatgcttggctgtcgtagttattggattttcagctgacattggatacgccatgggtgatacaaaggaagactgcagtgtctaccatggatcacggtggcatgctgctattgtatatgtcctgggattctggcttcttgatttttccaacaacactgtgcagggtccagcacgtgctctaatggctgatttatcaggacgtcatggacctggcacagctaactccatcttctgttcttggatggcaatgggaaacatcctaggatactcctctggttccacaaacaattggcacaagtggtttccattccttaaaacaagagcttgctgtgaagcttgtgcaaatttgaaaggtgcatttctggtggctgtgattttcctgtccctgtgcttggttataactctgatatttgccaaggaagttccattcaaaggaaatgcagccctcccaacaaaatcaaacgagccagctgagcctgaaggcactggtccactagcagtgttgaaaggcttcaggaacttacctactgggatgccttctgtgcttattgtgactggccttacctggttgtcttggttcccattcatcctctacgacactgactggatgggccgtgagatctaccacggtgacccaaagggaactgatcctcagatcgaggctttcaaccagggtgtcagggcaggtgcatttggcctgctactgaattcgattgtgctaggattcagctcattcttgattgaaccaatgtgccggaaagtcgggccaagggtggtgtgggtgacgagcaatttcctcgtctgcatcgccatggctgcaactgcactgatcagcttctggtcactcaaggacttccatggaactgttcagaaagccatcactgcagacaagagcatcaaggctgtctgcctcgtcctctttgcgtttcttggagtccctctcgccgttctgtacagtgttcccttcgcagtgacggcgcaattagcggccactagagggggtggccaagggctctgcaccggcgtcctcaacatctccatcgtcatccctcaggtggtcatcgcgctgggagccgggccgtgggacgagctgttcgggaaggggaacatcccggcgttcggcctcgcctcgggattcgcgctcatcggcggcgtcgccggaatattcctgctgcccaagatctccaagcgccagttctggtcggtcagcatgggcggcggtcactgaccgcccgctctcgccgccggctgcggcggcggcggcggccggagcagcgccgccggaagtggtgagctttgtagttctcgtttgcaatggatcaaaggagccccctctttttttttacatagggtaattaattaattaaggctgttaattaggaaggggtgaggtggccctgcagctggggcccacgctttgttgccacctcggtagaagagaataagcagatcatgcagataatatggaactgtaaaactgttttgtgttgtgtgtgtgtgcagtgtgcttggtaattagtgtgtaatgaatggtcaggagaagtgcagtgaactaagtgaaagtgagcttccatcatcatcatc

SEQ ID NO: 290 - DNA, 1713 bp, Oryza sativa
cttcgatctcttgggatataactagcttagctatagctctagctaaataggttcgtacgtataggatatttgatccattgatcgatggccgtcgacatggagctcgacggcggtggcgacggcaagggcaaagccccgccgcagataagcctgtcggggctattccttgcgtgcatggtcgccggtggcgtgcagtacggctgggcgctgcagctctctctcctcaccccgtacgttcagacattgggaattcctcatgcactcacttcagttatgtggctctgtggccctattgctggcttaattgttcagccatgcgtcggcctgtacagtgacaagtgcacatccagccttggaagacgtagaccgttcatcctcactggatgcataatcatctgcatatctgtgatcgtcatcgggttctcctcggacatcggctacgctctcggcgacacgactgaggactgcaaggtttacaggggtcctcgttaccatgcagcggcggcattcatcctcggattctggctgctcgacttctccaacaacaccgtgcagggtccagctcgcgctctgatggccgatttgtcaggtcggcatggcccaagcgcggccaacgcgatcttctgttcttggatggcattaggcaacatccttggctactcctccggatccaccaatgactggcacaagtggtttccctttctcatgaccagggcttgctgcgaggcctgcgcgaatctcaaagcggccttcttggttgcagtggtgtttttggggttgtcgacggcggtgacgatggtgtttgcgagggaggtggcgctggacccagtggcggcggcgaagcggaacgagggtgaggcgtcggggctcctcgccgtgttcaaggggatgaagaacctccccgtcgggatgccgtcggtgcttatcgtcaccggcctcacctggctctcgtggttccccttcatcctcttcgacaccgactggatgggccgcgagatctaccatggccgcccggacggctcccccgccgaggtcaccgccttccaagagggtgtccgccaaggcgccttcggcctcctccttaactcgatcgtgctgggcatcagctcgttcctgatcgagccgatgtgccgtcggctgggcgcccgcgcggtgtgggtgatgagcagcgccgtcgtgtgcgtcgccatggcggccgtctccgtgctcagcgcgtggtcgctcggcgacttcggcggctcggtgcaggacgcagcgcgggcgccggcggaggagggcggcgtcagggcgtcggcgctggcgctcttcgtcttcctcggcctccccttcgccgtcctctgcagcgtcccgttcgccgtcacggcgcagctcgcggcgagccgcggcggcgggcagggcctctgcaccggcgtcctcaacatctccatcgtcgtgccgcagatggccatcgccctcggcgccgggccctgggacgagctgttcggggaggggaacatcccggcgttcgccatggcgtccgtgttcgccgccgcggccgccgccgccggcgtcgtcttgctgcccaaggtctccgtccgctccgtcagcatggccggcggccactgatcactactagtctatcaccctttttttttccgtggttttaaatctcccgctatagctgctgctatctccagttagagcgggtactatagcaggctataagccagctgt

SEQ ID NO: 291 - DNA, 2016 bp, Emericella nidulans
atgaacgatctttggggccttatttcctgccattcgtatggacccagaggaatgcgagtgtcatttcccattcggaagatgtgtcgtctgatcggtgacaccgtttctcgaaatatcgaacgcttatcttacgcttctcgcctgcaggctcgcaagcttatcaacacagtaccaaccgacgcaaacccctccggatacattgttgcctcatctgacgatttgcttcgtctggtggatgccgactacggtgcgctgtgcatccgcggcgaggtaaaaattctggcaaagtcaccccagtctcaggagatgttggccttgctagagtacctaaaggtccgaaaatacaattcggtactgacgtccaaccatatcgtcaaagacttccaggacctcaattatcctcccgggttcaaggacatttcaggtttgctttatgtgcctctgtcgaccgacggtttggacttcattgttttcttccgtcgcggtcaattgaccgaagtcaaatggggcggcaatcctaacgaggccaagttcaccgagggccaccttgagccccgaaagagctttcagacatggcgggaaaccgtcctggaccggtgccgcgattggactgaatctgaggtcgacacagctgccgtgctctgcctggtgtatggcaagttcatcaaagtctggcggcagcaggaagccgctttggagagctccagccttaccaaattgctcctggcaaactctgcgcacgaagtacgcacacctctgaatgccattgtcaactatctagaaatcgcgcttgaaggtgcgctggacggcgagacaagggatcacttgagcaagtcctactccgcatccaagtccctgatctatgttatcaacgaccttctcgaccttaccaacgtcgagaagggacagagcctcatcaaagatgagccctttgatttgcccaccactttcagcgaagcaacggccatgtttgaaagtgaagccaaacgcaagggcttgaactacaaggtattgtcacaaccggggattcccgagaccgtgattggagatcagcggcgtgtccggcagtcgatcagcaacctcacctccaacgcggttcaaaacacctcgtccggtggagtgactgtcgaggtgtggcacgctcctggggagggcgataccgacaaggcgacggtcaagatcgcggtccttgatacaggccgcggtatctcatcaagcacgcttgagctattgttccgtgagctggagcaggtctcaggagaagacgactcgcattattatggcgggagcgaagaaggggaggaatccgctccagaggctaaggctagcaaggataaggctgttttgggcctgggcctggcgttggtggctcgaatcgtgcgcaatatgcacgggcaactcactgtgcggtctgaagaagggaagggtagtcggttccagatttcgctacagttccctatccccgaaggctcggataccaagagtccaaccgcggaacaccgtcctgttgccactggggactctgcggccccgttctcgaccggggatgatgtgatcctcgttgatagcactactggttccaaaagaaatagccaagacagcctaacccgcccagacgtgcctcgaaaatctgaaccggaggatacagcccttgctgatggcgctggtgaacaagcgtcaggtgaaagcgaagctcagactcgacccaaaaagaccggagaatcgacagcatctacttctcatgagcaatccgaaacggcacgttcacggccgtcaggccccagctctgggcctagtgcgcccgaacggcggcccctccgggttctcgtagctgaggacgacccgatcaacgcgaagattatcgagaaacgactcgaaaaactcggccacactgttcaacgcacggtgaatggggaggagtgtgcgaatgcatactcggcagagtcgacgcagtgggatgttgtgttgatggatattcaggtaggtggtcaatgcctttggtgtcttttaatgtaa

SEQ ID NO: 292 - DNA, 917 bp, Zea mays
ggctcgagaccagttgatacatgtcttgtgacttgtgaagtgtgttcctatctgcatcaccttccttcgccttgcaaccctttggctagttcattcatacgaatggattattctaatttgcgtcgccaagctgcatccatgaaaaagactctctttgatcaggggtacctagatgagcaattttgccaggtggaagacttgcaggatgaagctagtcctaatttcgcggaagaggttgtcactttgtttttcaaggactcggccaggctaatatcaaatgctgaacaggctctggaaaaataccccaaagatttcaatagatgggatgcatacatgcagcagctaaaaggcagctgttccagcattggtgcttcaaggatgaagagtgagtgcgtgtcattccgggattactgcggacagggaaatgttgaaggttgtatgagatcgttccagaaagtgaagagggagcacggtgccctgaggcagaaactagaggcctatttccagctgctacgacaagctggtcctgctggagctgccaccaggcctggatgtaagaactaggagttgcaggaaaacggagtatgacccaagaagatacctcactacaactgactggcccagtggccctgctgcgcagcaattaggggtcagcatacgaagaaaacaagagatgatatgcatggatatgcacaaaactgtaataagagattgttttttcaagaacaaaaaaaaaatcagaggagaggaagggatgggaaccttgtgtagtgagtttacaagctttactgaaagatggtattattgtctcatgtgtaatatattccttccattttaaaataaaaaaaaaaaaaaaaaaaaaaaaaaaaaaaaaaaaaaaaaaaaaaaaaaaaaaaaaaaaaaaaaaaaaaaaaaag

SEQ ID NO: 293 - DNA, 833 bp, Zea mays
caaccagttgcatatgcattttgtgcctactctacctttaaggcattcatttataaatggagtattctaatttgcagcagcaggcagcgtccttgaaaaagaacctctttgatcagggatacttggatgagcaattttgtcagattgaggacttgcaggatgaagcaagccctaattttacagaagaagttgtttccctgttcttcaagaactcaaccaggctaatgacaaatattgagcaagctatggacaggaatcccagagatttcagtaaatgggatgtaaacatgcagcaattaaaaggaacctgttctagcatcggtgcttgcaggatgaagaacgagtgcacctcattcagaaatagatgtggagacgagaacgttgaaggttgtatgaggtccttccagaacctgaagagggagcatggagtcctcaggcagaagctggaatcctacttccagctgctgcgacaagccggtcctgccgtgactgcaaccaggcctagaggcatgtaaggaacggctgttggcgtgcagggagcagtgcaagggacagacagcgtcatagcgatgctccactacgccattgttgaggctagctgtaacgatgggccacgaataagaagtttgcctatggcctgtgggggagttccctgcgggttttaaagtgtaacacccttcataatcgatgccttaagctggtgctgccgagtgccgactagctaggccggcatgtaagagcagcctagactgatgttgatgtggtctggcagacgtcctgtgctgtgcctgcctctgtatttcggtcaaataaataaactagatggagtttgc

SEQ ID NO: 294 - DNA, 799 bp, Glycine max
cccacgcgtccgcttatgttgttttgtgtgacagacaacagaggaacactcccaaacaaaccatggacgtgggtcagatgcagagacagtggatcgactacaccaaatccctcttcctcgagggcttcctggatggtcagtttctgcaacttcagcagcttcaagatgagaacaaccctgactttgtggtcgaagttgtctctctcttctttgaagattctgaaaggcttctcaaagatctcacctttgccctagatcagaatggcgttgacttcaaaaaagttgatgctcatgtgcaccagttaaagggtagcagttcaagcataggtgcacaaagggtgaaaaatgcctgcattgctttccgcaacttctgtgaggagcagaacacagatgcgtgcgtcagatgtctgcaacaagtgaaacaagagtactgccttgtcaagaataagcttgaaacaatgttcaggcttgagcaacagattgtggcagctggtgggtcaatccctacggaactgagtttcagtggatgatgggtgggtttgtagagatgcttgtattatgatcctcttctttgttaaagattatcctttatcttatttagtccatggtgaatgtatgggtttttatgaagatagaagttttccatccaatgtacctttttcttcaccaaaaagctcttcataatttgtaatcttttgcatgctttactgaaggatgatagcagcaccattaattgaactttcctcttttatctctcttccaaacgaggaagaaaaaaaaaaaaaaacaaaaaaaaaaa

SEQ ID NO: 295 - DNA, 1003 bp, Saccharomyces cerevisiae
tggtaaatagaaacggaactttacatattgaataccggagatataattcgtttatgccacataatcatcaatacatccgtaacccgcccgaaacggaaaaactgaagaaaaattacataaaaagtttaatatttttatcaaatttaattgaacctatatttaggaacattattgtttttaatttctaaaccggttgggttggtcgatagttgtgctctggatcattgataaaccactgacgtgtaatagttttatttctttgaaaaattcaaaagaaataacaacactcgttctcggaaacaagaaaatacacacaataatgtctactattccctcagaaatcatcaattggaccatcttaaatgaaattatatctatggatgacgatgattccgatttttctaaaggtctaattattcaatttatcgaccaggcacaaacaacttttgctcaaatgcaacgacagctggacggtgaaaaaaatcttaccgaattagacaatctgggccattttttaaagggttcttctgctgcattaggcttacaaagaattgcctgggtttgtgaaagaattcaaaacttgggaagaaaaatggaacatttcttccccaacaagaccgaattggtcaacactctgagcgataaatcgattattaatggaatcaatattgatgaagatgacgaggaaataaagatacaagtggacgataaagacgaaaattccatatatctcatcttgatagcaaaagctttgaaccagtctaggttggagttcaaactggcgagaattgagttatctaaatattacaacacaaacctataatcgtcatcattttattcacacctccggataatccattcttccccggaaaaacacatgtacaatatatattatatatatatatatatgtatatcaaatcatacaacttacataaaaacaacaaacctgaatatttttccttttcaaaaagtaattctacccctagattttgcattgctcct

SEQ ID NO: 296 - DNA, 2234 bp, Oryza sativa
tcatatgtatgtttgtacttctgtagggagtgtggtgaggactgatgaacttgtaaacattgggtatggatggatgtgactgcatcgagccactatggccaactgatgagctcctcatcaagtatcagtacatctcggacttcttcatagccctcgcatatttctcgatcccgttggaactaatttatttcgtgaagaagtcatccttcttcccatacagatgggttttgatccagtttggtgcatttatagtcctatgtggagcgactcatctcataaacctgtggactttcaccacacacacaaagactgttgctatggtcatgacagtcgcaaaggtttcaacggctgttgtgtcctgtgcgacagctttgatgcttgtacatattatccctgacttgctgagcgtgaaaacaagggaattgtttctgaagaataaagctgaacagcttgatagggagatgggcttgattaggacacaggaagagactgggaggcatgttaggatgcttacccatgaaatcagaagcactcttgatagacatacgattttgaagactacacttgttgagctaggagggaccttgggcctggaagaatgtgccctatggatgccatcaagaagcggttcaagtcttcagctttctcatactctccgccaccagattactgttgggtcaactgtatcaattaatcttcctgttgtcaatcaagtgttcagtagcaacagagcaattataataccccacacatctcctttggcacggatccgacctcttgcagggagatatgttccaccagaagtggctgcagtgcgagttcctcttctacatctttcaaactttcaaataaatgattggccagagctttcagcaaagagctatgcaatcatggttctgatgcttccatctgatagcgcaagaaaatggcatgtgcatgagttggagcttgttgaggtcgtggctgatcaggttgcagttgcactttctcatgcagctattcttgaagagtccatgcgtgcgcgtgatctgctaatggagcaaaatgttgctctggatttagctcgacgtgaggctgaaatggctatccgtgctcgtaatgatttcctggctgttatgaatcatgaaatgagaacaccaatgaatgcaataatagccctttcgtccttacttttggaaaccgaacttactcctgagcagcgcttgatggtggaaacagtcttgaaaagcagcaatcttttagcaacactcatcaatgatgtgttagatctttccaaacttgaggatggtagccttgaattggagattaaagcattcaatcttcatgctgttttcaaggaggtaatgagtttcatcaagccaatcgcagccatcaagagactgtctgtgtcagttatgttggcaccagacttgccattatgtgccatcggtgatgaaaagaggctaatgcaaactattttgaatatctctggcaatgctgttaagtttacaaaggagggccacatcacacttgtagcttctgttgtgaaggctgactctttaagagaattcagaaccccagattttcacccaactgcaagcgatgacaatttttatttgaaagttcagattaaagatacgggctgtggcattagccctcaggatctacctcaggtatttacaaagtttcctcaatctcagcctggaggaaacagaggatacagtggtagtggtcttggccttgccatttgcaagaggtttgttactttgatgggagggcacatctggttggatagcgaaggaacaggaagaggctgcacagtaacgtttgtcatccagcttggcatatgcgataatacgaatgcatatcagcagaagctgattcctctagtctggccgagcagtggggatgctgattttgttggtccggtgccaaatgctcctaatgaagagaaaggtcaggcttctctgaaatctcggtatcagagaagtatatgagctactgtaaattgatcgacggcattgtatcaagtagggcctggttagtttgtctctaattttgtgcctagccttgtgatagctggaatatatttgtacaaataatgtacagcagatgggactgcataatgcagctatgcacctgggtacaactctaacttgcgtagtgtcctgtcagcgaaatgtgattctgggctgttcgtgtgaccttctgataaaaaaaaaaaaaaaaaaaaaaaaaaaaaaaaaaaaaaaaaa

SEQ ID NO: 297 - DNA, 2701 bp, Oryza sativa
ataagtagatggatggatcatgtgattgcattgagccgctctggcaggcggatgatctccttgtaaagtatcagtacatatctgacttctttattgcgctcgcttacttctcgatccctttggagctcatatatttcgttaagaagtcagcattcttcccttaccgatgggtgcttatacaattcggcgcattcattgttctttgtggggcaacccacctgataaatttgtggacttttgccatatataccaagactatagctgtggtactgacagtggcgaaagcagcgacagcggttgtttcgtgcatcacagctttgatgcttgtgcatataattcctgatttgttgaatgtgaagttgagagagagatttctgaaggataaggctgatgagcttgatagagagatggggattataagaacacaagaggagacaggaagacatgtccacatgctgacccatgagataagaagcacacttgacaggcacaccattctgcgaactacgctcgtcgagctgggaaggactcttgttttagcggagtgtgccctgtggatgccaacacgctctggatcggcccttcagctctctcatacgatatataacagcgcagcaattggatcagttgttcctatcaaccttcccattgtcagtaaggtttttaatagtaaccgtgtagtaaaaattccgcatacctccccgttagcttcgataacggctgacaaaagcaggtatgtgccaccagaggttgtggctatccgtgttccactgctgcaccttacgaatttccaaataaatgattggcctgagctatctgcaaaaagctttgcagtaatggttttgatgctccctccagacagtgcaagagaatggcggccgcatgaacgggagcttgttgaagtcgttgctgatcaggtagttatcagtttcatttatgtgcattcctctatatatgtaatcaaaatcaaaggtgtgattttctgatacccgatatcttgaatctggtgatatcaggtttagtctgatattgtttggtagagaactagagaatcaattaaatagagaaatttaaccatttatgttggtgtgacctgtgaactaagttttcttgaaaattgtgaaaatcctaaacccatggcctcatttttctcattcaggtagcggtcgcattgtctcatgctgccattttggaagagtccatgcgggcccgtgatctactaatggagcaaaacattgctcttgatgcagcacgtcgggaggcagaaatggctatttgtgcccgtaatgattttcttgctgtaatgaaccatgaaatgcggactcctatgcgagcaatcgtttctttgtcctctctccttttagaaacaaatcttagtgctgaacaacgcctaatggttgagactatactaaagagtagcgatcttctggcaactcttacgaatgatgttttggacgtttcaaagcttgagaatgggagtcttgagctggaaattgcaccttttaatttgcattccacctttacagatgtgagtcccctctctgtgatttaggatttgctgttatgttgcctggaaagtaagaaatggagatctttgctatttttcattaagattaactcggtagttcatcttgtattcttgtaggtggttaatttgattaagccagtagcagcgtgcaagaggctctcggttatggtcactttggcaccagagttacctctacatgctattggtgatcaaaagcgattgatgcaaataatcctaaatgttgccgggaactccattaagttcacaaaggagggtcatgtttcgattacagcttctatggccagaccagatgctttgagaggtccacatgaacctgactaccatccagttgtctctgatggattcttttacctggctgttcaggtttgctcatgaacattttctatgttcgctacttcctcttatctccagtctattaagattatagttatacatggttgaactttatctgttacttgttattatgcttcacaagttcacctgtgtgttgtagcgcatctaatgtccaacaaaccactgatttagttctcgcaatctgtataagttgccttgttttgtgttagagggatattaagataggataccacgtactaaacatttagttgttttatgacttgatcttttttctatttctgtaggtaaaagacacaggctgcggaatcagccctcaggatatgccccacacattcagaaagtttgcacaccctgaaaacgcaggcaaatggaacagtggcagtggattggggctggccctttccagaaggtatcccaagaaaacattgttttcacatatgcatcatttttccctggatcattttacatatgcatcatttatccctgtgctaacatatgttaactatctcttgccatatcagatttgtcagtctaatggaaggtaacatctggctcgagagcgaaggcgtcgggaagggctgtaccgcgatgttctttgtgaaacttggcatgcctgagaaaccaaatgcaaacctccgaagaatggcgccgcaccctctacagccaaaccaaggagctggaggccctgatgccctcagtatatccataatggacagcaacccgagggttcctcgggttcgctaccaatcaagcgtatgagaagcaccgatgatgccatcgccatgccaaggcagagca

SEQ ID NO: 298 - DNA, 1876 bp, Arabidopsis thaliana
tgaaatatcgtagtgttcataacgaaacgagcacacaactcactaaacactcaaacaaaaatacaaacattaagatgatgatgaagattagctttaacacatgctttcaaatcttactaggatttatcgtcttcatcgcatcaatcactttactaggtcgaatattctcaaggccttccaaaaccaaagaccggtgtcgccagcttcctcctggccgaccaggatggcccatcctcggcaatctacccgaactaatcatgactcgtcctaggtccaaatatttccaccttgccatgaaagagctaaaaacggatatcgcatgtttcaactttgccggaacccacaccatcaccataaactccgacgagatcgctagagaagcttttagagagcgagacgcagatttggcagaccggcctcaactttccatcgtagagtccattggagacaattacaaaacaatgggaacctcatcgtacggtgaacatttcatgaagatgaaaaaagtgatcacaacggaaattatgtccgttaaaacgttgaatatgttggaagctgcgagaaccatcgaagcggataatctcattgcttacattcactcgatgtatcaacggtcggagacggtcgacgttagagaactttcgagagtttatggttacgcagtgaccatgagaatgttgtttggaaggagacatgtcacgaaagaaaacatgttttcggatgatgggagactaggaaaagccgaaaaacatcatcttgaggtgattttcaacactctaaactgtttgccaggttttagtcccgtggattacgtggaccgatggttaggtggttggaatattgatggtgaagaggagagagcgaaagtgaatgttaatcttgttcgtagttacaacaatcccataatagacgagagggtcgaaatttggagggaaaaaggtggtaaggctgctgtggaagattggcttgatacgttcattacgctaaaagatcaaaacggaaactacttggttacgccagacgaaatcaaagctcaatgcgtcgaattttgtatagcagcgatcgataatccggcaaataacatggagtggacacttggggaaatgttaaagaacccggagattcttagaaaagctctgaaggagttggatgaagtagttggaaaagacaggcttgtgcaagaatcagacatacgaaatctaaactacttaaaagcttgttgcagagaaacattcaggattcacccaagcgctcattatgtcccacctcatgttgcccgtcaagataccacccttgggggttattttattcccaaaggtagccacattcatgtatgccgccctgggctaggccggaaccctaaaatatggaaagatccattagcatacgaaccggagcgtcacctccaaggagacggaatcacaaaagaggttactctggtcgaaacagagatgcgttttgtctcatttagcactggtagacgtggctgcgtcggtgtcaaagtcgggacaattatgatggctatgatgttggctaggtttcttcaaggttttaactggaaactccatcgagatttcggaccgttaagcctcgaggaagatgatgcatcattgcttatggctaagcctcttcttttgtctgttgagccacgcttggcatcaaacctttatccaaaattccgtccttaaaaacaagacgccttgttttttctctgtgatgtgtttcgacgctttgtcgtttctgtattacttgacgtactgttgtttttagactatccattgcccgaaaacgctatattgttaaaatcgtgtgtcttgtttattcttttgtatctccgtaacttaatcatgaatatcaatcaataccatatgaggtt

SEQ ID NO: 299 - DNA, 1539 bp, Arabidopsis thaliana
atggtcagccatccaatggagaaagctgcaaatggtgcgtctgcgttggaaacgcagacgggtgagttagatcagccggaacggcttcgtaagatcatatcggtgtcttccattgccgccggtgtacagttcggttgggctttacagttatctctgttgactccttacgtgcagctactcggaatcccacataaatgggcttctctgatttggctctgtggtccagtctccggtatgcttgttcagcctatcgtcggttaccacagtgaccgttgcacctcaagattcggccgtcgtcgtcccttcatcgtcgctggagctggtttagtcaccgttgctgttttccttatcggttacgctgccgatataggtcacagcatgggcgatcagcttgacaaaccgccgaaaacgcgagccatagcgatattcgctctcgggttttggattcttgacgtggctaacaacaccttacaaggaccctgcagagctttcttggctgatttatcagcagggaacgctaagaaaacgcgaaccgcaaacgcgtttttctcgtttttcatggcggttggaaacgttttgggttacgctgcgggatcttacagaaatctctacaaagttgtgcctttcacgatgactgagtcatgcgatctctactgcgcaaacctcaaaacgtgttttttcctatccataacgcttctcctcatagtcactttcgtatctctctgttacgtgaaggagaagccatggacgccagagccaacagccgatggaaaagcctccaacgttccgtttttcggaggaatcttcggagctttcaaggaactaaaaagacccatgtggatgcttcttatagtcactgcactaaactggatcgcttggttccctttccttctcttcgacactgattggatgggccgtgaggtgtacggaggaaactcagacgcaaccgcaaccgcagcctctaagaagctttacaacgacggagtcagagctggtgctttggggcttatgcttaacgctattgttcttggtttcatgtctcttggtgttgaatggattggtcggaaattgggaggagctaaaaggctttggggtattgttaacttcatcctcgccatttgcttggccatgacggttgtggttacgaaacaagctgagaatcaccgacgagatcacggcggcgctaaaacaggtccacctggtaacgtcacagctggtgctttaactctcttcgccatcctcggtatcccccaagccattacgtttagcattccttttgcactagcttccatattttcaaccaattccggtgccggccaaggactttccctaggtgttctgaatctagccattgtcgtccctcagatggtaatatctgtgggaggtggaccattcgacgaactattcggtggtggaaacattccagcatttgtgttaggagcgattgcggcagcggtaagtggtgtattggcgttgacggtgttgccttcaccgcctccggatgctcctgccttcaaagctactatgggatttcattga

SEQ ID NO: 300 - DNA, 756 bp, Glycine max
atgtacggacggagtgattcttacgaatccgatttggcgcttctggattcgattcgccgccacttgctgggagagtccgaattgatattcggagccccgaatttcggttcgggtcggagctccagtttcagcagcttggactcgtgtttgagtgatgattggggagagcttccgtttaaggaggacgattcagaagatatggtgttgtacggcgttctccgtgacgcagttaatgtggggtgggtcccatccctcgatgccggctcgcccgagagcgtctcgtcgggttttccggcggtgaagctggagcctgatgtcatgccggcgttgattaatccgtgtccgcctccggcgccggcggtggaggagaagaaggttgttccgccgaaggggaagcactaccgcggcgtgcggcagcggccgtggggaaagttcgcggcggagatcccggacccggcgaagaacggggctagggtttggctggggacgtttgagacggcggaggacgcggcgttggcgtacgaccgcgccgcctaccggatgcgagggtcgagggcgctgctgaattttccgttgagggttaactccggcgagccagatccggtgagggtgacgtcgaagcggtcgtcgtcgccggaaagtatggcggcggcggcgccgaagagaaagaaagttatggtggtggggacggtgcaagagcaagtggggagtcaagtggtggagtgtacacgtggcgaacagttattggttagctga

SEQ ID NO: 301 - DNA, 856 bp, Zea mays
tcgcactcgcccaacctcgaatgccaagctagcaagagaggcctcgatcgcagaacccagcggcaaagcaagcacgcccgtgtctacaggcagctctttccatatggcgcccaagaggagcagcgaggagcgcgcggcggcggagcaggagcagccgaggctccgcggcgtgcggaagcggccgtggggcaggtacgcggcggagatccgggaccccgtgaggaaggcgcgcgtgtggctcggcaccttcgacacgcccgagcaggccgctcgtgcctacgacgccgccgcgcgcaggctccgcgggccgcgcgccaccaccaactaccccggcgacgtcgtccgagaagcgccgtgcacggccccggctctggctgcgagcgcgagcggcagcaccgagtcgtcgtcgtcgtcgtcgtcaagggacgacggccacccgccaccgccgctgcctacggcgccgtcgtcgctcggcctgggcctcgggctcttcccggcgacggtggccacccagccgtgcctgttcctggacccggcgccggtggagagggaggaaggggagcgggagcggagctgctgctcccggtcgccgccgtcggtgctggcgggcctcgggttcgacttcgacctcaacctgcctccgcccgccgagatggtcatgtagcgttggagatagtaattctagcaaaaagggattgtgtagtaaataggaagggcaatcggtttgtgtagtagtagtgtagtactagctagccagtttgcctgtgcactagccactagccaatttgcgacttcgcaatgcaaatcaagaaatcgacgggcaaatatttttctcctgcaaaaaaattgcagtgcc

SEQ ID NO: 302 - DNA, 696 bp, Arabidopsis thaliana
aatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtacaaaaaaaaaaaaaaaaaaaaaaa

SEQ ID NO: 303 - DNA, 1861 bp, Zea mays
cccacgcgtccgagtagcaacaggagcgcaggcagaactagagcggtcttggtatggcttcttccctcgcgcccgcgtcgtgggcactgccgctgcagatgggcggggctggggcggcagcggcggggccttcctgccgcgcgacgctagccgtcgtcacggagccccgctgggccgcgtcgctgcgccgggcaagggttctcgtggcgctggcgccccggtgcgtggcgctcgacgggcccggcgccagcggcgaggaggaggcgcccaagatcgaggacgagaggaagaagagcggtgagacgaagaagccggcgcgcggccggccggtgtggagccggatcctcttcgcctccaagaagacacgaagtatcatcatcctcaacgccctcacggtcatctatgcaagtgatattccggttttgaaagaggtcgaagccctgacagagcctgcggtcttcaacatggtgcggttcgttgttgcagccatccccttcgtaccattcgcgctccgttccttcggtgaccgcagtgtacgctacgcgggactggagctgggagtctgggttagcttagcttacctttctcaagcaattggattgctctcatctgatgctggccgagcatccttcatcacggccttcacggtcgtagttgtgcctctaattgatggtcttcttggtgcttcgatccccagactcacatggttcggagccatcatgtctctgttcggaattggcctgctggaatgtggtggatctcctcccagtgttggcgatattttgaacttcttcagtgccgtgtttttcgggatccatatgcttagaacagaacaaatatcaaggagtacggacaagaagaaatttttagctcttcttggcttcgaggtccttgtggttgctttctcctccgttctctggtttatgttcaaagatggctacgttgataccagcggatccagctttgaatcttggacgttcgggatgctctgggataccacagtttcgtttccttggataccagcattgtacactggagttctttctacggtgttatgcatgtgggcagagatggtggcgatgggcgatgtttcagcaaccgaaactgcagttgtttacgggttggagccagtttggggagctgcttttgcttggttcctccttggtgaaagatgggatgacgctgcatggaccggagctgctctcgtattatgtggcagtttgacagttcagctatttgggtcagctcctgagaagtccaagaaagtcaaaaaacgcagcagcaatgctttagaaactccggtgaaacgacgagactacttatcgttgtctcccataccagttgattccgggaagatcataggaaggcaattagaaaggaagaacaaagcagtataggtagcccaactacaaggcaagaagaaaggaaacgctgcgatggtaggggcgcgcatgtaccaaatcattgtcctgaggcatcatctgtttggctccgtcaatatggggatgctgctcgattgctcctcatggggtttttttcctttgtccatattgaaaatggtcgtatttggatttctgttgtctcagttgaccgtgctagagtacctcatgcgtattaggaaatgaggcattggtagtggcaactcgaggagaatactgagacacatctactggcgtagtaatggcgttcagtgagataacttagtgtgttttgggcactgttaaccgtacaggttcatgtaaatatagtggctaaatggttctagagtactgagctgagcacaccattgtatagtactgaaataacaaataccacgcatggtattatttggctaaaaaaaaaaaaaaaaaaaaaaaaaaaa

SEQ ID NO: 304 - DNA, 1282 bp, Zea mays
ggcagacgccagcggccagccgcagcgccatggacgtagaagcgcgcaaggacgcagcgcccgcgcgcggcaaggcggtgcgccgctttctggtagcactaaactgcgggatgctggcgctgggggccatcggcgggccgctcctgagccgcctctacttcagcaagggcgggcaccggcagtggctctccgcgtggctcgagaccggcggctggccgctgctgctggttcccgtggcggcgtcgttcggcgcccggcgcgcgcgcgaccggggcgccccggtgctgctcaccccgccgcggatcctgctggccgccgcgggcctcggcgtcgccacgggcgtggacgacttcgtctacgcctacgggctggcgtacctccccgtgtccacctccgcgatcctgatctcgacgcagctggcgttcacggtgttcttcgcgttcctggtggtgcggcagcgcctgacggccgcgtccgtgaacgccgtggcgctgctgacggtgggcgccgtggtgctgggcctgcacgtctcgtcggaccggcccccgggcgtcaccaggggccggtactggctgggcttctcgctgacgctctgcgccgcagcgctttacggcctcgtcctgccgctggtggagctcgcgtacaggcgcgccgcgggcggtggccgcgccgtgacgtacgcgctggtggtggagatgcagctggtgatggggttcttcgccaccgccttctgcacggtaggcatggtcgtgaacaaagacttccaggcgatcccgagggaggcgaggcagtacgagctgggggaggcccggtactacatggtgctggcgtgggcggcggtgctgtggcagtgcttcttcctgggcgcggtgggcgtcatcttctgcgtgcacacgctgctggcgggcatcctcatcgccgtgttcatcccggtgacggaggtggcggccgtcatcttcctgcacgagaagttcagcagcgagaagggcgtggcgctggcgctctcgctctggggcctcgcgtcctactcctacggcgagtggagccaggccaaggccaagaaggagaagaagagcgaggaggacgacggcgaagtggcccaggcagtcccatgatccgtgccccacacacacaaacacaatggtctgccccgttgtactctctgtctgtgtgtatgtaaatgttgtgttgattgcggccgtgttggtcctgtgaatggcgtcctgagtcgtcggttgtcagtgatgtttgatttccagggattaatcttttgtctcaaaaa

SEQ ID NO: 305 - DNA, 2246 bp, Zea mays
ccacgcgtccggggcggaagagttgcgggaggaggaggagggtggcgggcagcggaagaaaatgggcgggatcccaagggagccgtcgttctcgcggtggtgcagggacccctctgccgcctccgcctccaataccgccgctgctgcggcgaccagtgacagcgacgcctcagaggagttcgagctgccgcttctgccatcctcctcgggcggcggcggctcaccgatggacattgaggtgggggcaacggcgagatctgatgatctgccgatctcgccgaggttgcttgcgaaggtcatcgggttgatagcgtgttggtacacactgagcacgtgcttgacgctgtacaacaaggagatgctgggaaagcacatgtggaagttcccggcgccattcctgatgaacacagtgcatttcacgatgcaggccgtggcgtcgagggccatcgtgtggttccagcaacgaggtctagagggagggccaagtaaaatgtcgtggaaggattactgtttacgagttgtcccaacagctttggctactgctcttgatataaatctgagcaacatttcacttgttttcattactgtgacatttgctacaatgtgcaaatctgcttctccaattttcattcttctgtttgctttcatgttcaggcttgagaaaccgagctttagccttcttggaatcatgctggttgtttcatttggagttctactaacagttgctaaagagacagaatttaatctatggggatttatgtttatcatgcttgctgctgttatggctggtttccgctggtctatgactcagattcttctccagaaagaggaatatgcattaaagaatccttttaccttgatgagtcatgttgccccggtgatggcaatagtaacagcaattatttccatcgtgatggatccatggcatgacttcagagcaagtcacttttttgatagttctactcacataataagaagcagtttgttgctgcttctaggtggggctttggcctttttcatggttttgacagaatatgtccttgtttctgtgactagcgctgtcacagtgactgtagcaggaattgtgaaggaagctgtcactattctggttgctgtgctattctttaatgatccatttacatggttaaaggcgcttgggctggcaataataatatttggtgtcagtctattcaatatttacaagtataaaaggttcaaaaaagggcatcacagtgaagatgctgggacaaatatccaatcttacaatgggacttcaaagtacgttatccttgatgatgatactgaagatcaggatgattcaggctgacctgaatatggtaggtaagaatgcagactactatatgcactggcgtttccagagaagcaagatcttctggtgcctgcatagacttacttccacaggctaactgatttcatactattttttgagttgatcaaccgctgtggccagtcatgcacgagcgtgacgcttgcagccgtgtgacaagttgagaagactacacgctcgtacatggaacatacaagagacaggctgataatcagtacagatgttttctcctttcgttcaaaacaaagaacggtgcatatatctgaacgaggcattctgcagtatgtccacgaagaaaatgttgcatcaattacaattagaaacacaggtaacacacttaactttatggatgaggatagggttcggttttgtagtgcattctgattgttgaagggagattcagcatcggaacatagctttcttttctttagttctttctttttttgagatgaaaaataaatagtactaacaatcttatatgtaataatgttgtatttacgggaatgtgtaccgtttcacgtaggagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 306 - DNA, 1491 bp, Zea mays
cccacgcgtccgccgccgcccgcccgggtcgcatcgcatcgcctggtcggccggggactcggggcaggcgagcgacactagctataaaagacctcccgccgcctgcgactgggccgtgtgcaagcaaattaaagcgcaaggccgatccgagggtggactgtggagggccggccatggtgatgatgatgcggtcgtgcctcggcggtggcctgctgccggtggcggtcatgctctgcctcaacgtggtggcggcggtcatggtatcgctcgtcaaggtggccatggacggcggcatgaaaccgctcgtgatcgtcaccctgcagcagctcaccgccgccgtcttcctcgcgccaatcgcattcttcaaggagaggaagtcgaggccaaagctgacgctggagatcttcgcctacatcttcgtcagtgcggcgctcggggcagctcttcgtcagtacatgatcttcgtggccctgcgctacaccacggccaccttcgtgaccgccttctccaacatcgcccccgtgctcaccttcctcctggccgtcgccacgcggtccgaagcgctggacctcaagagcaggacggggttggcgaagctgctgggcacgctggtgtcgctggccggcgccatggtgctcaccctctacaagggcgtggcgctcacccacgcggcggcagcctcgcaggaccagcagcagcactcccacggccggttgccgccgagcgccgccgacagccgcggcaagtggacgctgggcaccgtggccatcctgggcaactgcgtctgcctctcctgctggttcctgctccacggccgcctcgccaagaagtacccgcacgtctactcctgcaacgcgctcatgtccttgctcagcttcctccaggtcgccgtcgtcggcctctgcacccagcgcagcatctccccctggatcgtcaccagcaagttcaacatcctcaccgtcctatacgccggcatcgtcggctgcggcgtctcgttcgtgctggtgacatggtgcatcgagaagagaggagccgtgttcgtggccgccttcataccggtggtgcagatcatcgtctccgtcatcgacttctccatcctgcacgagcagctctacctcggaagcgtgctgggatcagtgctagtgataggtggcctttaccttctgctgtggggcaagaggcaggaggccctgcactgtcctcctcctcctcctccaaaggttgccgaagaagaccctgctgacaaagagcagcagcaagtgcagcacaactgaagacggacagcatcctctgactgttggtcgtttggttgtaacagtgccagcaataagatccctctgcctccttttcttttcttttggtgtctcaggggggtgggcaatgttccttccttctcagatcgatcaccaacaaagtgtttagattctaatccaaaacagtagaatggtcttaaatacagtactcctgcttactgatgataaaaaaaaaaaa

SEQ ID NO: 307 - DNA, 1205 bp, Zea mays
ctgtatgcttgtggaaatgggcagcagagcagctttcgtggtcgcgtttctcctgagggctatatatgcaggcacgcagatactcaccaaggctgccttcgatgaaggcatgaacacgtcggtctttgttttctacaggcatctgactggtatcctcttcttggtgcctattgcttttgtgcttgagaggaaaactgcccctccactgtcattcagagtctctctgaaattgtttttccatgcactatacgggatctctggagcaataaacatatacggcctcggtctcagctattcttcagcaacatcatcgtctgcgatatttaacctcctgccagctgtggctttctttctggctgttcttttggggatggagacactgaacttgaagcggttccacgggatcgcaaaggctgcaggcgtgttgttcagcactgctggcgtgactgtgctggcgttctaccaaggccccgcattcagatcgttcatccaccacaccgctttctcccatcacaacgtccacgctggggtcgttaccgccgctcatcctaaaagcgtctggatactggggattttcctgacgaccttgtcgactgcatcgtgggctctctggacggttcttcaggggccaatgctggaagcgtacccatccaagctgctcaacacgaccctccagatgatcttcgcgacggtccagtgcttcttcatcgccctagcggccgagagggacttgtcgaggtggaagctggcgctggacatacgcctttacgctgtgatctactctggaatacttgtctcgggagtcgcttactacatgcaagtatgggtgatcgagaagagcgggcctgtcttcttggccatgacgatgccgataaccttgcttgtcaccatcattctgtccctgtttctcggagagccggttaccctgggaagcatcttgggtggactgatcatggtcggtggtctgtacagtgtgctctgggccaagaggtctgagcaggtgcatgccagcaagcagcaaatggcagcgcctactcctcctccagcaggcgacacaagtgtaggccgagcttagcttgtttattttgcagtgactgagatcgagagaactgtgaagttctgtttttagataatggaaacctgaatgagcacatgcatcaggcccctaaggactctcctaacagctgctaaaaaaaaaaaaaaaa

SEQ ID NO: 308 - DNA, 1580 bp, Zea mays
gtgagctagctagctctagctaggccacgcactgctgcctccttcatcatcaggtcgtgctagctagctagctatagctgggccgggggacgtacgacatcagcgcgcggccatgggcgtggggaagctgatgaacgacgtgaagccatacctggcgatggtgctgctgcaggtggggttctccgggatgtacatcgtctccgtcgcctccctcaagcgcggcatgaaccacttcgtcctcgtcgtctaccgcaacctcgtcgccaccgtcgtcatggcccccttcgccctcctcttcgagaggcgagtgaggcccaagatgacgccgctcatcttcctcaagatcatggggctcgccgtgctcgagcctgtgctcgaccagaacatgtactacctcggcgcgaagctgacgtccgcgaccttcgcctcggcgctggtcaacatcctccccgccatcacgttcctgctggccctcgccctgaggatggagaggctgaggctccggagcctccgcagccaggccaaggtggtcggcacggtctgcaccgtcgccggcgccgtgctgatgatcctctaccacggcccggtggtgccgttcccgtggtccgcgggtcgtcttcaccaccacgtccccgcggcggcggtggagagccagagcagcgcctcctggctcaacggcatctgcatgatcatcggcagctgcctgtgctggtccggcttcttcatcctccagtcgaacacgctgcagagctaccctgcggagctgacgctgacgactctgatctgcttcctgggctcggtgctgaccggcggcgtggcgctcgtggcggagcgccgcgacatgagcgcctgggtcattggcttcgacacccgcctcttcaccgccgtctactccgggatcgtgtgctccggcgtggccttctacgtgcaggggatcgtgacgcaggcgcgcgggccggtgttcgtgacggcgttccagcccctgtgcatgatcatcaccacggttcttggctccaccatactgaaagaggagaccaccctgggaagcgtgattggcgcggcgatcatagtggtggggctctactgcctcatctggggcaagagcaaggaccacctcggcagcaacggcggcaagcccggcgccgcggccgtcgccgagctgcccctgacctcgtcggctcctgcttggtccaacggcaagcaagctctggccgtcgtcgagacgacaccgccttcgtctttgcccaacaagtgcgttcactgacgcgcggatcggagctccatgcatgatgcggaccgtacaccaccgcacactactagtagtgcattgccagtgactgtaagccgccggccgtgtatgatcatgcatgcataccgtcataccgatatgatgtcccatactcccatcgttgcgtttaacactctcgagtttttgataacgtacttgcgtgtgctctgctgtgtgccactgccagtgccaccacaaccaatagtctaatactactacgacaattaagctttgtttagtttgtgcaaggaaagaagagaattaattactactattcgagtcaaaaaaaaaa

SEQ ID NO: 309 - DNA, 1294 bp, Zea mays
cttttggttattttcctcttgctgtggcttaacttgacaagaagaagatgctacgtcggcaaggccgaggtggaaaatttctggaggaggtgctcatcgtcggcgggctcctgctggtgcagtgcgtgctctccggctacgtggtcttcaccgaccacctgctcgccctcggcgccgacccgctggccgtcgtcgtcgtcgccggagccgcctacgccgccttctgctttcccttcgccgtcgccctcgagaggaagcgatggccttccacggtttcggggactctggtggcgcaatacctgctcattgctcttggagggacaaccgcgtttcaagcgctgatgctgctggggatcaagaagaccacgccggccatcgcatccgccatgcccaacctcagccccggcctcatcttcatcgtcgcagcctgtttcaggctggagaggttcgacagggcgtgcaagtacacgcaggcgaagatggcggggacggtggtgtgcctggcgggagcgctggccatgggcttcctgcacagcccaacttctacctcctcctctctgcaggcggcagtagctgcggaagcagcagcaggagggggcgactactactacgactggatcctcggctgctgctgcctcgtcgccgccgtcaccgtcttcgcgctcgtcaccgtcctgcaggccgccacgctcgccgccttccccgcgccgctcaccatgtgctgcgccacctccgcgacgggcgccgctctcaccgccgtcctgcggctcgtcctggaagggaggttcctcggcatggggtcgcccaggatcgacgccacgctcgtcgcggggatcgtcgtcctcggcggggccgcggtgggcgcgtgcatggcgttccaggcgtggtgcctgggcaggaagggcccgcttttcgtctccgtcttcgggcccgtccagaccgtctgcaccgccatcctctccgcggctctcctccgccaagtcctcagcctgggaagcctcgcagggatcgtgctcatgttcactgggctctacattgtcctatgggccaagagcaacgagatctcggctgacgacgaggaacagtcgttgcagggtggcgacgacgccgagaaggcactcctagcctagcctagcaaaatccagagcgaatatcactgcacgctctgtatttgtaaaaatggaatggtgtctacgtacctgtatacatactcgagaggatttagagaaaaaggacatggctacgtttgttcataatatgtatatactggaaatactccctcccaaaaaaaaaa

SEQ ID NO: 310 - DNA, 1490 bp, Zea mays
ctcctctctgcttctcggcctagctagctagctcggtgcctcggccaaccgggcgtcgcgcgctggccggccggcctgccaggcgagaactagctagcagcgcaagcaacaatggcagattcaggggaggggcgtcgggtgtgcggcatgccggagaaggcgcagctgcacgtggcgatgctgctgctgcagttcggctacgcgggcttccacgtggtgtcgcggctggcgctcaacatgggcatcagcaagctcgtcttccccgtctaccgcaacatcatcgcgctctgcctgctcgtgcccttcgcctactttctcgagaagaaggacaggccgcagctgaccctcaacttcgtcgtccagttcttccttctcgcgctctgcggcatcacggcgaaccaagggttctacctgctgggcctggacaacacgtcgccgacgttcgcgtccgccatccagaactcggtcccggccatcaccttcgccatggccgcggcgctgcggatcgagaaggtccggctggaccgccgcgacggcgtggccaaggtggcgggcacgctggcgtgcgtggcgggcgcgtccgtcatcacgctctacaagggccccaccatcttcggtcccagcggcagcggcggcggcggcggcctcgagctggcggcggtgggcggcgacaagaactggacgctggggtgcgtgtacctgatcgggcactgcctgtcgtggtcgggctggctggtgctgcaggcccccgtgctgaagaagtacccggcgcggctgtccgtcacctcctacacctgcttcttcggcgtcatccagttcctcgtcatcgccgccttcatggagagggacgcggaggcctggaagttccactccggatccgagctcttcaccatcctatacgccgggttcatcgcgtccggggtggcgttcgcggtgcagatctggtgcatcgaccgtggggggccggtgttcgtggcggtgtaccagccggtgcagacgctggtggtggccatcatggcgtcgctcaccctgggcgagaagttctacctggggggcatcatcggcgccgtgctcatcgtcgccggcctctacctcgtgctctggggcaagagcgaggagagggcgcgcgtcgccagggacgccgtctccggcggcgaccgcgaggggctccttgtcgcggcagccgccggaggtggtggcggcggcatcatcaggagcgccggcaataaggtggcgtcggccgcgacgcagcctctcctgctgccgtcctccacctccactgacaacgtctgaccgatccatggatggatgaatcgtcatccatgcttgcttggtgcgtggagatctgaggcagcatgcagaattaccagttattagtcatttctttgaggttttcccctgttgattttcacgcatgtatgtatgctgctacctacgtgtacgtacgtatatgcatgcatcactatggttgttttacgccaaaaaaaaaa

SEQ ID NO: 311 - DNA, 1774 bp, Zea mays
gacttccctggctgtcatggacaagcgcattatgccctcacgagataagttaacagggctagctgctaggtggttgctgcatactggtcttccctctttctcttgccacctcgggcatcctctctggcttagaaaaaaaatatgcgcttcatagtccatacctagatcttttggtgttcagttttggtttcaagccatggcgaattctcggattggacgttacaagatgtctactctctcagacccctcaaaagaagatacttcacctgagggttcaggtactacccagagaaatggagcctggagtaacacattgaacactcttctgcagcaagcctcagtatatggtgtggccgctgggtattgtttatcagcgtccctgctctcgatcatcaataaatgggcaatcatgaaatttccatatcctggagccctgacagctctgcagtacttcactagtgttgctggagttctcctatgtggacagctcaagctcattgagcacgatggacttaacttgaggacaatgtggaagttcttacctgctgctgtgatgttctacatctccatcttcacaaatagtgaactcctgcttcatgccaatgtggatactttcattgtgttccgctctgctgtgcctatatttgtcgcgatcggagagacgctgtatcttcatcagccatggccatcgctcaagacatggctttcactctccacaatacttggtggaagtgtgatctatgttttcacagacaaccaattcactgtgactgcttacacctgggcagtggcctacctagcaagcatgtccattgatttcgtgtacatcaagcacgtcgtaatgaccattgggctgaacacatggggccttgtgctatacaacaatctcgaggctttgatgttattcccccttgagctccttataatgggagaatttgatcagatgaaggtcgacagctccaaggtgtcaaactggctgtcattcgatgtggtcctccctgttgctctttcatgcctgtttggactatcgatatcattctttggattctcctgcagacgggctatttctgctaccgggttcacagtgcttggcatagtgaacaagctcctgactgttgttattaatttgcttatctgggacaagcatgcctcttttgtgggcaccattgggctcttgatatgcatgtcaggtggcgtgctctaccagcaatccaccatgaagccgaaggcgcccaaggttgagccgaaggaagagaacgacaacgacgaggagcagcagaaattgctgcagatgcagggtgttcaagagagcaatccaactcagaaataaagctcttcataaaccttacaacgaagtaatgctttgatggattaccttctttgcaacagcctcacctgaaacgtttttgtattggctaatacttggaaaaaagcatatggatgagtagtcatgaattaggagctacaaaatatcatgtttttgatattagaagtcgtgaggggacctaattatcactatgcaattctttattactgtattaccacttacatttgtaacgcaaaatcgttatgataggataccaggtactcggcaaatacctgcattgaatacttcctatacaaaagcatccgtctcatacagttcgggggtgacagtggtagtatgatctgtttttaggcatttctctgctggagttagcctatatgttctgtaacttattgttggtgatgaagacattggttcttgtgctaaatagagttttcttatcaaaaa

SEQ ID NO: 312 - DNA, 1467 bp, Zea mays
cggacgcgtgggccagcagcagcccatccgaccccccgcctcctcctcctcctcctcccgggttcgcgtgaggctgtgtgctgctgggaggcggcgccggcgccggcgccatggaggcggagaagaagccgccggcggtgtccgacgtgggcgcgtgggcgatgaacgtcgtcagctccgtcagcctcatcatggccaacaagcagctcatgtcctcctccggctacgccttcgccttcgccaccacgctcaccgggttccacttcaccgtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggattctaccagatctccaaactgagcatgattccggtggtctgcctcatggaatgggtgctcaacagcaagcactacaccactaaggtcatatcggcagtcaccgtcgtggccgccggtgtcgggatttgtactgtcacggatgtcgaggtcaatgccaaggggttcatctgcgcttgcgtggcagtgttctgcacgtcgcttcaacagattacaattggctcctttcagaagaagtacaacattggatcatttgagctgctgagcaaaactgcgccaattcaggcactttcactcattatactgggcccctttgtggactactatctaaatggacggtcattgttgaactaccctttttcaggaggggcaactttcttcatactgctttcctgctccctggccgtgttctgcaacatgagccaatacctctgcatcgggcggttctcagcgacctcgttccaggtcctgggccacatgaagaccgtgtgcgtgctgatcctgggctggatcctgtttgactcggccctcaccgtgaagaacatcctcgggatgctgctcgccgtgatgggcatggtggtctacagctgggccgtggaagcggagaagaaggcggcagccccgatcccccggaacaagggcggcatgctcgacggcgaggacgtgcccctcaaggccagggtgagcggcgtgcccgcggtcgacctcgaggacggcgacgtgaagggctagccgctgatccgttcattcttctcgttcttttgtaactgtgcgcgcgcggtcgctcgatgcaaagttgcttgttcgtcggttctcagctatcgacactacactgttaattttgttggccccttgttggggggagtctgctcgtaggtgaccccccccccccctcccccgggttcgacgtagatgaaacacacgcgggcagattgttaggatttttcaggcggggaggtggcgacatgctgttatagatggtgacaagactttatataatggaaatgcaggtgtttttgaaaaaaaaaaaaaaaaaaaaaaaaaaaaaaaaaaa

SEQ ID NO: 313 - DNA, 1269 bp, Zea mays
tagcaatgtcggggatggcggcgcgcatcggcgagtggaagccggtgatggcgatgctcatcttcgacctcatctccgccgtgacgacggccctgatcaagaaggcgctgcaggaggggctggaccgcctggtgctcatcacgctgcggcagctcgtggccaccgtcttcctcgcgccgatcgcctacttcagagagcggagcacgaggcctaagctgacactggagatcctagtctacctcttcttcagcgcagcgtttggcgccgctctctcccagtacaccttcttctacgggctgcagtacaccaccgcgacgttcgccataactttcaccaacgtggctcctgtgctcactttcctcattgcagtcttgctaagggtggagtcactgagcatgaagaacaaggcaggagcagcgaagatcgccgggacgctgacgtcgttcgccggcgtcatgctcctcaccctctacaagggcgtctcactgacgcaccagcaagctggagaagcgagcccggaggatcacaacctcggagcagcagcagcatcgccgtctgacaggaagagctggacgctgggcaccctggcattgctcgccaactgcctgtgcttctccttctggctcctgctgcagtccaggctgaccaagaagtacccggcgctctactccagcacggcctacatgttcctcatcagctcgatgcagggaggggccctcacggcggccattcagaggcgagcgtcggtgtggcttctcacaaggccgatagagatcgtcacggtcttatatacaggaatcatggggtccggagtgggctacgtgctgatgacgtggtgcgtggagaagcgagggccggtgttcacgtcagccttcatccctgtcatccagatcatggtcgccatggtcgacttcttctttctccatgagaatctctatctcgggagtgttctgggatccatactcttgatcctgggcctctatattctgctgtggggaaagaagagggatgcctcatcatcagcggctgccaaggaagaggaagatggagagaaagaagatgaggaggaggaggacaaagagaagcaagtcagatcatgaggaccagaccactctcatatatatatatggattaggaccaaattaaagatacagttcttcggactgtgtgatgatctatacttgacagagatatatatatatatagtatttgtttaatatataactctgctagtatatatagtatttgttctgaattcaaaatcaaaaa

SEQ ID NO: 314 - DNA, 1622 bp, Zea mays
cccacgcgtccggcaagcacactgctcctccctccccagccgcagcacagcagagcagagccgagtttgctgctgctgacctgacaccatcgtgtgcccctctctcggtccagaaggacgcgaaccgcgctcgtagagtgtggcagcaatggcggtcgtcgccggagacagcgagtcgctgatgcagcggtgcaagccgtacgtggcgatgatctcgctgcagttcgggtacgccggcatgaacgtcatcaccaaggtgtcgctcaaccacggcatgagccactacgtgctcgtcgtctaccgccacgccttcgccacgctctccatcgcgcccttcgcgctcgtgctcgagcgcaaggtccgccccaggatgacgctctgggccttcctccagatcttcgtcctcgcgctgctcgggccggtgatcgaccagaacttctactacgcggggctcaagttcacctcgccgaccttctcctgcgccatgagcaacatgctccccgccatgaccttcgtcctggccgtgctcttcaggatggagaaggtgaacctgaagaaggcgaggtgcgtggccaaggtggtaggaacgctcgtgacggtggccggcgccatgctcatgacgctctacaagggccgcgtcgtcgagttggtctggaccaagcacatacacctccacggcccgcacccggacgccgccgctgctgccgccgccgccgacaaggactggttcaccggctccattttcctcatcatcgctaccctcgcctgggcgtccctcttcatcctccaggccgccacgctgaagaggtacgacgcgccgctgtcgctgaccaccctcatctgcttcgtgggcaccctgcaggccatcgtcgtcaccttcgtcatggagcgcgagccctccgtgtggaggatcggcttcgacatgaacctcctagccgccgcctacgctggcatagtgacgtccagcattgcctactacgtgcaagggctggtgatccagagccggggccctgtcttcgcctccgccttcagccccctcatgatgatcatcgtcgccatcatgggctccttcatcctcgcagagaacatctacctcggcgggatcatcgggtccgtgctgattgtcgccggcctgtactcggtgctgtggggtaagcacaaagagaacgaggagaaggagggagaggcggccatggagatccccgtggcgatcaaggccgtcgacggcaatggcaggatcatggagatcgtggagctggacgaggtgcagctggagaaagcccaggccaacaccaacgccaacgccaacgcggccgtcgccgtcacggcggtccccgcggcggaggcccggatgcagggcaaggacgaccaggcttaagctacaggagatgcgccgatcgacgggtcgatcgcgcgcgtgcgtcatcttagccctcctgtgctgtgcttttgtgcgtcctcttctcccccggccggcccatgatagatgtgttgtagtgtggggcgacctgatgctttaagctagcgacgggcagtagtagtgctagctgtagtagtgaagtggtgccaagatggaagctgaggaggatgcaatataatgatgatggggagttttgtaaaaa

SEQ ID NO: 315 - DNA, 1272 bp, Zea mays
aggtcaccagttcggtcctgcgctctcgagtcgagactccaccttccattcatttcatctgctccatctctctctttgttcgccggcgtataataagcttcccctttctgcaactgatctgatccgggctgccgtgagctctgctcgccctgatggagttcaagagggatgtatggagcctgctcctcgtgctgctcctcgggcagctcgtcgccttctccatggccgcctcaagctttgcctcctccctcattgctaatcttggagtcgatgccccactgacacagtctttcttagcctacctgttgctgaccttagtctatgtaccaatcgtcctgcgtcgacggcagaagctgcaaatagcttggtactggtacctagctctggccttctttgatgtacaggggaattatcttgttgtgaaggcgtaccagtactcatacattaccagtgtgactttgttggattgctggactgttgtatgggtcgtcatgctcacctggtacgcactgggcacaagatactcactctggcagttcgtgggggcagggacatgtgtggcagggctcgcccttgtgctgctttcagatgcaaaatctcaagatgagcaagatccgaaaaaaataccacttctgggggatgcccttgttattgctgggacagttggttttgcgtttagcaatgttggggaggaatactgtgtcaagaaaaaggatagagctgaggttgttgcaatgcttggtctctttgggttgctgatcagcacagtgcagatacttgtatttgaaaggaagggcctagaagcagttacatggtctccaacaatgataagtctgtttgcaggatttgcagtggcaattttcgtattctacacagttgctcctttcgttcttaagatgagtggagctacattgttcaacctttcactgctaacatctgacatgtgggcagtcgccattcgagttttattctatcagcaagagataaacaggttgtactacctagcattcacagttgtggccattggattaatcatctattcgttgaatgatagatcttcagatgatgaaacagctggaagtacagaagcaccagcccaatatcagcaacttccaattgaagacaattcaacaagaattggttctagttcaggtagccaagaaaggacacataaggaagaagttcatatctgttagtgggataatgtattaatgtacgaagacacttcattgtcaatgcatggatttttactaaaaaaaaaaaaaaaaaagc

SEQ ID NO: 316 - DNA, 1891 bp, Zea mays
cccacgcgtccgctctctcatctgtaggatgtaaaaaactcagccaggaaagctgctgaaactgttctgttggttattgatgaggaaggagttgaaactttgatacctgagcttctaagaggaatcactgacagtcaggcatcaatgaggcggggctcagcctacctaattggtttcctctttaaaaacactaaactatatttggctgatgaggcttctgatatgatgtcaaccctaataattttgttgagtgatacagacaaggctactgtatcagctgctttagaagcattttcaagagttgttgcatctgttccaaaggaacagctcccaacacacataaaactagtgcgcgatgctgtctctacagccagagataaagagcgtagaaggcgaaagggtgtgcctattcttctgcctggcttatgtctttctaaagcactgcaaccttttcttcctatatttcagcagggtttaattagtgggtcggccgaaacaaaggagcaggcggctgaaggtctaggagagttaattgatgtaacaagcgagaagactcttaaggaagttgtagtgccaattacaggacctcttatccgcatccttggtgatcggtttccatggcaagttaagtcagcaatcctatcaaccctgacaatcatcatcatgaaaggtggaattgcacttaagcccttccttccacaacttcaaactacattcgtgaaatgtctacaggataacaataagtctgtccggacgagggctgcagctgctctcggaaagcttagtgctcttagcacacgggtggatcctttagttagcgatcttctgtccatgttgcagtcaggagatgaatctgtaaaagaaagtgtgctttctgcactcaaaggtgttatcaaacatgctggcaaaagtgtcagtgctccaataaggtcacggggatgtgctcttcttgaagatctgctgcaggctgaagctgatgatatccgcagttgtgctgcaaaagtgattggcacattgtctcagtacatggatgacagagagattccagatttggtgcaaatccttttggaagtgggcacctcatcggactggtgtaccaggcatggtgctttgttagcattatcatccatatcaatgcattctccatcaaaattatgtgatttggcatcctttccatctctggttgatcttctgaaagattctcttaaagacgacaagttccctgttcgtgaagttgctacaagaactctgggaaggatactcgttttcgagctacagtcagaagctgacaccttgcaacttgttcagttgcttgtcttggccttgcgtgatgattctagtgaagttaggagaagatctttgtcgtgtatcaaagctgctgcaaagatgaaccattcagctcttgctacacatcactctatattgggcccggcaattgctgatgctttgaaggactctagcatgcctgtacgtctagcagcggaacggtgtgcccttcatgttttccagttgactaaagggccagataatgttacaacagcgcagaagtacctaggcatgactggcttggaagtgaagaaaatcgcaaagcttaacgaggagagtgatggcagtgagagcagtgatgatgacaggaggacatgacctctactcacagcaagcttgtatcggttcagttattatgatctttatatatagttaggcaagttagctacattgacagtggaaggtggggtcattttttgttctgtctgacccattttgtgaacatcctttttgacaacaaatactggcagaggaagacacgtcggcatttgtcatattttgttgcggcaaaccgacaatgtttatggaaaccaacaatttttgttaaagttattcaatcaaaaaa

SEQ ID NO: 317 - DNA, 1519 bp, Glycine max
ggctcgagcaaagactgaaggcaaaaaaaacagagaaaggtctggctctgaatgatggatagaaggcactgttacaaggatttgctgccattggtggtgcttgttgccaatgaatgcaacaacacaggcttgttcactctcttcaaagcagccacactgcaagggatgagtaactatgtctttgtcacctatgcctattctgttgcctttcttgtactacttcctgtcacttttttctacagaagatcaagagtggttcctccactcactttttccatcctatccaaaattgcccttcttggagtgatagggtgttcatctcagatcttggggtatgctggcatcaggtatagttctcccacactttcctctgcaatcagcaacctcactcctgctttcaccttcgtgcttgcagtcatttgcaggatggaaaagatagctgtaaaacgtagaacaacccaagctaagatattgggcagcataatatcagtattaggtgcatttgttgtgactttctacaaaggccaatcggtcatcatagctgataattccccttccattcaacttccacaatcaaatggcattcttacttcagtggatagaaattgggtcattggtggccttctgctcacagcttgcaatatactacttactgtatggttcgtttaccaggttgaaatcttgaaggagttcccggatgaactatctatggtcttcttttacaacttgtgtgcagccattgtagcatcaattgtaggcttattaggggagaaaaattcaagtgcatggaaaataagaccagatatatcactgatctctattgtttgcactggaatatttaacaagttcctgagtagtgcaatatatgcttggggaatacacttaaaagggcctgtgtatgtagcaatgttcaagcctctctcaattgttattgcggttgccatgggtgttatgttccttggtgattctctatatgttggaagtataattggagccacaataatatcaattgggttttatactgttatgtggggcaaagcaactgaacagaaggaagaggagggggaggaggaaaatgttggtagccaggaatcatcaattactgagaacgttcctcttttgcaaagctatataactgtaaattctacgaagaaaatagatggaagtgtatagacagctgaaatgagaagtttcctcttctgcaaaaccaaaaaatttgtaaattctgaatagaagacaggtggaagtgtatagaagacaaatataaactgtttgcacctctttagtcttgacattgtagaaaatcatagagaccattttttgtcacagaacagcacattgtaactttcagtaatttatgaaaatacaattctcccatacttactataggttctagttgcagaagcagcctagacaatgggagcatcatgtacctttatacttcagatacaatagtcaatatttctaaggaatgaagccccaaagaagtatcataagttcaaaaaaaaaaaaaaaaagg

SEQ ID NO: 318 - DNA, 1405 bp, Glycine max
gaattcccgggtcgacccacgcgtccgcccacgcgtccgcccacgcgtccgcccacgcgtccgcccacgcgtccggcgagaagacgacagaaggggaaaaaggatgaggtagagagaaggtgggagtggcagagagaagattacaaagaaatggggagatgggtgaattgtaggggcaatatattcccattcctggggatggtgatggctatgctagctcaaagtggaagcatggtggtaatcaaagttgccatgactgatggaataaacaaatatgtcatggttgtgtactctttggcactctccaccatcttgcttcttccctttgccttgtttcttcacaggtcagagcgtcctcctcttacattctctgcactttgcagtttcttcttgcttgcattctttgggagttcaggacagataatggcttatgttggcatagatctaagctctcctactcttgcatcagccatgcttaatctcattccagctttcacttttatacttgctctcatttttaggatggaagaagtacattggaaacattccagcagccaagccaagttcttaggaacaatagtatcaattgctggagcatttgttgtgatactgtacaagggcccacccatctttaagacacatttgtcaaactcttcgaacaaatttctattttcgcagcaactaaactggatcttgggagggatgttctgtgctggcgattctatagtttgttccctgtggtacatatatcaggcttcggttgcatacaaataccctgctgtaacaaccatagtattcttccaactcttattttcaaccattcagtgtggagtatttgccttaattgtagttcaagatcaaacggaatgggagctgaagttagatattgggttgattggcattgtatatcaggcaattgctgcaacattgatacgttacatcttatgcacgtggtgcgtccttaaagctggacctctgttctgttctatgttcaagcctgtggcaatcatcttctccgttttcatgggtgcaatttttctcggggatgacttaagccttggaagtttgattggtgcggttataatcgtgataggattttatgccgtactgtggggaaaatccatagaagataacaagattgagaaaggggttgagaacttggagtcatcgtgccataatgttcctttattacaaaataggacgtaacaggtaggttgaatatttgacatggagaacaatgtgatattgcaaaacacttaaaaagttagttagaagttgtaatgtttatgtattggtttttcatgtatctatttttaataataataatatttttgagaaaaatgttttccaaaaatattttttagccaaaaaaaaaaaaaaaaaaaaaaaaaaaaaaagcggccgc

SEQ ID NO: 319 - DNA, 1589 bp, Glycine max
gaattcggctcgagccgaaattctgatctgtgagaatgggaaaaggtggatctctgagcgacggcgtggtgaagaagatcgttctctcctacagctacgtggcaatatggatcttcctgagcttcaccgtcatcgtctacaacaagtacatcctggacaagaagatgtacaactggcccttccccatctccctcaccatgatccacatgtccttctgcgccaccctggccctcctcctcgtccgcgtcttccgcctcgtcgagcccgtctccatgtcccgcgacgtctacctctcctccgtcgtccccatcggcgccctctactccctctccctctggctctccaactccgcctacatctacctctccgtctccttcatccagatgctcaaggccctcatgcctgtcgctgtttactccatcggcgtcatgctccgaaaagaatcctacaaaaacgacaccatgcttaatatgctctccatctccctcggcgtcggcgtcgccgcctacggcgaggcccgcttcgacgcctggggcgtcctcctccagctcggcgccgtcgccttcgaggccacccgcctcgtcatgatccaaatcctcctcacctccaaggggatctcgcttaacccaatcacttctctctactacgtcgcgccgtgctgcctcgtgtttctctctattccgtggatctttgttgagtatcctgttttgagagacacttccagcttccacttcgatttcgtcatcttcgggaccaactccttctgtgcattcgcgctgaatctggccgtgtttcttcttgttgggaagacgtctgcgttgaccatgaatgtggccggtgttgtgaaggattggttgctgattgcgttttcgtggtcggttattaaggacaccgtgacgccgataaatttgttcggctacgggcttgcgttcctcggcgtggcgtattacaatcactcgaagctgcaggcgctcaaggccaaggaggcgcagaagaagaccgcgcaggcagatgaggaggaagggaggttgctcgaggacagagatgacaacaagaggaacgaacagcagacttaacttttatttatttttaatcgttccctgttttattttacacagattcaagaaaggaaaaaaacaaacaagaggtttggtttggttttcgaggcaaatatggaaatgtcatcgtcctctctgggcatattgccggttcggtattgtttttttagttgctagatcttcttcacgttgccaatgcggtgggtagttaattagtagatatgggtttgagatttgagaacaattatgtgttactagagctagagtctccaatccttttattattattattattattattttcttttatctcattcccgttttcggtggttttgttttatgttatgttattgtaggaactcgatttatggagtttacatgcttcttattaattcatagtacatttcaattctgtgtaatgtgaatttgggatttatcttatagccaagctgtctgacaaatttcacttggcactgtgttccgaattactctgtttcggttgtaaaaaaaaaaaaaaaagggcggccgccg

SEQ ID NO: 320 - DNA, 1535 bp, Glycine max
ggctcgagattatattatccgattcagaattgtgtggactggaaactcctctgtccccaaacaggacgatgaaggaactgggcttggtttcaatgatgctgatggcagagttgttggacgtgatcgtcaacactctaagcaaagcagccatgaagaagggcatgaatgactttgtattcatcatgtactccaatgccttcgctgcatgcctcctccttctcttagccttattcttttataggaaaagaacacttccgccactctcctgtaacacccttggcctattccttgttgttggcatgctcagttgcattaatcagtcgatcaagtttttcggcataggttacagctctccaactttggcctcagcactgtccgatttggtgcccgcctttaccttcatacttgccgtcatcttcaggatggaaaaattagattggaaagctaatagcactctggccaagtccattggcacagtggtatcgatcgctggggcattgttattgtctttgtacaaaggccaagtcatcataaataataatccaccttttaaattgttccctcaaaaacttgtctcatccatgcaatttgactgggtatttggggcactgttgcttgcagctcatagctgttttctctcaataaactacattcttctgacacggatagtgagagaataccctgcagaactggtggtggtactcagtcgcattgcattaacatctatactatctgttcctgctgcactgatttcagtaaaggatctaaaagctttgagactggggtttaatatggagcttatagctattggatgttcagcaatttttgtcttatcctttcgaggtgttatccatatatggatcatggggaagaggggccctgtctatgttgcaatgtttaagccactcgaaattgtcttcgcagtcatcttgggggttacttttcttggggactctctttatattggaagtgtgatcggagctgccataatagttgttggtttttatgctgttatttgggggaaaagtcaagagaaggtggaggaagattgtacagtctgcagctctgagtcatatgataatgaggtccctcttttacagaacaagagaacgggggaataaaatcttcaggaaatgatttatatactttctgcttgtaagcaaagaacgatggcagaaaaatttcaatattcttgtttcctctaaatctgtttccctgggcctgcaagaaatagatattggtcaccgaggacatgaatagaaagattgcataatttgcacaagatattgattttttgggtgccacttattccctacatccaccgagaagggtcagagcggattacaattttctgccattgctgagttgaatgcacacaaatatcaatcagtttgacctttccttctttatttggttcttgtggactttcggatttcacctccagttgttgtatagatcgtctaccaatattatggaatgtgctgtgaaataattaattttagttcttaacaaaaaaaaaaaaaaaaaaaaaaagg

SEQ ID NO: 321 - DNA, 1514 bp, Glycine max
ggctcgagacctttgcaaaccctttccaacaattagcaaaacatttgttaaacgatggaagtaatgtgtggtgccaaagttggcaatatggtccataaggccaagccttatgtgttaactgtggggttgcaatttgggatggctgggacatacctcttcaccatggccagtttgaaccatggaatgagccgtttggtgttcattgtgtatcgcaatgccattgctgcattggcccttgctccctttgccttgatctttgaaaggaaagttagaccaaagatgacatggactgtcttcatacagatattagtacttggatttcttgagccagtggttgaccaaggattcactttcttggggatgcaatacacttcagcttcctttgcatccgctgttatgaatgccgtgccctctgtaacctttgtgcttgcagtaattttcaggttagagcatataaaaataagggaattacgcagtcaagcgaaagtaattggaaccttagtaacctttgctggggctttgttaatgacactatacaaaggccctcaattcgacctatttcatcattcaaacacaacccaccaacaaggtggaagccacactcagaatcactcacactgggtcgcaggaactctcttcatttgcctgggttgcctggcttggtcttccttctacatattgcagtccataacggtgaaaaggtaccctgcggaactatcactctcatcgttgatatgcttggcgggtgctttgcaaagtgccgtggttgctctgattgcagatcataaccctcgagcatgggctatcggttttgactacagcctctacggtcctctatacactggaataatgagttcaggaatagcatattatatacaagggttggtaatgcaaagcagaggtccagtgtttgtaacatctttcaatcctctttgcatgatcattgttacagctttgggctccttccttctaggagaacacctctacttgggaagcatcattggaggcatcataatcgcagtgggtctatactctgtggtgtggggaaaaggcaaagactataaagatgacacgtcatcaccagcaacaacaaaagaaacagaaacaatgcagcttccaattaccttaccaaataataaataacagacactttgtgttaacttatagaaaagaaaaattacatagtaattcgatcgacttatgttggcggaagtgaccgatgatagcgtaatttgcaaatcatatagtgatttgttgtgctggtgtgggcactatatttagccatgttaagttgaaacacgactttgtttaagttaatactaatttgttagaaagtgttttgctatcgttaattattccaagagtttaaattgttaatcaatgtgtaattttattttcttcctgcttttgtattttttttatcatgatatatgatatattagtgcggaatatttatcacgatgaaatcagatagctggtttaataaaaccaaaaaaaaaaaaaaaaaaaaaagg

SEQ ID NO: 322 - DNA, 1596 bp, Glycine max
ggctcgagacactacccactcaactcactccaaccatggcgtcgtggtggtgctcctctccctccgccaccctcaccgtctccaccaccaccacccgccacttctctctcctttctcacacttcccaatttcgcatccaaaccctcacattcccaccttcctcctttactcgcttcaccaccgctccaccttcgctccgatttagggttccatgctccaacaaaaccgccttcgaaaccgagcttccggaggacggcgtggattgcgtgggaacaggccaagacgtggaatgcctcgttaacacggaagagaaacaatcggaaccatcatcatcgtcatcatcatcatcatcatcgtcatcgatgctgtgtctcgcggaagcgctgtgggaaggggcggtgttggtgtcgccgttcttcttctggggcacggccatggtggcgatgaaggaagtgcttcccaaatgcggtcctttcttcgtttccgcttttcgcctcattccggcggggtttcttctcgtcgcattcgccgcttccagaggaagaactctcccctctggcttcaacgcttggctttccatcaccctcttcgctctcgtcgatgccgcgtgctttcagggttttcttgcagaagggttgcaaaggacttcagctggtttgggcagcgttataattgattcgcagcctttgactgtggctgtacttgcggctttgttatttggtgagtcaatcggagttgttggagctgctgggcttgtacttggtgtcataggacttgtactgctcgagttacctgccctatcatttgatgaaagcaacttctcactatggggaagtggtgagtggtggatgctacttgcagctcagagtatggcaattggcacggtcatggtccggtgggtctccaagtactctgaccctgtcatggctactggatggcatatggttattggtggtctcccacttgtgctattcgcagttcttaacaatgaccccgcagtgagtttgagtctcaaagagtacagttcgactgatatattggcactcctctacacatccatttttggaagcgcagtcagctatggtgtgttcttttatagtgcaactaaaggtagcttgaccaagctcagttcacttacgtttttgaccccaatgtttgcttcaatttttgggtttctctatcttggtgagaccttctctcctgtacaactagttggggccttagtcactgtggctggaatatacatggttaacttcagaagcacatctgaatgaattgtcatttttgcctggttctttcaacctaatccaatggaaaacaactctgggaattagatgttttccatgaactcaaattgggaacgataaaagcaagtttggacatggagaggagaaattgcagtgatatacaacttggagcccttgtgctcatgctagtgtaaatacaattttgttttgttagttaatttaggcctcgagcctcttcctatgcaatatataccaaaaacttgaagttacctgggcagaacacaagccttatatcggaataaattgtttccgtaaaggtttttttgttgtaaaaaaaaaaaaaaaaagg

SEQ ID NO: 323 - DNA, 1623 bp, Glycine max
cgcaaacgcaactcagctttccttcgatccctgaatctggacgttactaaagcagcccagccatccacgcaccattttaaaagccaacacagaaagcacagaaccaccacatcgttgccttcctctaaacgataaatttttgggattctgaaactagtgatacattttcttgcatgaaggcagcgtattgaggaattcagttagtgtattggaagatctagttcaacatgtcttctgtaagcaagggtgataggaaggcttccattgatgcagcatcatggctgttcaatgtggtcacgtctgtgggaattattcttgtcaataaggccttgatggctacatatggttttagttttgctacaactttaactggtctccattttgccacgacaaccttgttgacactcattcttaaatcgttgggatatatccagacctctcatcttccattatctgatataatcaaatttgtcttgtttgcaaatttctccattgttgggatgaatgtgagtttaatgtggaactctgttggtttctatcagattgctaagctgagcatgattccagtatcttgcttcctggaggttgtcttggacaatgtacgatattcaagggacacaaagcttagtattgttttggttttgctcggcgttgctgtctgtacagtcactgatgtcagtgtcaatgcaaagggtttcatagctgctgtaatagcagtttggagcacagccctgcaacagtattacgtgcattttcttcagaggaagtattctattgggtcatttaacttgttgggccatactgcaccagcacaggcagcaagtttacttctagtaggcccctttatggactactggttgactggcaaacgagttgatgcctacggctatggtttgacatccacgttgttcatcattctgtcttgcactatcgcagtagggacaaacctcagccagttcatctgcattggtaggttcacggctgtaacgttccaagtccttggtcacatgaagactatcctggtcctgatcttaggattcattttctttggaaaagagggtctcaatctacatgttgttctaggcatgatcatcgcaatagcaggaatggtttggtatggcagtgcttcttccaagccaggggggaaagagcgtcgtagcttttccctccccaaaacacaagattatagttcactacctgtgtcctctgaaccagatacgaaggaatagaaaataatagaaactaattagagaaaaagtgatgaaacttctggtgaactgcatgaaaaaaatcaggtgcccattaggcgagctggttcattttctttataccaggagtgaattcccaattatttatagatcatggttatatcttttcttatgtgttaatgaattgtttgggaaagaaatgagaggaaacagcgttaagggatggaaaaatctacgttatgttcctttttttttatgacagaaaatgttactgttacttttatagtaaaagtttaattccatttttcccattagggttggttccgttgttaccttctactcatgacaactattagcatgtttggattacctagttatgaaatgttttactctataaaatacttttgaaagtttt

SEQ ID NO: 324 - DNA, 1452 bp, Glycine max
gaattcggctcgagactccgcaatgctgatttccattctctcttagtgtcagtcttattcctcccgaacccgaaattcagtccttaaatgataaataatatcccagttgtttctgctaaacttgggggagtaggaaaacatggccactttcgagcaattttggagcagaaaaacgttactaggtcttgctttgggacagtttctttctctcctcatcacttccactggtttcacctcttctctattggctaaaaaaggaattaatgcaccaacttctcagtcgtttctaaactatgtgttcttggcaattgtctatgggattattgttctatacagaagggaagcactcaaggcaaaatggtattattacatacttcttggattggttgatgttgaagcaaattttcttgttgtgaaggcatatcaatatacatcactaacaagtgtgatgctgcttgactgctggtccatcccatgtgtcatgctttttacatggattttcttaaaaacaaaatatggattcaaaaaggtcactggtgtagttgtttgcattgctggccttgtcctggttgtattttcagatgtccatgcaggcgaccgggcagggggaagcaaccctagtataggggacattcttgttattgctggtgctacattgtatgctgtcagtaacgtcagcgaggagtttctagtgaaaaatgctgatagagttgagttgatggcaatgttgggactctttggtggcattattagtgccattcaaataagcatacttgagcgcaatgagctcaaatctattcactggtcagctggggcagttcttccttttgttggatttgcggtggctatgtttatgttttactctttagtccctgtcctacttaagatcaatggttccactatgttaaatctgtctctattgacctctgacatgtgggctgtcttaattcgcatttttgcttaccatgagaaggttgattggatgtactatgtggcctttggtgctgttgttgttggtctcattatctactctggtggtgacggagatgagaatcaagaccctcatcatgttgctgaagatgctagccaaagacaacatgatgaagaagctacttcaggtaaatcataatataacagcagccaggctggaagctcaaaacactaagcacgcctgaagaggtgcttgaaaggtaaaaccatgacagagtctcctccaaagatgaagattttacttccattcaatttgtgtagatggaattttgagtgttttggacggttttttgaaagttggtactagatttttagtgaacatagtttgctaaatatgatatttaattatttttgaagaaaatctataagaaagattttcggagataataagtaacagccgtttattttttcgtatgaaatttgggatgttcgattaaaaaaaaaaaaaaagggcggccgccg

SEQ ID NO: 325 - DNA, 1573 bp, Glycine max
cggctcgagcggaaagatcaggctttgctttgctttgtgtgagatctgaagaagagaggtatggcaaaaagggtcttcttgtacaaggatttggttccttttggggccatggtgaccatggaatgcctcaacgtagccttgaatactctgttcaaagcagctaccttgagagggatgagttaccatgtctttgttgtttatgcttatgctgttgctgctattgttctcattcctggaccctttatctcccaaaggtgcagatcaagagtgcttcctccgctcagtttccccctactacgcaaaattggtcttctcgggctaatagggtgtgcttctcagatcgtgggatacacaggcatcagtttcagttcccccactctctcctcggcgataagcaacttggtgcccgcttttacttttttgcttgccatcattttcaggatggaaaaggtgattgtaagaaatacaacttgtcaagccaaggtattgggtaccatagtatcaataactggagcattcgtagtgaccttctacaaaggaccaccaatcatcattgttcatacaccttccttgtcacttcatcaaccaattaacactctgaattcggtagatcgaagttgggcaattggtggccttctactgacagcagagtatattctggttccattatggtacattgtacaggtgcaaatcatgaaggtgtaccccaatgaactaactgtgatcttcttttacaatttatgtgtaagcatcatggctgcaattgtagctatatttacagagacaaatgcaggagcttggaaaataggactagatacagcattggcttcaatagtttgctctggaatttttggttcatttgtgaacaacgcagttcacacatgggtactacgtataaagggtcctgtctatgtggcaatgttcaagccactctcaattgccatagctgttgccttgggagtcatgttcctgggtgatacactccaccttggaagtctagtgggagccacagtaatatcgatcggattttatacagtaatgtggggaaaagcaaccgaagagaatgtggacgaagatgtccctggccagcaatcaccaccaaccacagagaatgttcctctcttgcaaagctataaaactgatacagctgaaaagaaaatgcatggaagtgtataaatgacaaacaaaactgttgataaatcttaacattattgaaattacacgaatagcaaagcaaatacatggttttgttttcgcccaagctaaccctgtaacgccaatagcaattagcaaagtaggtacccacgcctttagagtgtagaggacatcatatgtaagaaatagttcaagggttcaactgatctcctttcgccaaggaacataaacgaatctttatacaaattagggagcaacctatctacaagtttgtgtacgaacactcacagatgaaaacggagcaacttcgttatctgtcttcccttttcctgtctcttgtaacaagtcatccatattatgatttatagaagctgcgtgattctttaacattaaaaaaaaaaaaaaagggcggccgccg

SEQ ID NO: 326 - DNA, 1677 bp, Glycine max
ggctcgagactacacaagaactagctataggcctcaattagttattatattaatttggtctaagtagttgttattacttgtgtagtagttcttctccaatggctgatttaggttcagcctcttccaagagaatgtggtgttccgttccagaaagaatgcagcttcacttggccatgttggccttgcagtttggctatgctggattccatgttgtctcaagagctgcacttaacatgggcgttagcaagcttgttttcccagtctatcggaacatcattgccttgcttctgctccttccctttgcctacttcttggaaaagaaggataggccagccatgactttaaacttcgtctgccagttctttcttctggcacttgtcgggattacagcaaaccaaggtttctacttgctagggttggagaacacatcccctaccttcgcatcagcaatacagaactcagtcccagccattacatttctcatggcagccatattaagaatagagcaagtgagattgaaccgaaaagatgggttgggtaaggtggcgggaacagtgctatgtgtggttggagccaccgtgatcacactatacaaaggtccaacaatatatagcccaacaactggtgtgaacataaacaacacaagagtgacacaagtgtttgaattggggtcagtgtcactgggagatgcaaaggggaagaactggaccctagggtgcttatacctcattggacactgcttgtcgtggtctggttggcttgtgttgcaagcaccggttctcaagaagtacccggctcgcctctctgtcacttcctacacctgtttctttggactcttgcagtttctcgtcattgctttgctccttgaaagagacgcgcaggcatggcttttccactctggtggagaagctttcactattttatacgcgggagtggtggcatctggaattgccttcgctgtacaaatatggtgcattgacagaggtggtcctgtgtttgttgccgtctatcaacctgttcagacttttgttgtcgccatcatggcttccattgctttaggagaagagttttacttgggcgggatcattggtgccgtgttgattgtagcgggactgtaccttgtcttgtggggtaagagtgaagagaggaagtttgcaagggagcagcttgcgattgcatccactgagcatagcatcataaggcccgcaagccacgccaaagcatcacttgctcagccactcctttcttcatcaacagagaatgtttgaacaagatcaaaattccaacttcaaaccacacaccattttcttggtgagaagaagtaaaagaaaaaaggggaaaaaagataccagctataccttactagttactactgctactactacattatgtcagcaagtttgtgtgtgttggaaccggttttcatcttttcctttctttttttttttatttaattcaaatgcttttttagtaggtcatttagaatatgagagaattgtgggaatggttgtaatggtggatgccactttaagtggggctagagcctgaaatccccccatatgcttttgtatgtcaattaatttatggtttgatttaagaaatgaatttttgttttttgggtcaaaaaaaaaaaaaaaaaaaaaaaaaaaaaaaaaaaaaaaaaaaaaaaaaaaaagg

SEQ ID NO: 327 - DNA, 1441 bp, Glycine max
ggctcgagtacaagttaacgagttatgggagctccccggacctcagttttaaaggggctttagggcgttaaaaagaaagcgcagagaaaggtgttgttctcagatccatccatcagtggtgggcgatgttgttgttctcagatccagactgagggggtgaaggaaaatgaagtcgtcgaggcgtctgttgaggatcgggcttgtgtcggcgtggtactcgtcgaacattggggtgctgctcctgaacaagtacctccttagcaactatggcttcaagtaccctatcttcctcaccatgtgtcacatgaccgcttgctccctcttcagctacgtcgccatcgcctggctcaagatggtccccatgcagaccatccgctcccgcctccagttcctcaagatcgccgccctcagcctcatcttctgcttctccgtcgtcttcggcaacgtctctctccgctacctccccgtctcttttaaccaggccgtcggcgccaccactcccttcttcaccgccgttttcgcttacgtcatgaccttcaagcgcgaggcctggctcacctatctcaccctcgtccccgtcgtcaccggcgtcgtcattgccagcgggggtgagccgagcttccatttatttgggttcatagtatgcattgcagctactgccgcacgtgccttaaaatccgtgttacaaggaattttgctttcttctgaaggagagaagttgaattctatgaaccttcttctttacatggctccaattgctgttgttttccttcttcctgctacacttataatggaagaaaacgtggttggcattacattggctcttgccagagatgatgtgaagatcatttggtatctgctatttaattcagcacttgcttattttgtcaacctgaccaattttttggtcaccaaacataccagtgctcttacccttcaggtgcttgggaatgctaaaggggccgtagcagtagtagtttcaattctgatatttagaaacccagtgtcagtcactggaatgatgggttattcactcacagtcctcggagttgtactttatagtcaagccaaaaagcgaagcaagtgatactgatgctgtctgtcattcatgattctgtggaaatcagcagtgaattccctatatttgttttcattcctgtgcggacaaactcaagattccatgaggcaaatttgttagcatgattgtgatcagaatgtttcagactctacaattttttggccctacatggaaaaacgggtttcccattgtattagtacctgtgcagaaatagcccacagtacaaagtttcaataagtgactgatctctctactatacccatgttggcatataatcgaggaatgtctttttgtcatttattctttgaagaaagagttgtagaaggacctctactcatttgttgttaaaaaaaaaaaaaaagg

SEQ ID NO: 328 - DNA, 1535 bp, Glycine max
ccacgcgtccgctttaatttgtctcttacttcacgcaagttgttcacggctcctctttatatgtacacgtactatctctcatgcatttcattcatcacatacaacactctctccaaagttcaaattaagactgagaggtgagaaagagagaattcatatgggtgccggtctagttgcgttcctcttaatggttcttgtgcaattggtctatgcagtgatgaacattacttcaaagcttgcaatagaatctggaatgagccctcttgtccttgttgcttatcgacaactctttgctactgtgtccattgctccctttgcttattggctcgagtggaatacgcttcccaggattacacagcgtcttatgattcagatattattttcgtccctgaccggagttacaggaaatcagatgctttattttgtggggctgaaatattcatccgctacaattgcatgtgcactgacaaatttgctcccagctttcactttcatccttgcagttctcttcagacaagagaatttgggaatcaagaagagggctggtctagcaaaggtattcgggacaatattgtgtgtgagtggagccttgcttttgtcattttaccatggaaaaaccattggtttaggccaatcaagtattcactggagatatgctgagaaaatggaaggaactagctcttctggcaaaggaaacatgttcctaggccctttggtcgtaattcttagcacccttgtttgggcagcatggttcataattcaaaaagacataagcaagacatttccagctccttacacgagcactggcttaatgtgtttcatggcaagctttcaatgcgtgatcattgccgtgtgtgtcgaccacagggcctcagcttggtcactccacaatgctatgagactttcctctgccctttatgcgggaatattttgcactggattagcctattgcctcatgtcgtggaccattgagagaaaaggtcctctttatgtctctgtatttacccctttgcagcttgtcctcactgccattttgagctgggctttgcttcgggagaaattatatgttggaactgccgtagggtctctcttgatagttttgggactctattctgttctctggggaaagagtgaagaggtgaataagggagacggtattgaagaagatgcagttaaagaagcagtcaaggattcgaagaatgacatggaattgcaatcatatgtgccatccaatggtaataatggtcgggttattgcatgaagaagggacgaggcagagtgagattcctcgcaagatgctagtagctaaggattgagaaagtttcggttatttgtctttattttatttttgctctctaccagtaaatttgaattttgatatgtgtaatcttgtgtcacatttgaaaggggttcacaactctttgcagttgcattgaagacatgtattaatattattattattattatttatatattaatcaacccggaatcagttattccattaaaaaaaaaaaaaaaaaaaaaaaaaaaaaaag

SEQ ID NO: 329 - DNA, 1583 bp, Glycine max
ccacgcgtccgacgacagaagggggattcaattgaaattcgagtttcctttttaatcacctggtttttttttttaaatttgaaggagatccaatccaaatgcatcgaatgccaatcacctgaaattccgccagatctctccctcttacacgctcttgataaaccgaaacgaagcaatagctatagcatcacacacacacaccaccgctagggttagggttagggttgggggtgttccgaagtaacaacaatggcggtctccgacggcgtcgtgaagaaaatcgtcctctcctacacctacgtcgcgatatggatcttcctcagcttcacggtcatcgtgtacaacaagtacattctggatcgcaagatgtacaactggccctacccgatctcgctcaccatgatccacatggcgttctgctcctccctcgcgtacattctcgttcgcgtcttgaagctcgttgaaccggtttcgatgtcgcgtgatctctacctcaaatccgttgttccaatcggtgcactctatccactttccctctggttttccaattccgcgtatatatacctctctgtttcgttcattcagatgctcaaggcgcttatgcctgtcgcggtttattcaattggtgttattttcaaaaaagaggcctttaagaacgagaccatggcgaacatggtttccatctcgctcggtgtagcggttgcggcttacggcgaagccaaattcgatgcatggggtgttaccctgcagcttatggcggttgcgtttgaggcaacacggttggttctgattcaaattttgctcaattcgaaggggatttcgctgaaccctatcacctcgctttactacattgctccctgttgcttggtgttcttgtccgtgccttggattatcatggagtacccttcgttgagggacaactctagcttccatttggatttcgcgattttcggcacgaattcggcttgtgctttcgcgttgaacctcgcagttttcttgctggtgggaaagacttcggctttgacaatgaatgttgctggggtggtcaaggattggcttttgattgcgttctcttggtctgtgataaaggacactgtgaccccgattaacttgattggttacgggttggcgtttttgggggttgcgtattataatcattgcaagttgcaggctttgaaggcttcggaggcgcagaagaaggctctgcaggctgatgaagaggctgggaggttgttggagcagaaggatggagaagggactggaaggaagaacgacaaccagaactgattcaagtgctgatctcattatttggtcactctcttcgattaatgttggatgacgcaggttttgtttttggttttgttctgtaatgtactctgctattaggtaattattattatcgtcgtcgttattgttattatcgttataattatattattattatgatgttacatgttacttctcacagtttaattttcatacccatatttagttatgtattggaggctgagattgacttttgttccttatattactgattcgtgtttatgggtaaaaaaaaaagaaaaaaaaaaaaaaaaaaa

SEQ ID NO: 330 - DNA, 1653 bp, Glycine max
ccacgcgtccgcaactacacttcagatctggcaccatcaccccaaacctaaaaaacaaaacatcatcgtactatttcccatttggcggcgcggcgatggtggaggcgcagacatggacgacgcggcgaatgagcaaccctcggctggacaccagcacgacggaccaagtactggacattccccccacacccccgggggagctccgcaacagcttcggatcgaaccctaacaacctctccccgaccctgttaactgctctcatcatttcatcttggtacctctcgaacatcggagttcttctcttaaacaagtacctcctcagcttctacggctaccgcttccctatcttcctcacaatgctccacatgctatcatgcgccgcttattcctacgcctccatcaacttccttgaactcgttcctctccagcacatccactccaagaagcagttcctcaagatcttcgctctcagcgccatcttctgcttctccgtcgtctgcggcaacacctccctccgctacctccccgtctccttcaaccaggccatcggcgcaacgaccccgttcttcaccgcgatttttgcgtttttgatcacatgcaagaaggagactggggaggtttacctcgccctgttgccggtggtgttcggtatcgtcgtggcgagcaacagtgaacccctttttcatttgtttgggtttctggtctgtgtcggttccaccgctggtcgcgctttgaagtctgtggttcaggggattttgttgacttctgaagcggagaagcttcactccatgaacttgcttctctacatggcacccttggcggcgatgattttgttgccgttcacgctctacattgaaggaaatgtgctggctttgactattgagaaggcgaaaggtgacccctttattgtgttcttgctgcttgggaatgccaccgtggcttatttggtgaacttgacgaatttcttggtgacgaagcacacgagtgctttgacgctgcaggtgttggggaatgccaaggcggcggtggcggcggtggtttcggttttgatcttcaggaatccggtgacggttatgggaatggccgggttcggaatcaccataatgggggtggtgctttacagtgaggccaagaagaggtccaaagttacgactcattgattcattcgcacgcacgccgttttggtttcttttttggcttttatcataacaccttattcttcgggtatttttctttctttctttgtttttattgatattgcacaatttagtttgatttaattttatcattatatttccgtggaattgggtcgaattaattacagcaattggactgtataggaaggaaggaaggagaagcagaaaatggggtgggagtgggagggattattattacttggtgttgttgttgggtttctgttggccgttgtgtaagcttatatatgaaacgctctatgccctttggcaacatacataaaaacgttcaaagaacgaaaaaccttatgtgtatttggctagggaggaaaattctccctccctgcattttgttgatcacatcatcatccatttttttttggcttttttgtcatttggtgttttgttagctttaattttgattcgtttgtgaggttcgagctaaaaaaaaaaaaaaaag

SEQ ID NO: 331 - DNA, 3859 bp, Oryza sativa
atccgcgccctctcctcctcttccccggggatccagcacggctacgccgccgccgccgccgctgccgccgtgcaatgcccgtggcgcctgctctcccaagaaaagcttcccttcttggtacatggtcgtcgtctccccttccccgattgcctcgccgccgacattcccctcgcctcgccggaccgccgccccccctgctccgaggtactcgctctctgtctcccctagtagtactagtgcactactactgctactactactagtactactacttgagctgcatgcgctggtgagttggtgagctttgcggtgattggagtggagatccaatccgagatactgctagattcgtttcaaacttttttcttcctcatcaaatgtagtagatttcttgcattgtcttgaggctaaaagctctggccttttatttgctagctacaggagtatgtctaatccaagcctttttttctctctgttcaatccatccaggttagtttgctgcggattgggattcgtttgctgctgctgttgcaaaggtggaggagcaccagcagtcgcattttatcccgaaagattggggattgtatgcttccactgaaccccgatgcgccacgttagccgctgcaccatccctgattggtatgcaccgagagagagagagagagagcgagaggaaaaaaaaagttccaaccttttcgtttcggttataataagactcgcctgatttccgctgattcttagcccaaaatgttgcaacctttgcaggaaaaataattttgtgtagacccctccaagtttcaagaaatggacattgtgcctgttgtagcattgtgctgctgcctggtcttgctgcccagttgggcctatggccttggatccatggcgtccatcgccgtgtcctacggcgaggacggccccgtgttctgcgggctcaactcggatggttctcacttggtcacctgcttcggcgcggatgcctccgttgtgtacggtgcccccagcaggatcccgttcgtaggggttactgcgggggatgggtttgcctgtggcctattgctcgacaccaatcagccttactgctgggggagcaactcctatgtcaagattggtgtgccgcagccgatggtcgagggagccatgtactcggagctcagtgcaggagacaaccacctttgtgccctacgaacatctgtcaaggggtttcacagcgtgaatggagatacatcggtgattgattgctggggatacaacatgaccgccacacataccgtcaccggagctgtatcggccatttcagctggttctgtgttcaattgtggcttatttgcacggaacaggacggttttctgctggggcgatgaatcggttagtggtgtcattgggctagctccgaggaatgtgcggttccagtctataggagcaggtggttaccatgtctgcggggtgctggagaatgcgcaggtattctgctggggtaggagcttggagatgcagcagatgtcaacacccagttctactgatgatggtgatgtgaacatagttccgatggatgcaatggtctccgtggtcggtgggcggttccatgcttgtggcatcaggagtcttgatcaccaagtggcttgctggggcttcacacttcagaacagtacacttgcaccaaaagggctcagagtttatgcaattgtggctggagattacttcacttgtggggtgccggccgagacatcgttgaagccaatgtgctgggggcatagtggcccattagcactaccaatggcggtatcccctgggatttgtgtatctgattcatgcagccatggctactatgaatacgcaaaccatggtgaagttggcagtggtagcaagacatgtaaacctgcaaattctagactctgcttgccctgcagtgttggttgcccagatgactcatatgagtcatcaccttgcaatgccacagctgaccgtgtttgccagtttgattgctcaaagtgtgcctcagatgagtgcgtgtcattttgtttgtcccagaaacggaccaagaaccgcaagttcatggcttttcagctgcgtatttttgtggcagagattgcatttgccgtcatattggtgttcagtgtgaccgctattgcttgcctgtatgtccggtacaaacttcgacattgccagtgttcaaagaatgagttgaggctggcaaagaatacaacatattctttccggaaggacaacatgaagattcagcctgatgtagaggacttgaagatcaggagagctcaggaattctcatacgaggagttagagcaagcaacagggggcttctcagaggattcacaagttggcaaaggcagcttttcatgtgtgttcaagggcattctgagggatggtacagttgttgccgtgaagcgtgcaattaaggcatcagatgtgaagaagagctcaaaagagttccataccgagcttgacctcctctccaggctcaaccatgcgcacttgctgaacctgcttggctattgtgaggatggcagcgagaggctcttggtttatgagttcatggctcatggatccctctatcagcatcttcatggcaaggatccgaacttgaagaagagactgaattgggccaggcgggtcactattgctgtccaagctgctcgggggatcgagtacttgcatggctatgcttgcccaccagtaattcaccgagacatcaagtcctcaaacatactgatagatgaggatcacaatgcgcgtgtcgctgactttggtctatctatattgggcccagcagatagtggtaccccactatcagagctgcctgcagggacacttggctaccttgatcctgagtactaccgtctgcattacttgacaacaaaatctgatgtgtatagcttcggagttgttcttctagagatcctaagtggcaggaaagctattgacatgcagtttgaggaaggaaacattgttgaatgggcagtaccattgatcaaagctggagacatttctgcccttcttgatcctgtcttatctcctccctctgatcttgaggctctcaagaagatcgctgctgtggcatgcaagtgtgtcagaatgcgagccaaagaccgcccttccatggataaggtaacaacagctctagagcgtgcccttgcactgctgatgggtagcccgtgcattgagcaacctattctgccaactgaggttgttcttgggagtagcaggatgcacaagaaggtatcgcagaggtcatctaaccattcgtgctccgagaatgatctcgttgacggggatgatcagcggattgagtacagagcaccatcttggataacatttccaagtgtgacttcatctcagaggaggaaatcctcggcatctgaagctgacatggatggacgaacaaccacagatggaaggaacgttgggagcagcataggtgatggattgcggtcgctggaggaagaaattagcccggcctcaccgcaggaaaacctgtacttgcagcacaacttctgatgaaatgtcaagaacagttgaaaattcaggcaactgtctgctgtttatggtcagcattgtgaattcagccaatgtgacctgccgttgctatattggaaattgcattgaaatgtttataaatccaatggtacctggccatctaaaagggagagagaactagctatagagagcactggaagaaattttagcagccggaggcatttctttgtagattattttaaatttttttggctctctttcctgatgttatttatatgtggatggtaacatttgatggatgctcatctgtagcttacagatctgtaccctaaacatcttttgcatgtctagtcttgctttttcctgcaaa

SEQ ID NO: 332 - DNA, 2401 bp, Oryza sativa
attttgctaggagttgggtatctgggacatcaagaatatccacattgttagtaaggggtctaactagatggagaagagaagcaaggagatgttttcactgttttcctttgtggtaatatttctctgcttgataaccaacgccatatattcgggtagtaaatttgtgcatgcaacagatactctccttccaggcaaatctctaagtggtaaccaggtcttgatctcaaaaggcggtgccttcaggttgggtttcaactgcctatctcctccatgttattcagattctacctttggtatatggtacatcaaatcatcaacttgtaggtcactactagtttgggcacctgttgcaaatttctgcatctttaacccatggtcctcttcgtttatcctctcagaagatgggaagttaaacctaatcattgatggttcgcttagctggtcatcaaatggtgtggagacctctgtttctgcagttgcaatacttcttgacaatggaaatctcgtaataagagaccaagtgaatagtaccatggtgttctggcaaagcttcgataacccaattggtattctgctacctggagggtggctaggatttaataggatgacaggaaagaacgtctccctttcttccaaatattcgaccgatggatatgacgcatatgacactggaaattttattttggatataaatgcgaacgaaggtagagggtttaccatcaatgctcctgacttcgattctggcaatacatacaagataaaatattctggggcctttcctagatggatgggcgttcgtgcagatggaggttcgtttctccttttcaatgacgcagatatatatgtacaattatatcctgatggtaatgttactgctgcgaaactaggggattgtggatctgtgctgtggtctgctccagaaaattggtgcgactttgattcatactgtggttcaaacagcttttgtataatacccagcaaagaatcattctttgaatccccatgttatgatttttctgatttgggttatttgatgaatgtctcgttaaactgtagatataatgctccccataaacaaaatgtttcttttcatccgatggttggagtttacaaatttccccaaaatgaatggtcaatagaagtcagaagcataagagagtgtgaagctgcttgttacagtgactgttcatgtacttctttcgctttcaacaagacatgcttattatggtacggggagctgcagaacacaatagtgtttgattctagatcagagggatatctcatgtacatgcgcgtggtcgagcaaaagcaagaaaaatcagaatataaggttgcaattattgttgtaacagtgataggtgggttggtcctcatacttataagcatgattcttttgtggagaggcaaaagaaagctattcacagaaaaaccagtgaattctgatagcagacttatgatcttctcaaattcacagctaaagaatgcaacaaaaggtttctctgaaaaacttggagaaggtggtttcggatgtgttttcaaggggacattgccaggtttttctgtggtggccgtcaaaaagctaaaagaccttagacaaggggagaagcagttccgatcagaagtgcagactattggtatgattcaacatatcaatcttgttcgtttacttggtttctgtgctgaaggaagcaaaaggttactggtatatgagtacttggttaatggttctttgaattctcatctgttttcaaactattctgcaaaattaacatggaacctcaggtactgtatagcacatggaattgcaaaaggcttggcttatctgcacgaggaatgtaggcattgcatcatacattgtgacatgaagccagacaatgtacttcttgatgcagaattctgtcctaagattgcagacttcggtatggcaaagcttcttggtcgagatttcagcagggcactgacaacaatgcgagggactataggatatcttgcaccagagtggatctcagggttgcccattacacacaaggcagatgtttacagctatggaatgatgcttcttgaaatcatatcagggcgaaggaactcggagaagatcaaggaagggaggcacacttactttcctatctatgctgcatgtaaggtgaatgaaggtgatgtcatgtgcctgttggataggaggttggatggaaatgctgatgcagagcaactggagaaagcttgcaggattgcatgctggtgcattcaggatgctgaggatcacaggccaatgatggggcaagtcgttcacatgctggagggtgttatggatgttgaggtccctcctattccgaggtcacttcagtactttgtgggcatggaggataataatactcaatctgcggaatgtaactaatatctg

SEQ ID NO: 333 - DNA, 2501 bp, Oryza sativa
tgcaactgcaagcaaagccatggccgctgatggtgatggcgacggtgagctagtgcggcgcgttcggtcgccgtcttcccgtggaagaatggcgccgacgctggcgttcctcctcgtcctcctcctgctgctcgccggcggcggcggcggcggcgcgttcttggcggcggccgcgtcgacggacaccgttgtcccggggaaggggatggccgggaaccagacgctcgtctccaagaacgggcggttcgagctcgggttcttcaccccgggctccggcatccactacttcctcggcgtccggctgaggaacatggcggagtacagccccacgttctggatcggggacagggtcggcgtcatcgacctccccggcgtgtcgctcgaggtgttcggcgacaagctgtacatcaaggaggacggggtcagcctctggtggtccagcgtcgctgggaacggctcctcctcctcctcggacggcggcgccgtcgccgtcctcctcgacaccggcgacctggtggtgagggaccaagggaacccctccggcgtcctgtggcggagcttcgactaccccggcgactcgctgctccccggcggcaggctcgggctcgacgcggccaccgggacgaacgtctccctcacattcaaaggcttttcccacaatggcagcctccaggtcgacgcgagcaggaggaacgggttcgtgctcaccaccgatggcatcgacagccgcggcgccttcccggactggatggtgacctcccaagacaacggcagctcgctggtgctcaaccaccctgacgccccgaactccaccgagttcttgcagttcaatcttgggctgatcagcctgatgcggtggtcggattccaccgccggctgggtggctcgctggacgttcccctccgactgcaagtccggcgccttcttctgcggcgacttcggcgcctgcacggccggcggcggcggcggatgcgagtgcgtcgacgggttcacgccgtcgtacccggacgagtggcggctcggctacttcgtcaccggctgctcgaggtctctcccgctgagctgcgaggccaacggtcagaccgagcacgacgactccttcgccattcttgacaatctccgaggcctcccttacaatgctcaggatgaaccagtgaccactgatgaagattgcagagctgcttgcctgaacaaatgctactgtgttgcatactcgaatgaatctggatgcaagctgtggtaccacaacctgtacaatctgagctcagctgataaacctccatacagcaagatctatgtccgtttgggttccaagctcaagagcaacagggggttggccacaagatggattgtgctcttggttgttggatcattagctgtaacttcggtaatgttgggactggtgcttctatgcagatacaggagagacttgtttgcatccagtaagtttgaagtagaaggctctcttattgtctacacttatgcacagatcaggaaggctacggggaatttctctgataaacttggtgagggaggttttggaagtgttttcagggggacattgcctggatcaaccactgttgttgctgtgaagaatctgaaaggtgttgggcaagcagagaagcagttcagaacagaagtacagactgttggaatgattcgacacactaatcttgtccgtctcttgggattttgcgtcaacgggaatagaaggttgctggtttatgagtatatgtcaaatggatccttggatgctcacatcttttcagaaaaatctagtttgctgagttggcatgtccgataccaaattgcacttggtattgcaaggggtctagcctatctgcatgaagaatgtgaggactgcatcatacattgtgatattaaacctgaaaacatactacttgattatgaattttgccccaaaatctgtgattttggtatggcgaagcttcttggacgagaatttaactctgcattgaccaccgtccgagggacaatgggctatcttgcaccagagtggatatatgggcaacctattacaaaaaaggcagatgtttatagctttggcattgtgctttttgaaataatctcagggagaaggtctacggagacagtgaaatttgggagccatcgctattttcctacgtatgcagcggtacaaatgaatgaaggagatgttttgtgcttactagatagcaggctggaaggaaatgctaacgtgaaggagcttgacatcacctgtagagtggcctgttggtgcatccaggatgaagagaatgacagaccgtcgatggggcaagtcgttcgcatgttggaaggcgttgtcgatatggagatgccaccaattccagcttcatttcagaacctcatggagagtgaagacagtggtatatactctgaagaaagctggaatttcaggacccgagatcagttctagcttcccctccagtttctcagaatgatactctcggtttctccgtggacctgcttggtgtgagcag

SEQ ID NO: 334 - DNA, 2601 bp, Oryza sativa
gcgattttatcgcacgaattgcaacttatcatgatcgtgaccgcaaaacagcggcgagttcagaggtgatgatcgcgacagcacttccgatcaatccatggcgtgctcgtttctctgcaagccatggctgccattaacggagagcgcgaagcccgctcgctcgccggcgccgtcttcccgcgcaagaacggtggtgcagcagctcgccgtcctcttactactgctcggcggcgtcggcggcggcggtggcgcgctgcttgccgcggccgcgtcgacgacggacaccatcctccccggcgagagcatcaccgggaaccagacgctcgtgtccaagaacggtgagttcgagctcgggttcttcaacccgggcgtcgggatccactacttcctcggcgtccgcctcaggaagctcgcggcgtacagccccacgttctggattggcgacagggtctacgtcgtcgacctgcctcgcgccgcgctggagctcttcggcgacagcctctacatcaaggaggacggtgccagcctctggtggtcgtcgccgtcgtcctcctcctcctcctcgggcggcggccgcggcggcggcgcggccgtcgccgtcctcctcgacaccggcgacctcgtggtgagggaccagaggaactcctccctggtgctgtggcggagcttcgactaccccggcgacgcgctgctgccgggcgggaggctggggctcgacgtcgccaccggggagaacgtgtcgctcacgttcgaggggttcacccacaacggcagcctccgggccgacgcgagcaggaggaacgggttcgtgctcaccaccgacggccgcgacacccgcggcgcgttcccggactggatggtgaccacccaagacaacggcggctcgctggtgctcaaccacccggacgccacgaactccaccgagttcctgcagctcaaagtcgggcaggtcagcctggtccggtggtcgggcgccgacgccggctgggtgcctcgctggacgttcccctccggctgcaagtccggcggcggcttcttctgcggcgacttcggcgtctgcacgacggcgaccggcggcgaatgccggtgcgtcgacgggttcgcgccgtcggacacgaaggagtgggggctcggttacttcgtcaccggctgctcgaggtctctcccactcagctgcgacgccaacggccagaccgagcacggcgactccttcgccattcttgacaatctccaaggcctcccttacaacgcgcaggatgagccagcgaccaccgatgaagattgcagggaagcttgcctgaacaaatgctactgcgttgcatactcaactgaaactggatgcaagctctggtattacgacctgtacaatctgagctcagctgataaacctccatacagcaagatctatgtccgattgggttccaagctcaagagcaagaggggattggccacaagatggatggtgctcttggttgttggatcagtagctgtagcttctgcaatgttggcagtgttgcttctatgcaggtacaggagagacctgtttggatccagtaagtttgtagtagaaggatctctggttgtctactcatatgcacagatcaagaaggcaacggagaatttctccgataagctcggcgaaggcggattcggaagcgttttcagaggtacattgcctggatcaaccactgttgttgctgtcaagaatctcaaagggctcggctacgcagagaaacagttcagagcagaagtgcagacggttggaatgatccggcacactaatcttgtccgtctcttgggattttgtgtcaaagggaacagaaagttgctggtctacgagtatatgccaaatggatccttggatgctcatatcttttcacaaaagtccagtcctttgagttggcaagttcgataccaaatcgcgatcggcatcgcaaggggtctagcatatctacacgaagagtgtgagcactgcatcatacactgcgacattaaacccgaaaacatactactcgacgaggaattccgccccaagatcgcggatttcggcatggcaaagcttcttggacgagaattcaacgcggcacttaccaccatccgaggtaccaggggctatctcgcgccagagtggctgtatgggcagccgattaccaagaaggcagacgtgtacagcttcggcatcgtgctgttcgagatgatctcagggataaggagtactgtcacgatgaaattcgggagccatcggtattaccccagctacgcggctgcgcaaatgcatgaaggagatgttctgtgcttgctggacagtaggctggaaggaaatgccaatgtggaggagctcgacatcacctgcagagtcgcctgctggtgcatccaggacagagagggtgacaggccatcgatggggcacgtcgttcgcatgttggaaggtgttgtggacacggagatgcccccaattccagcttcgtttcagaaccttgtggatggtgatgacagtgatatatacgaagaaaactggcgtttgaggacccaagattagtgccagtttcccttcctgttttcaaagggagaagtatattggtttcttgctggacctatttg

SEQ ID NO: 335 - DNA, 2401 bp, Oryza sativa
ttttcttcagggatagtgcttgaagataagaaatgaaccacaagcattctttctctgccctctgtgcagcaatgatactcaacgtgatcatattatttgtggatagctatgttgcagttgcatcagataccctttttcctggccaatctctctcaggctctgaaaccttagtatcagaaaatggtatttttgagttgggccttttcccctcagccccagctggtacaaagcactacctgggtattcgatacaagaacatgtcaagcaacaatccaataaccttttggctgggaaacagaattcccatcacctacttcattaatgcaacgctgtacatcgatgcaggtaaactttatattgaggagctcggctctattctatggacctcaaattcaacgagaaatgaatcaaacactgctgtggcagttattcttaacactggaaactttgtaataagagatcagctcaactcttctgtggtcacatggcagagctttgatcacccagctgataaactgctcccaggagcatatcttggactggacatggtcatgggaaccaacatcttgcttactctgttcaagcctccttataattgtaccctcatgattgaccaaagtaggaagaggggattcatcatgttcattgatgggcatgacaagtatcttggaacctttcctgaatggatggttacctacgaagaaaatggtagtctggtacgattaaacgatccaggaattccaaatgatactgaatacatgaaattgcaactggggcaactcagtttgttgaggtggttagataatgcaacaattagtggttggcaatctgtgtggagccacccttccagctgcaaagttagtgcttttcactgtggtgcatttggtatttgcacaagcacaggaacatgcaaatgtattgatggtttcagaccaacggagccaaatgaatgggagctgggacattttggtagtggctgctctagaattaccccctcaaattgtctaggtgttgtttccactgacttgtttgttttgttagacaacctgcaggggcttccttacaatcctcaggatgttatggcagcaactagtgaagaatgtcgagctatctgtctaagcgaatgctattgcgcagcgtactcctatcattctgcctgcaagatatggtacagcatgttgttcaatttgacttcagctgataaccctccgtacactgagatttatatgcgtataggttctccgagtaaacgcaggatgcacatactggttttcgtactaatttttgggtcaataggggttattctttttctgctgatgcttcttttgatgtacaagagatcctcatgtgttgcaagacagacaaaaatggaaggttttcttgcagtgtactcttatgcacaggtcaagaaagctacaagaaacttctctgacaaacttggggaaggaagctttggaagtgttttcaagggaacaattgcaggttcaacgattgttgctgtgaagaagctcaaaggcctagggcacacagagaagcagttccggacagaggtacagactgttgggatgatccaacataataatcttgttcgtcttttgggattctgtactagagggactagaaggttgctggtctatgagtatatgccaaatggttctttggattctcatcccttttcagaaacctcaagggtattaggttggaatcttcgccatcagattgtcgttggtattgctagaggtttggcctacctgcacgaggaatgcagggactccatcatacattgtgacattaagcctgaaaacatactactagatgcagagttctgccccaaaattgcagattttggtatggcaaagcttcttggacgggaattcagcgctgcactgaccactatccgaggaaccattggctatcttgcaccagagtggatatctggacaggctattacccacaaggcagatgtctatagctttggtgtcgtgctcttcgaaataatatcagggcggaggagtactgagaaaattcgacatgggaaccattggtatttccccctttacgctgccgctaaagtgaatgaaggagatgttttatgcttgcttgatgacaggatcgaaggaaatgcgagtttgaaggagttggatgttgcctgcagagttgcatgttggtgcatccaggatgatgagatccacaggccatccatgaggaaagttattcacatgttggaaggtgttgtcgacgttgaattgccgccaattcctgcttcctttcaaaacctgatggacgattatgatagtgatatatattccgtggaagtttgatatcggatcttttcagttgctagtagtttttattgcttgtttcttgaccttgatgttgtctatttaatcagaactgatca

SEQ ID NO: 336 - DNA, 3501 bp, Oryza sativa
aagaagccaaaatgatcttatactggaatggagattgcaagacagtaagcagcaactgagttactaagccaggaggaataaacgtttcaccctccttctctttcgttgccactgcatttcactttctttctgcatttcctgcaggttgtccgtcgcctattaccaacggccaggtagccaggtccaagctccgtcccttgaattcagagactggaaacaatggcgccgccctgctcctctgctctcgttcttccttgcctgcttgtcatagccatggccgctctgcaaagtgctgtggtgtttgccgataccgtcactgccaaacgcccgttgtccggcagccagagtgcactggtgtccaagcgtcgcaagttcgcgctcggtttcttccagccaggtaccgccacattctatgtgtttgtttccggctttaattgtttgtgttacaagaaaagagcgtagtaaggaaaattttagaatgtgtatagcctctagaggaaatatgtcggtgctttaatttctaacaatccaaatacgtggagcgagatcgtagcaacaagaaagaaaataacatgaacaaggttcatagttactccatttcatctagttaacatttatacgagatttggttaaatttttaaaaaattgatcatcaataattgattcaattgtttagttttaaaaagtggtatgtgaagatagatatgccttgaaaaatactattacgatagattcattatattttatagacttatcctaatataaaattaatggccaaagctccaagagttcggctgaattttgtcctaaacaacaaatatttataactggagggagtacatgtggttttccacaacaacaaaacatgagttattgtggtgcaaaacaactttgaatgagaggagaatagttttgtcaacttttttttcttaaatatattatagttactacaaattaccattggtataagatttaatcttttcagatgcacttgatagtgtagtggtaaaaggtttaaccctaaagttttgtgttcaattttaatacgcttataactttttctaattaactaattgataaccaagttgccccttagttgttcttgtttcttttatgagatttatgcttttgatttttgtgtgcttactaagaggtactactccttttgatgtgcaacagaaaattcacagcattggtaccttggcatctggtacaaccaaatttccaaacacacacctgtctgggttgcaaacaggggcactccaatctcgaatccggacacctcacaactaaccatagcaaccgacggcaacatggtattactcgacaattcaacaactgcaatttggtccacgaacatctccaagatcgcctccaactccacggtcggtgtcatcctcgacaccggcaaccttgtcctcgcagacgaatcgaacacctccatcatccactggcagagcttcgaccatttcggcaacacctggctccccggcggcaagctcggccggaataacaagctcgccggcgtgagcacccgtctggtcgcatggaaggctcgcaatgacccatctccaggcgtcttctccctcgagctggatccgaatggcacgagccaatacctgctcgaatggagcatcacgcagcagtactggacgagcggcaactggactggccgcatattcgccgacgtgccggagatgacgggatgctacccgagctcgacgtacaccttcgactacgtcaatggcgagaacgagagcgagagctacttcgtgtacgacctcaaggacgagtccgtcctcacgaggttcttcctgagcgagatggggcagatccagttcttgacatggatctacgcagccaaggactggatgccgttctggtctcagcccaaggtgaagtgcgacgtgtactcgctgtgtggcccgttcagtgtctgcaccgagaacgcactgacatcttgtagctgcctccggggattcagcgagcagaacgttggcgagtggttgcagggagatcacacttcagggtgcagaagaaacgtcgagctgcagtgtagcagcaatgcctcagtgatggggaggactgatggtttctacacgatggccaacgtgagattaccaagcaatgcagagagcgtggtggtcataggaaatgatcagtgtgagcaagcatgcttaagaagttgttcttgcactgcttactcctacaacggcagctgctcactgtggcatggagacctcatcaacctgcaggatgtgtctgccattagtagccaaggaagcagcactgttttgattcgcttggccgcttcagaattgtctggccagaagcagaagaacaccaagaacttgatcactattgccatcgttgctactagtgttctagtactcatgatagctgctttgtttttcatcttcagaagaagaatggtaaaggaaacaacaagagtggaaggttccttgatagcattcacataccgtgacctgaaatctgtgaccaaaaatttctccgagaagctcgggggaggcgcattcggtttagtgttcaaagggtcgctacctgatgcgaccgtggtggccgtgaagaagctcgaaggttttcgtcagggggagaagcagtttcgcgcggaggtgagcacgatcggcaacatccaacacgtcaacctgattcgattgctcgggttttgctcggagaaatcgcgaaggctactcgtctacgagtacatgccaaacggttcactggacaagcaactttttgacaataaaaaacatgtcctgagttggaacacgaggtaccagattgctcttggaatcgcgaggggattagactacctccacgagaaatgcagggattgcatcatacactgcgacatcaagccagagaacatactgctcgatggctcgtttgcacccaaggtcgccgacttcgggctcgccaagctcatgggccgcgacatcagccgcgtgctgaccacggcgaggggcacggtggggtacatcgcgccggagtggatcgccggcacggccgtcacggcgaaggcggacgtgttcagctacggcatgacgctgctcgagatcgtgtcggggaggcggaacgtgcagggacgacggaggaggcaggagcagcaggacgacggcggcgcggcggcggaccgcccattcccgttggtggcggcgggcaggctcgtcggcggcggcggaggccggcgggaggagctggtcagcgccgtggtggacggccggctcggcggcgacgccgacatgggcgaggcggagagagcatgcagggtggcgttctggtgcatccaggacgacgagaacgcgaggccggccatggcgacggtggtgcaggtgctcgaagggctcgtggagatcggcgtcccgccgattccgagatcacttcagttcctcgcggagttggccgatcaatcaaattacttgcagttcttctccgatttattaccgtcgaattgaggtccttgcaggtgcaggcttgagg

SEQ ID NO: 337 - DNA, 2601 bp, Oryza sativa
ctcttctcccgcgtgcacctcactatacgtacgttggcacgtaccacgtacgcacatccgatccacatgcctcctcttctgtataacctcttcgtgctcatcgtcgtcttcctcggcggcggtgctccggcgtgttcagccgcgacggacaccgtcaagcctggccatgtcgtcggcggcaaggacaaggtcgtctccaacaacggcaagttcgcgctcggcttcttcaaagccccggctccaaaccaagagaaatggttcctgggcatatggttcaacacggtgcccaaccgcaccacggtatgggtagccaacggcggagagccaatcatggacgccgccgacgccggctcgccggagctcaccatctccggcgacgacggcgacctggttgccttacacccaaccaccaagtcaatagcctggtcaaccaacgtttcagccaagaactccaccagcaacagcaacaacactgcagccgtccttctgaacagtggaaacctcgtactgcaagacacctcgaacatgtcccaacctcgtacgctgtggcagagcgtcgaccacccgaccgacacgctcctccccggcgcgaagctcggccgcgacaagctcaccggcctgaaccgccgtctcgtctccaagaagagcatggccggcccgtcccccggagcctactgcttcgaggtagacgaagacacgcctcagctcgtgctcaagctctgcaattcgtctgtcacctactggtccagtggaccatggaatggtcagtacttcactggcatccctgagctgatcggcaattcacctggctttcaccttgggttcttcgacaacagcagagaggaatatctccagttcaatgtgtcaaatgaagctgtggtgacacgcaacttcatcgacgtcgatggccggaacaagcagcaggtttggctggacagctcgcagtcttggctgacgctgtactccaatccgaaggttcagtgtgatgtgtacggtgtatgtggggctttctcggtctgcagtttcagtttgcttccactctgcagctgcatgaagggattcactgttggatcagtgaaggattgggagcaaggcgatcaaactggtggatgtgtgagaaagaatcagttggattgtgtaggtagcaacacgagttcatcagattcaactgataagttctactccatgtctgatatcatcttgcctgacaaagctgaaagcatgcaggatgttgacagttcagatgaatgcatgaaggtttgtctgaataattgctcttgcactgcttattcatatggcagtaaaggttgccttgtttggcacactgaattgctcaatgcaaaactgcagcagcagaattccaatggagaaatcatgtatctccgtctctcagcaagagatatgcagagaagcaagaaacgtagagtgataatcggtgtcgtcgttggtgcatgcgctgctggtttggctgtgctgatgttcattttgatgttcatcatcaggaggaacaaagacaagaacaggagtgaaaattatggtagcctcgtggctttcaggtacaaagatttgcgttctgcaaccaaaaacttttctgaaaagattggcgaaggcggattcggctccgtcttcaggggacaactgcgtgattctaccggcatagctgtgaaaagactcgacggtagatcacaaggagataagcaattcagagctgaagtgagatcgatcggaaccattcaacacatcaacttggttaatctgattggcttctgcagtgacggcgacagtaggtttcttgtctacgaacacatgccaaatcgatctcttgacacacatctgtttcaaagcaatggcaagttcttggactggaacactcgctaccagatagctcttggagttgccagaggcttgtgctacttgcacgagagctgccatgatcgaatcatccactgcgacatcaaaccgcaaaacatactactcgacgcatcgtttcttcccaaggtcgcggattttgggatggcaaagtttgtagggagagatttcagcagagcactcaccaccatgagaggaaccataggttatcttgcgcctgaatggattagtggaacagcaattacaccgaaagtagatgtttacagctatggaatggtgctgcttgagctagtgtcaggcaggaggaactcagccagatcagaagaagaatgcactactactaccactacttctacatccactgacactgatggcaactattctgtctacttccctgtgcaagcttcaaggaagcttctagatggagatgtgatgagcttgctggaccagaagctgtgtggtgaagcggacttgaaggaggttgagagagtgtgcaagatcggttgctggtgcattcaagaggatgaggttgatcggccgacgatgggtcaagtggtccagattcttgagggtgtcttggactgcgacatgcctccgttgccgaggttgcttcagagaatctttgagaggccgtcttcagttagcaccagcacaccagttttcctttttgtcggtagccctgaacgccaatgagaatacagtatcagtttggaatgtacagtatatctgaat

SEQ ID NO: 338 - DNA, 2808 bp, Oryza sativa
atggaagctcatggcaatcgtcgcagcagtccaacataccttgttatgctgtggatgatttcggtagctagcctattgataacatgtcgtggcagtatccagaagcaagttctctttccagggttcactgccgcgcaaatggattacattgataacgatgggatatttctgctttctaatggctctgtctttggctttggttttgtcacgagcaatgtctcagacaacacgttctacattcttgcagtggttcacatggccactactaccacagtctggtctgccaatcctaactctcctgtcacccattcagatgacttttttttcgacaaggatggcaatgccttcctgcagtcaggaggaggctccaagtatgggctgccaatatctccgggaagggactgccacctctatgcaactactggactctggcaatctgtagtgcttgggaaagatgcctcttctcctctctggcaaagtttcagccatccaacagacactcttctgtctggtcagaatttcatcgaagggatgacgctgatgagcaagtccaacacagtacagaacatgacctatacacttcagatcaaatctgggaacatgattttatacgccggcttcgagacacctcaaccatactggtctgcacagcaggatagcaggataattgtcaacaagaacggtgacagaatctaccctgcaaacctcagttcagcttcttggtccttctatgatcaatcagggtcccttctatcacaacttgtcatcgcgcaagaaaatgccaatgccacattgtctgctgtccttggtagtgatggattgatagctttctatatgctgcagggtggaaatggcaagagtaaattctcgatcacagttccggcagactcttgtgacatgccagcctactgcagtccttacaccatttgcagtagtgggacaggttgccaatgcccttcggccctcggctcgtttgcaaactgcaatcctggtgttacatcagcatgcaaatcgaacgaggagtttccgctggttcaactggatagtggagttggatatgtaggcactaacttcttccctcctgcggctaagacgaaccttacgggttgtaagagtgcctgtacaggcaactgctcttgtgttgctgtgttctttgatcaatcttcaggcaattgtttccttttcaaccagatcggaagcttgcagcacaaaggtgggaatacaactcgtttcgcatcttttatcaaggtatcaagcagaggaaaaggtgggagtgatagtggcagtgggaagcacaataccattattattgtcattatgctcggaactttggctatcataggcgtccttatttatattggtttctggatctacaagaggaagaggcatcctccaccatcacaagacgacgctggttcatcggaagatgatggatttctgcaaacaatatccggagcaccagtgcggttcacttacagggagctccaggatgcgacaagcaacttctgtaacaagcttggtcagggagggtttggatctgtgtatcttggtacactcccagacggcagtcgtattgctgtgaagaagctggagggcataggccaaggaaagaaagagttccgctctgaggtaacgatcattggtagtatccaccacatccatcttgtcaaactccgaggcttttgtactgagggaccacacaggcttcttgcctacgagtacatggcgaatgggtcgctggataagtggattttccattctaaagaagatgatcacctgctcgactgggatacaaggtttaacattgcgcttggaacggcaaagggattggcatacctccatcaggactgcgattcgaagattgtacactgtgacattaagcctgagaatgttctacttgacgacaacttcatcgcaaaggtatctgattttggccttgccaagttgatgaccagggagcagagccatgttttcactacgctcagaggcacgcgcgggtaccttgcacctgagtggctcaccaactatgccatctcagagaagagtgatgtgtacagctacggcatggttttgcttgagataatcggtgggaggaagagctacgatccctcggagatctccgagaaggctcacttcccttcctttgcattcaagaagctggaggaaggcgatcttcaggacatcttcgacgccaagctgaagtacaatgacaaggatgggcgggtcgagaccgcgatcaaggtcgcgctctggtgcatccaggatgatttctaccagagaccatccatgtcaaaggttgtgcagatgctcgaaggcgtctgcgaggtgctccagccaccggtgtcgtcgcagatcgggtacaggctctacgcaaacgccttcaaatcgagcagcgaggaggggacttcatcagggatgtcggactacaacagtgatgctctgctttcagctgtgaggctttctggtcccagatgatgtgaagaatcccatgtacagtgccttgtctagttaggttgcaaagtgtgcaaattttgctgtagtttccagtgttttggtgatcatttgcttcacactattgtacatatcttcttggtcatttctggtggtagtttatacatatcttgctgattatttatggtggtagtttatcggtgccattctttttttgttgcccttttggttatacataaggtctccaaaacctttgacaattaccttttgtagttatgtcttggtaaaaataataggaaatgcaatgatacaaaaggctttttcatgaaaaaaaaaaaaaaaaaaaaaaaaaaaaaa

SEQ ID NO: 339 - DNA, 1027 bp, Glycine max
ggttaagcggtgagatttgcgaatctgagaaatggcggattcttctcgggaggagaacgtttacatggcgaaattggcggagcaggccgagcgttacgaggagatggttgagttcatggagaaggttgcaaagactgtggaggttgaggagttgacggtggaggagaggaatctcctctctgtggcttacaagaacgtgattggtgcgaggagggcttcgtggaggatcatatcctccattgagcagaaggaggagagcaggggcaatgaggaccacgtggccattataaaggagtacaggggcaaaattgaggctgaactcagcaagatctgtgatgggattttgaacctccttgagtccaacctcattccttccgctgcatctcccgagagcaaagtcttttaccttaaaatgaagggtgattaccacaggtaccttgctgagttcaagaccggggcagagaggaaagaggctgcagagagtactttgcttgcttacaaatccgctcaggatattgctcttgctgacttggcccccactcaccccattaggttgggacttgctctcaacttttctgtgttctattatgaaatccttaactcgccagatcgtgcttgtaatcttgccaagcaggcatttgatgaggcaatttccgagcttgacacattgggtgaagagtcatacaaagatagtacattgatcatgcaacttctccgtgacaatctgactttgtggacatcagacatcacggacgatgctggagatgagatcaaggaaacatctaagcaacaaccaggcgaataggcgatggcagttgcgatgtggtagttgattggatatgtattaccgataatatggatccaatgtggcttgccatagtgggattattgtattaatgaattttatgatttcaagtgcgcgttgcgcttgggatttacaatgtttcagtggattgtctaatgtgttttatggatgagaagaatgtggtttagtgatttataaattttttattgttgctagtaaaaa

SEQ ID NO: 340 - DNA, 1027 bp, Glycine max
ggttaagcggtgagatttgcgaatctgagaaatggcggattcttctcgggaggagaacgtttacatggcgaaattggcggagcaggccgagcgttacgaggagatggttgagttcatggagaaggttgcaaagactgtggaggttgaggagttgacggtggaggagaggaatctcctctctgtggcttacaagaacgtgattggtgcgaggagggcttcgtggaggatcatatcctccattgagcagaaggaggagagcaggggcaatgaggaccacgtggccattataaaggagtacaggggcaaaattgaggctgaactcagcaagatctgtgatgggattttgaacctccttgagtccaacctcattccttccgctgcatagcccgagagcaaagtcttttaccttaaaatgaagggtgattaccacaggtaccttgctgagttcaagaccggggcagagaggaaagaggctgcagagagtactttgcttgcttacaaatccgctcaggatattgctcttgctgacttggcccccactcaccccattaggttgggacttgctctcaacttttctgtgttctattatgaaatccttaactcgccagatcgtgcttgtaatcttgccaagcaggcatttgatgaggcaatttccgagcttgacacattgggtgaagagtcatacaaagatagtacattgatcatgcaacttctccgtgacaatctgactttgtggacatcagacatcacggacgatgctggagatgagatcaaggaaacatctaagcaacaaccaggcgaataggcgatggcagttgcgatgtggtagttgattggatatgtattaccgataatatggatccaatgtggcttgccatagtgggattattgtattaatgaattttatgatttcaagtgcgcgttgcgcttgggatttacaatgtttcagtggattgtctaatgtgttttatggatgagaagaatgtggtttagtgatttataaattttttattgttgctagtaaaaa

SEQ ID NO: 341 - DNA, 1004 bp, Oryza sativa
gaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagctcagcaagatctgtgatggtatccttaagcttctggattcccaccttgtcccatctgccactgcttaggagtccaaggtgttctacctgaaaatgaagggtgactaccacaggtaccttgctgagtttaagtcaggagctgagaggaaggaagcagctgagaacactcttgtggcatacaagtctgcccaggatattgcactcgctgacctgcctacaactcacccgataaggcttggacttgcactgaacttctcagtgttctactatgagatactgaactcaccagaccgtgcttgcaaccttgcaaagcaggcgttcgacgatgctattgctgaactggacactcttggcgaggagtcttacaaggacagcaccttgatcatgcaacttcttcgtgacaatctgactctctggacctctgacaatgcggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccaaaaa

SEQ ID NO: 342 - DNA, 1158 bp, Sorghum bicolor
cggacgcgtgggcgctccagcgccactcgcatcgagatcgagacgacccgcgtccgccgctcccgtgcaccgccgcgactcgcacccccggaagtaactctattccttgatcaacatgtcgcgggaggagaatgtctacatggccaagctggctgagcaagcagaacggtatgaggaaatggttgagtacatggagaaggtggctaagaccgttgatgtggaagagctcaccgttgaggagcgtaacctcctatctgttgcctacaagaatgtgattggggcccgccgtgcctcatggcggattgtctcctccatcgagcagaaggaggagtcccgcaagaacgaggaacatgttgctcagattaaggagtaccgtggcaagattgaggctgaattgagcaacatttgtgatggtatcctgaagctgcttgactcgcaccttgtgccttcctccactgctgcagagtcgaaggtgttttacctcaagatgaagggtgattatcacaggtaccttgctgagtttaagactggtgctgagaggaaggaatctgcagagagcacaatggtagcttataaggcagcccaggatattgcattggctgaactggcacctactcatcccataaggcttggacttgcacttaacttctcggtgttctattatgagattctgaactctccggacaaagcttgcaaccttgcaaagcaggcatttgatgaggctatttctgagttggacacgcttggtgaggaatcttacaaagatagcaccttgattatgcagctcctaagggacaacttgaccctctggacctctgacatcacggaggagggcactgaggagggcaaagaagcctcgaagggtgatgctgagtagcctggtaaaccttgatggatggttcggcatgtttttctagcccatcttgttggacgccctgtgctgatagaaggtgtttgctgctccatgcattccaagattctgtcttctcgttccctccctgctgtagctggtggtagtagtcaaattagccccattgctttagttggctctgggtccatttggactgatgtattgttactgctgttgaagtcattcgttctcgttttgctcttgcagtagattgctgttgggttgtgctttaaaaaaaaaaaaaaaaa

SEQ ID NO: 343 - DNA, 1158 bp, Sorghum bicolor
cggacgcgtgggcgctccagcgccactcgcatcgagatcgagacgacccgcgtccgccgctcccgtgcaccgccgcgactcgcacccccggaagtaactctattccttgatcaacatgtcgcgggaggagaatgtctacatggccaagctggctgagcaagcagaacggtatgaggaaatggttgagtacatggagaaggtggctaagaccgttgatgtggaagagctcaccgttgaggagcgtaacctcctatctgttgcctacaagaatgtgattggggcccgccgtgcctcatggcggattgtctcctccatcgagcagaaggaggagtcccgcaagaacgaggaacatgttgctcagattaaggagtaccgtggcaagattgaggctgaattgagcaacatttgtgatggtatcctgaagctgcttgactcgcaccttgtgccttcctccactgcttaggagtcgaaggtgttttacctcaagatgaagggtgattatcacaggtaccttgctgagtttaagactggtgctgagaggaaggaatctgcagagagcacaatggtagcttataaggcagcccaggatattgcattggctgaactggcacctactcatcccataaggcttggacttgcacttaacttctcggtgttctattatgagattctgaactctccggacaaagcttgcaaccttgcaaagcaggcatttgatgaggctatttctgagttggacacgcttggtgaggaatcttacaaagatagcaccttgattatgcagctcctaagggacaacttgaccctctggacctctgacatcacggaggagggcactgaggagggcaaagaagcctcgaagggtgatgctgagtagcctggtaaaccttgatggatggttcggcatgtttttctagcccatcttgttggacgccctgtgctgatagaaggtgtttgctgctccatgcattccaagattctgtcttctcgttccctccctgctgtagctggtggtagtagtcaaattagccccattgctttagttggctctgggtccatttggactgatgtattgttactgctgttgaagtcattcgttctcgttttgctcttgcagtagattgctgttgggttgtgctttaaaaaaaaaaaaaaaaa

SEQ ID NO: 344 - DNA, 1132 bp, Oryza sativa
gccagagcgcgaggagacgcacacagagacttggcatttgtagagtttttagatttatagatagcaaagatgtcggcacaggcggagctttcccgtgaggagaatgtgtacatggccaagctcgctgagcaagccgagaggtacgaggagatggtcgaattcatggagaaggtggccaagacggttgactctgaggagctcaccgtggaggagcgcaacctcctgtctgttgcatacaagaatgtgattggagcccgccgtgcgtcatggcgcattatctcctccattgagcagaaggaggaaagccgtggtaacgaggaccgtgtcacactcatcaaggactaccgtggcaagatcgagactgagctcaccaagatttgcgacggcattctcaagctgcttgaatcccaccttgtcccctcttccactgcccctgagtccaaggtcttctacctcaaaatgaagggtgactactacaggtaccttgccgaatttaagaccggggctgagaggaaggatgctgctgagaataccatggtggcatacaaggctgctcaggacattgctttggctgagctgcctcctactcatccaattaggcttgggctagctcttaacttctcagtgttctactatgagatcctcaactcgcctgatcgtgcttgcaacctcgcaaagcaggcttttgatgaggccatctcggagctggacaccctgagcgaggagtcctacaaggacagcactttgatcatgcaactcctccgtgataacctgaccctgtggacttcagacatctcggaggacaccgcggaagagatcagggaagctccgaagcgcgactccagcgaggggcagtaaagccggctttatgtgccctagaagcttgtagctagtgctttgctactgtgtaatgacacctatgtggctgtgattgttgtcgggaaatctggggctcccccgtatgtgaggttgctagcgatggttttgcagtctcgcctttaagctactcgtagcagagcaggtgggggtctgtggagccaggcctggttgggggtgggggagcctcttgaactgcttggtggcacttcctgtttttctgtttgcctttttattggtgtttattgttatggtc

SEQ ID NO: 345 - DNA, 1132 bp, Oryza sativa
gccagagcgcgaggagacgcacacagagacttggcatttgtagagtttttagatttatagatagcaaagatgtcggcacaggcggagctttcccgtgaggagaatgtgtacatggccaagctcgctgagcaagccgagaggtacgaggagatggtcgaattcatggagaaggtggccaagacggttgactctgaggagctcaccgtggaggagcgcaacctcctgtctgttgcatacaagaatgtgattggagcccgccgtgcgtcatggcgcattatctcctccattgagcagaaggaggaaagccgtggtaacgaggaccgtgtcacactcatcaaggactaccgtggcaagatcgagactgagctcaccaagatttgcgacggcattctcaagctgcttgaatcccaccttgtcccctcttccacttagcctgagtccaaggtcttctacctcaaaatgaagggtgactactacaggtaccttgccgaatttaagaccggggctgagaggaaggatgctgctgagaataccatggtggcatacaaggctgctcaggacattgctttggctgagctgcctcctactcatccaattaggcttgggctagctcttaacttctcagtgttctactatgagatcctcaactcgcctgatcgtgcttgcaacctcgcaaagcaggcttttgatgaggccatctcggagctggacaccctgagcgaggagtcctacaaggacagcactttgatcatgcaactcctccgtgataacctgaccctgtggacttcagacatctcggaggacaccgcggaagagatcagggaagctccgaagcgcgactccagcgaggggcagtaaagccggctttatgtgccctagaagcttgtagctagtgctttgctactgtgtaatgacacctatgtggctgtgattgttgtcgggaaatctggggctcccccgtatgtgaggttgctagcgatggttttgcagtctcgcctttaagctactcgtagcagagcaggtgggggtctgtggagccaggcctggttgggggtgggggagcctcttgaactgcttggtggcacttcctgtttttctgtttgcctttttattggtgtttattgttatggtc

SEQ ID NO: 346 - DNA, 865 bp, Zea mays
gtccacacttcgcaacaacagaaaaaaatcctttttttaattgaattttttatcaatcaaaatgactgaaacaagagagatcaacgttttcatggccaagctcgctgagcaggctgaacgttacgatgagatggttgaagccatgaagaacgttgctgatttgggacaagaactcaccgttgaagagcgtaaccttctctccgttgcctacaagaacgtcattggtgcccgtagagcttcatggagaatcatcacctctattgagcaaaaggaagaatccaagggaaacaccgctcacgttgagagaatcaaggagtacagaaagaaggtcgagaacgaagtctccaagatctgcgctgatgtcctcggaaccctcgacaacaagttgattccaaacgctcaaaccaccgagtccaaggtcttctactacaagatgaagggagattaccaccgttacctcgccgagttcgccaccagcgaagctagaaaggaagccgccgacaactccttggctgcctacaagtccgccaccgacattgctaactccgagttggccccaacacacccaatccgtttgggacttgccctcaacgcctccgttttctactacgaaatcatgggatcaccaaagcaagcttgcgagttggctcgtaaggccttcgacgacgccattgccgagttggatcaactcaacgaggagagctacaaggactccactttgattatgcaattgttgagagataacctcaccctctggacctctgacttggagggagacaaggccgacgctgaaccagaagccgccaactaagaatcttcctttcctcacacaacactttgtataaatacttctatctttatttat

SEQ ID NO: 347 - DNA, 865 bp, Zea mays
gtccacacttcgcaacaacagaaaaaaatcctttttttaattgaattttttatcaatcaaaatgactgaaacaagagagatcaacgttttcatggccaagctcgctgagcaggctgaacgttacgatgagatggttgaagccatgaagaacgttgctgatttgggacaagaactcaccgttgaagagcgtaaccttctctccgttgcctacaagaacgtcattggtgcccgtagagcttcatggagaatcatcacctctattgagcaaaaggaagaatccaagggaaacaccgctcacgttgagagaatcaaggagtacagaaagaaggtcgagaacgaagtctccaagatctgcgctgatgtcctcggaaccctcgacaacaagttgattccaaacgctcaaaccacctagtccaaggtcttctactacaagatgaagggagattaccaccgttacctcgccgagttcgccaccagcgaagctagaaaggaagccgccgacaactccttggctgcctacaagtccgccaccgacattgctaactccgagttggccccaacacacccaatccgtttgggacttgccctcaacgcctccgttttctactacgaaatcatgggatcaccaaagcaagcttgcgagttggctcgtaaggccttcgacgacgccattgccgagttggatcaactcaacgaggagagctacaaggactccactttgattatgcaattgttgagagataacctcaccctctggacctctgacttggagggagacaaggccgacgctgaaccagaagccgccaactaagaatcttcctttcctcacacaacactttgtataaatacttctatctttatttat

SEQ ID NO: 348 - DNA, 1179 bp, Glycine max
attcggctcgagcgtaaaccctaatttcggaaagatcggcgatgactgcctccaaggatcgcgagaacttcgtctacatcgccaaactcgccgagcaggccgagcgttacgaagagatggtggaatcaatgaagaacgttgcgaatctcgacgttgaactgacggtggaggagcggaatttgctttctgttgggtacaagaatgtgattggtgctcgcagagcgtcctggaggatcctgtcttccattgagcagaaggaagaaacaaaagggaacgagttgaatgcgaagcggattaaggagtacagacagaaggttgaattggagctatcgaacatctgtaatgatgttatgagagtgattgatgagcaccttatcccttcggctgcatagggtgaatccactgtgttttactataagatgaaaggagattattatcgttatcttgctgaatttaagtcaggcaatgagaagaaggaagctgctgatcagtctatgaaagcatatgagtctgctaccgctgcagcagaggctgatttacctcccacacatcccatccgattgggtctagctttaaatttctctgttttctattatgagatcttgaactcccctgaaagagcctgtcatcttgcgaagcaagcttttgatgaagctatttctgagcttgacaccttgaatgaggagtcatacaaagatagcaccttaatcatgcaacttctcagggacaacctaactttgtggacttctgacatcccagaagatggagaagatgcccagaaagtgaatggcactgccaagcttggtggaggtgaggatgcagagtgagtccgatggatgatggaatcttccataggattcgatgcatgcgtttgggaatgaaacatgagggccgattacttatctgtgtattagctagagatagggattctattgtttcctctttgtttcctgttggattgcccaatacttcccgataggggaaagagatactccatttgtgctatatttatggtatgtttttatttgtgtggtgtctggaaatggcctatttcattcccaatccgtttcctccagtctctgggggatttgattgatgagaattgcttatggtgggtgtatttccttttccaatgaaatgctacaacatttactgcaaaaaaaaaaaaaaaaaaaaagg

SEQ ID NO: 349 - DNA, 1149 bp, Oryza sativa
gccttccccccccccattcgtcgcctcctgtcccgggggccgcgagcaaaacccccacccccaaatcgcagcctcgctcagctcgatctctctctcgtctcgccatggcccccagcgacgacctcgtctacatggccaagctcgccgagcaggccgagcgatacgacgagatggtggaggcaatgaatagtgtggcaaagttagacgaggggctgacaaaggaggagaggaacctcctctcagttggctacaagaatttgattggtgcaaagcgtgcggcaatgcgtatcattggatccattgagctaaaggaggagacaaagggcaaggagagtcatgtaaggcagactgctgagtatcgtcgcaaggtggaggctgagatggataaaatctgctgtgatgtcataaacattattgacaagtaccttatcccacattcctctggagctgagagctcagtcttctactacaaaatgaagggagattactaccggtaccttgcagagttcaagactgggactgagaagattgaagtgtctgaactgtcactcaatgcttatgagactgcttccaaaactgcgcagacagatctcactccaactgaccctatcagacttggtttagctctgaatatatctgtcttctactgtgagatcatgaactcacctgacaaagcttgccaacttgctaagaacgcctttgatgaagctgttgcggagcttccctccctcagtgaggagaattacaaagatagtacactgatcatgcaacttctgagggataatctagcactgtggaattctgatatggctgatgatgcagacgatattagggaacgaacagatacaactggtgctaaaggtgaccctgcagcgtgatggaggtgctaatagctggtagagtcgaagcataacaacaacaacaacaagggtgtggtggggtgcggaaggactaccatttactcactgttagtgttaggttctgtagtgtaggagttgagctgctgagtaaccctcgcttgtagtctgggcctgattcttcgacttcttgagcaacatcgtgtactaagcactcgctgatcgctcttttgcaagcattgtttttttttgggttactcttgatgatgattaggcaaaagttatctggttc

SEQ ID NO: 350 - DNA, 1149 bp, Oryza sativa
gccttccccccccccattcgtcgcctcctgtcccgggggccgcgagcaaaacccccacccccaaatcgcagcctcgctcagctcgatctctctctcgtctcgccatggcccccagcgacgacctcgtctacatggccaagctcgccgagcaggccgagcgatacgacgagatggtggaggcaatgaatagtgtggcaaagttagacgaggggctgacaaaggaggagaggaacctcctctcagttggctacaagaatttgattggtgcaaagcgtgcggcaatgcgtatcattggatccattgagctaaaggaggagacaaagggcaaggagagtcatgtaaggcagactgctgagtatcgtcgcaaggtggaggctgagatggataaaatctgctgtgatgtcataaacattattgacaagtaccttatcccacattcctctggagcttagagctcagtcttctactacaaaatgaagggagattactaccggtaccttgcagagttcaagactgggactgagaagattgaagtgtctgaactgtcactcaatgcttatgagactgcttccaaaactgcgcagacagatctcactccaactgaccctatcagacttggtttagctctgaatatatctgtcttctactgtgagatcatgaactcacctgacaaagcttgccaacttgctaagaacgcctttgatgaagctgttgcggagcttccctccctcagtgaggagaattacaaagatagtacactgatcatgcaacttctgagggataatctagcactgtggaattctgatatggctgatgatgcagacgatattagggaacgaacagatacaactggtgctaaaggtgaccctgcagcgtgatggaggtgctaatagctggtagagtcgaagcataacaacaacaacaacaagggtgtggtggggtgcggaaggactaccatttactcactgttagtgttaggttctgtagtgtaggagttgagctgctgagtaaccctcgcttgtagtctgggcctgattcttcgacttcttgagcaacatcgtgtactaagcactcgctgatcgctcttttgcaagcattgtttttttttgggttactcttgatgatgattaggcaaaagttatctggttc

SEQ ID NO: 351 - DNA, 1093 bp, Glycine max
ggtctccctcatttgttcactttctctctctaaatccctaaaccagatctcgcactcgcgctttctctctctaggattcgacaatggcggccgctccctcgcctcgcgaagagaacgtgtacatggcgaagctcgccgagcaggccgagcgctacgaagagatggtggagttcatggagaaggtctccgccgccgccgacaacgaggagctcaccgtcgaggagaggaacctcctctccgtcgcgtacaagaacgtgatcggagcgcgccgcgcctcgtggcgcatcatctcctcgatcgagcagaaggaggagagccgcggcaacgaggaccacgtctccgtcatccgcgactaccgatccaagatcgagtccgagctctccaacatctgcgacggtattctcaagctcctcgactctcgcctcattccctccgcttcctccggcgattccaaggtcttctacctcaagatgaagggagattaccacaggtacctcgccgagttcaagaccggcgccgagcgtaaggaggctgccgagagcactctctctgcatacaaagccgctcaggacattgcaaatgccgaactgcctccaactcatccaattaggcttggccttgcacttaacttctctgtattttactacgaaatccttaactctcccgatcgtgcctgcaaccttgcaaaacaggcttttgatgaagctattgctgaattggatacactgggagaggagtcatacaaggatagcactctgatcatgcaactccttcgtgataacctcaccctttggacctctgacatgcaggatgatggagcagatgaaattaaagaagcagcaccgaaacaggatgaccagtaaaaatattttactgctaattagaattgaacttctcctccatatctttttgaagggagaaggtgtttgttgctaatatctctttggtactgagattttaggcattcatgtttgttatgattgtggatgtactgggccgtttttagtttgtccttccattttcaagtgttttccaaattgcctattttattaaggacgctgaagtttttattatatggaattggaattttaag

SEQ ID NO: 352 - DNA, 1093 bp, Glycine max
ggtctccctcatttgttcactttctctctctaaatccctaaaccagatctcgcactcgcgctttctctctctaggattcgacaatggcggccgctccctcgcctcgcgaagagaacgtgtacatggcgaagctcgccgagcaggccgagcgctacgaagagatggtggagttcatggagaaggtctccgccgccgccgacaacgaggagctcaccgtcgaggagaggaacctcctctccgtcgcgtacaagaacgtgatcggagcgcgccgcgcctcgtggcgcatcatctcctcgatcgagcagaaggaggagagccgcggcaacgaggaccacgtctccgtcatccgcgactaccgatccaagatcgagtccgagctctccaacatctgcgacggtattctcaagctcctcgactctcgcctcattccctccgcttcctcctaggattccaaggtcttctacctcaagatgaagggagattaccacaggtacctcgccgagttcaagaccggcgccgagcgtaaggaggctgccgagagcactctctctgcatacaaagccgctcaggacattgcaaatgccgaactgcctccaactcatccaattaggcttggccttgcacttaacttctctgtattttactacgaaatccttaactctcccgatcgtgcctgcaaccttgcaaaacaggcttttgatgaagctattgctgaattggatacactgggagaggagtcatacaaggatagcactctgatcatgcaactccttcgtgataacctcaccctttggacctctgacatgcaggatgatggagcagatgaaattaaagaagcagcaccgaaacaggatgaccagtaaaaatattttactgctaattagaattgaacttctcctccatatctttttgaagggagaaggtgtttgttgctaatatctctttggtactgagattttaggcattcatgtttgttatgattgtggatgtactgggccgtttttagtttgtccttccattttcaagtgttttccaaattgcctattttattaaggacgctgaagtttttattatatggaattggaattttaag

SEQ ID NO: 353 - DNA, 999 bp, Triticum aestivum
cgccgagaaacagcaacagccacagccacacgcccacgcgcacacaccagatcgtcgacagcgatggcaaaggcagcggcaacgagggaggagatggtctacttggcgaagctggcggagcaggccgagcggtacgaggagatggtcgagttcatggagaaggtcgtggcggcggcggggaccgtcgagctcaccatcgaggagaggaacctgctctcagtcgcgtacaagaacgtcatcggggcgcgtcgtgcttcctggcgcatcgtgtcctccatcgagcagaaggaggaagggcgtggagcggcggggcacgccgccgcggcgcgcgggtaccgcgcacttgtcgaggccgagctctccaacatctgcgcggggatcctccgtctcctcgacgaacgcctagtccccgccgctgccgccgtcgacgccaaggtattctacctgaagatgaagggagactaccatcgctacctcgcggagttcaagtcggccgccgagcgcaaggatgccgctgactccaccctcggtgcctaccaggccgctcaggacatagccatgaaggagctgccaccgactcaccccatcaggctgggcctcgcgctcaacttctccgtgttctactatgagatcctcaactcgcctgatcgtgcgtgctcgctcgccaaacaggccttcgatgaagccatcgctgagctggattccctcggagaagattcctacaaggacagcaccctgatcatgcaacttctccgtgacaatctcactttgtggacctctgatatgcaggatgacgctggcgatgaaatgagggattcaagcaagcctgaggatgagcagtagtgaagggtcctagctactgccctctttctctcttaaccttcgggtagttatgatgcttgtacaaggaccattttcgtgtgtcctttgttgctgggtcttttatctaccctttctttcgttatattgttatacatcgccgtcctcgtgcattatttt

SEQ ID NO: 354 - DNA, 999 bp, Triticum aestivum
cgccgagaaacagcaacagccacagccacacgcccacgcgcacacaccagatcgtcgacagcgatggcaaaggcagcggcaacgagggaggagatggtctacttggcgaagctggcggagcaggccgagcggtacgaggagatggtcgagttcatggagaaggtcgtggcggcggcggggaccgtcgagctcaccatcgaggagaggaacctgctctcagtcgcgtacaagaacgtcatcggggcgcgtcgtgcttcctggcgcatcgtgtcctccatcgagcagaaggaggaagggcgtggagcggcggggcacgccgccgcggcgcgcgggtaccgcgcacttgtcgaggccgagctctccaacatctgcgcggggatcctccgtctcctcgacgaacgcctagtccccgccgctgcctaggtcgacgccaaggtattctacctgaagatgaagggagactaccatcgctacctcgcggagttcaagtcggccgccgagcgcaaggatgccgctgactccaccctcggtgcctaccaggccgctcaggacatagccatgaaggagctgccaccgactcaccccatcaggctgggcctcgcgctcaacttctccgtgttctactatgagatcctcaactcgcctgatcgtgcgtgctcgctcgccaaacaggccttcgatgaagccatcgctgagctggattccctcggagaagattcctacaaggacagcaccctgatcatgcaacttctccgtgacaatctcactttgtggacctctgatatgcaggatgacgctggcgatgaaatgagggattcaagcaagcctgaggatgagcagtagtgaagggtcctagctactgccctctttctctcttaaccttcgggtagttatgatgcttgtacaaggaccattttcgtgtgtcctttgttgctgggtcttttatctaccctttctttcgttatattgttatacatcgccgtcctcgtgcattatttt

SEQ ID NO: 355 - DNA, 1323 bp, Zea mays
ccgcacaaactcgtcgcttccgctccacaggatcctctgcgccacccacaaccgtgcgaccgtccgtgctgccggcgaccccgatccgccgacccgtcccgtcccaccacaccctaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctctccgtggaggagcgcaacctgctgtccgtcgcctacaagaacgtcatcggcgcccgcagggcctcgtggcggatcatctcctccatcgagcagaaggaggagggccgcgggaacgaggcgcacgccgcctccatccgcacctaccgctccaagatcgagaccgagctcgcccgcatctgcgacggcatcctcgccctgctcgactcccacctcgtcccatccgccggcggcgccgagtccaaggtcttctacctcaagatgaagggtgactaccacaggtaccttgctgagttcaagtctggtgcagagaggaaggatgctgcggagagcaccatgaatgcctacaaagctgctcaggacattgctcttgcagatctggctccaacccaccccatcaggcttggcctcgctctcaacttctcagtgttctactacgagatcctgaactcccctgatcgcgcctgcaaccttgcaaaacaggccttcgatgaggcgatctctgagctagacagcctgggagaggagtcctacaaggacagcactctgatcatgcagctcctgcgcgacaacttgaccctatggacttccgacaccaacgaggatggcggtgacgagatcaaggatgctgctgccccgaaagaatctgcggagggtcagtaagatggattcagtctcacgacctgctgctgctgatgttgaggagtgaccagaaccagaaccgccgtcctcgattctgatagattatcttctagtataccttgtgttgttgctgttgttgtcgtcgtcgcgccggtgtatgcgatgaagctgccattgctgctgttttaattaagcattctagatgttataccgcatgctttgtttcggtttctatgtcgataaatggtggccggatgctggttttcgtgctccgagccggccaccaggaagaagacctgcctgcccttgtgggtgcagcgttgttagaatgacctacggtgtatttgactttgacaggcctgctgcctagtggactgatattctgttatgcgcaaagctatttgccttgaaa

SEQ ID NO: 356 - DNA, 1323 bp, Zea mays
ccgcacaaactcgtcgcttccgctccacaggatcctctgcgccacccacaaccgtgcgaccgtccgtgctgccggcgaccccgatccgccgacccgtcccgtcccaccacaccctaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctctccgtggaggagcgcaacctgctgtccgtcgcctacaagaacgtcatcggcgcccgcagggcctcgtggcggatcatctcctccatcgagcagaaggaggagggccgcgggaacgaggcgcacgccgcctccatccgcacctaccgctccaagatcgagaccgagctcgcccgcatctgcgacggcatcctcgccctgctcgactcccacctcgtcccatccgccggcggcgcctagtccaaggtcttctacctcaagatgaagggtgactaccacaggtaccttgctgagttcaagtctggtgcagagaggaaggatgctgcggagagcaccatgaatgcctacaaagctgctcaggacattgctcttgcagatctggctccaacccaccccatcaggcttggcctcgctctcaacttctcagtgttctactacgagatcctgaactcccctgatcgcgcctgcaaccttgcaaaacaggccttcgatgaggcgatctctgagctagacagcctgggagaggagtcctacaaggacagcactctgatcatgcagctcctgcgcgacaacttgaccctatggacttccgacaccaacgaggatggcggtgacgagatcaaggatgctgctgccccgaaagaatctgcggagggtcagtaagatggattcagtctcacgacctgctgctgctgatgttgaggagtgaccagaaccagaaccgccgtcctcgattctgatagattatcttctagtataccttgtgttgttgctgttgttgtcgtcgtcgcgccggtgtatgcgatgaagctgccattgctgctgttttaattaagcattctagatgttataccgcatgctttgtttcggtttctatgtcgataaatggtggccggatgctggttttcgtgctccgagccggccaccaggaagaagacctgcctgcccttgtgggtgcagcgttgttagaatgacctacggtgtatttgactttgacaggcctgctgcctagtggactgatattctgttatgcgcaaagctatttgccttgaaa

SEQ ID NO: 357 - DNA, 5401 bp, Oryza sativa
gaggtgaggaggaggaggttaggttacctaggtttttggagggggagatggccggagcgggagccgtgggggggagcaactgggaggagatggtgaggaggatgctcccaccggggaccaccatcccggaggcgccggccaacctcgactattcgattgcgctcgagtacgacggccctccggtgtcctacgagctccccaggatcgatcccgtcgacctgccggcgattcccaccgcgcagcccgtctccggcccgctggtgcccgggaggagcaacggcgtggtggctccggtcgtcaggccggtgtttatgccgccggtgcaccggaagcaggatgctcaccgtgccgagccaccgccggttgcggcacagggtaggaggaggagaagctcggaatcggtcgattcggcgccgcagaatgaggggttctctgatgatgatgactcatgctcggtgtcgcaagaatccgcgcacaatttccatgggcagagaggtggtaggacagctgctcaggagggaagaagagctcaggttgtcacatttggggtcactgaggacagcaggtatgagagcaaagagtttgatgatgtgtcggaacagtacgtggcggtgaccaagaaggagaagagagggaggacctgcagccgttgcggtaaaaggaagtgggagagcaaggaatcatgcattgtttgcgacgcgaggttttgcagctactgcgtgctcagggccatgggctcgatgccagaagggcgcaagtgcatcacttgcattggccagccaatcgatgagagcaagcggtcgaagctcgggaagggttcgaggatactatcacgtctgctcagcccgttggaagtaaggcaaatactgaaagctgagaaggaatgccaagcaaaccagctccggcctgagcaactcatcataaatggttttcctcttaatccagatgagatggccagcttgcttagttgccaacggcctcctcaaaagctcaagcctggaagatattggtacgacaaggagtcaggcttgtggggaaaggtaagcctgttagtgttggtaggagaagagcataccttcttatgcagtctgagcttttgctaatgacattttgttcctgctgataggaaggagaaaagccagacagggttgtcagcactaacctaacctttaatggaaagcttcagcccaatgccagtaatggcaacactcaggtttatatgaatggaagggaaattaccaagattgaactgagagttctgaaggtatcagtgttctatcattgtacatctatctttgaaagcgggtacaattgcagaaatatccattatgaaacaatattaatatatatgacacatttttttaagactatgtctaagttatatcatagacacactttcttataggcatacagcctttcatagaatttcatatgattgttcaaaccaagaagacaatattacgggagaaactaggtgtatactgtataccatccaaattttcttctttagaaatataccacataccacaaaaaataaagtttactttaataccgtccaaacttcataactcttgtaaattgaccactatcattaccacctgttggaccaactaatagctattgaactagatggctgatctggtgtggcttggctttgggtaagaaggattggcctctgtctagtgcctcactttccttctgcggttctgtctactgtcctggtttggaagaagtcaaaccaagccagatcagccatctagttgagtctctcttaggagattggacgtgaggtaacgggaatagtagttgatgagatttgtgaagtttggatggtcttaaagtgaacccagcaattttggtgttatctatcttaagaggaaagacttgagtggtatacccaatgttgtattctattaatagcaaaacacatgaagatgaatgtagcatgtagtctgactataatttcaccagattaagaaagagtgtaaggactatgtgcgtggtttttaggaaacgaataaggcgattttttttgctggtactataattgtgctatcactatcactgaatttgcctcaatatctgaatcattcttgtagattgcacaagttcagtgcccccgtgacactcacttttgggtttaccatgatggtggctatgaggaagaaggccaaaacaatatcaaagggaagatatgggaatcggtatgtatcttgctcaaaggagttctaaccactttggcaatcatggattagctcacttttataatcgtgttctattttccttcttttcctctgctgcccctctccccgtacataatccagtgcattctcccttccctctttgtaatttatcttatttttaatatttaatgcagtaggagcctctcctactgtttcacgtaaagaaaaaggagttctaacccattcattgtacttcctaaaactactgcatgtcttgttgttttcttaacatgattttgcatgtccttatttgcagcctgtgacacgttttgcatgtgccttgttttcactaccggttcctccagcaaactctgacgaaccaaaggacgaagctccttattcagcaagaactgttcctgattacttagatcagaaaagaatccaaaagcttcttattcttggatcgcctggagctggtacaagcaccatattcaagcaggtacgaccaaatttgacatttaaaactgcagtaaacttttactttgttatacatctcttagggtggactctacctttacctactggccctgtatgatatacagcttgaatttgatttatagtctccgtttagtgacatagaaaccttctcgccgttcggaagcacaggactgcaggttaactgttataggtgacaatcacatatgcaacgtgacatgacattctgcaaactatcactgatcaattttcatgtgtagtttagttatctctggtgtgtttcttttccaataaatgcctgcaaatttttatggagcaccacacaagttattcattctgatatgtggatgcacagtttccagtggacaattgaggagtcagccctattatttatcttgtatacatttgcatgatgtttttttttctcaaaacaggcaaagttattatacgacactaggtttacccaagaagaacttgatagtatcaaacttatgatccaaagtaatatgttcaagtaccttgggatccttcttgagggccgtgagcgttttgaggaagaggctttggctggatcgaataacccaagctcagaggatgagaatacgcagcatggtagaaccacagctaacacatattcttcacttctatttttcagggctatatgcaatatctttaagtttttcttattgatgcagatggaaataaatcgaatggttcagattcttgcatatactcgataaatgcaaagctgaagaagttctcggattggcttttggatataatagcaatgggagacctcgatgcattcttccctgcagctacgcgtgaatatgctccaattgttgaggaaatgtggaaggatcctgccatacaagcaacatataaaagaaaagacgaattgcattttctccctgatgttgccgaatatttcttgagcagggtatttaactcagcttatatattaaacaaagagtgaatttatcattgaaaacttgcattattattcacaacctgcctttgtgcattgtgctacaccagtacctattatggttataactttataagtgtcagtgaatccctctagattcctatatcatatctgttcctaaaaattctacaacagcttgaaccactaatcatttgccttactccggcaccaagcataacataatgtgcccctgcacttactttttttttttgtgtacactataggtgtttgaatccctcattgacttgtctttttatgacatccttgcaggccattgaagtatcaagtaatgagtatgaaccttcagagaaagatataatatatgctgaaggagtaacacaagggaatggattagccttcattgagtttactctggatgaccgtagccctatgtcagaaatgtacactgacaatcatgagcctcactctcagacactaaacaagtaaactctttcttcatgactcatgcctgaagtgcatataaatcctttaatagtacacatctctacatatccatataccctaaacagtgccttttattttccttttccatccgtcattttttttgttactagctctctataaataaaatagccttagatattaaattgttggcaatgtatctttcgattgtggtaaaatgcatttctactggtcagtgaaataggtaggctacctgctctttgcttggggtgattatttatttgccctgcgaagcaagtaccggaaagctattgtctcatcagcttttattccttttcagatatcagctgattagagtaagtgccaagggaatgaatgagggatgcaagtgggtggaaatgtttgaggatgtcagcatggtaatattctcggtagcactcagtgactatgaccagctgggggccccttcaagtggtggcaacagtccccttgtgaataagatgatccaaagcagggacttgtttgaggctacaatcaggtactattggcattagccagatagttttgtaactttaacagttccataattgcgcataatcagaaaaaagatatttaaagtgacaagtgatagatcaagggaggttggtcttgttccaattgaatctagtaatagtttgggaggattgcatacttcatatttgcgaataccgtattgcttgtgtacaaaatggacaatgttacagcttgtttcaattgaatctaatagtttgggaagattgcacatttcatatttgcgaataccatattgcctatatataatgcgaacaatgttacagctttcctgaaattagtaaaatctcattccaggaccaaagttactaacctatacttgtcccaggcaaccatgtttccgcgacatgccatttgttcttgtgctcaacaagttcgacctcttcgaggagaaaatcgggcgcgtcccgctctccacctgcgagtggttcagcgacttctgccctctccggactcaccacaacaatcagtcgctggctcaccaggcgttctactatgtcgcgatgaagttcaaggagttgtacgccgcctgcacggatcgcaagctgttcgtgtggcaggcgcgagcccgcgacaggctgaccgtcgacgaggccttcaagttcatcagggaggtgctcaaatgggaggatgagaaggatgggggtgggtactacccagatgagtccttctacagcaccacagagctcagctcctcacgtctgatcagacaagaatgatgcacattttgcccagaaagaaa

SEQ ID NO: 358 - DNA, 1201 bp, Saccharomyces cerevisiae
tatgaaatgcagggtatggtcagaggctcgtgtttatacgaatatcaataaacaaagaaccgaggaatattgggattatgaaaatactgtaattgattggtccacaaatacaaaggactatgaaattgaaaataaagttgggcgaggaaaatactccgaggttttccaaggtgtcaaattagactctaaagttaaaattgttattaagatgttgaaaccagttaaaaagaagaagatcaagagagaaatcaaaatcttaacggatttgtctaacgaaaaagtgcctccaacgactttgccatttcaaaaagatcaatattacacaaatcaaaaggaggacgttttaaaattcatcaggccctatatctttgatcagccacacaatggtcatgcaaacataattcatctatttgatataataaaggatcccatctcaaaaactccggctttggtcttcgaatacgtagataatgtggacttccgtattctttaccctaaattaaccgatctcgaaattaggttttatatgtttgagttattaaaggccttagactattgtcattcaatgggaataatgcatagagatgttaaacctcataacgtaatgattgatcataagaataaaaaattgcgattgatagattgggggcttgctgaattttatcatgttaatatggaatacaatgttcgtgttgcgtcgaggttttttaagggtcctgaactactagttgactacagaatgtatgattattctttagacttgtggtcgtttgggacaatgttggcttctatgatctttaaaagagagccatttttccatggaacgagtaacacagaccagcttgtcaagatcgtcaaagtacttggtacaagcgattttgagaaatacctgttgaagtatgaaattaccttaccgagagaattttacgatatggaccaatacatcagaaagccttggcatagattcatcaatgatggtaataaacatttaagcggcaacgatgaaattattgaccttattgacaatcttttgagatatgatcatcaagaaagattaactgctaaggaagcgatgggacacccgtggtttgccccaataagggaacaaattgaaaaataagaaataaataatgaatgaaataaaaaaaaaaaaatcactgacaaacgatataacgattacttttttttaccatctgtacaa

SEQ ID NO: 359 - DNA, 4201 bp, Oryza sativa
cccatccctcgcgccggaagagaggtacatggcctggtgcgccgcgcgcagccgcctcctccccctcgccaccgcgccgcagctgctccgccgcctcctcctctcctccgctgcggccccgcgctacgcgcacccccaccaccaccacagcaacagccgccgccgccgccgccccctcgcccccaccgtctacgccgctgccgcggcagccgcagccgaggcgccgctccccatgccgccgcgcatcggccgcgccacgcggcaccccgggggcgccgcctccgtggcgcgcgtctacgccgacgccaactcccagcggcccaaggagtactgggactacgagtcgctcgacatcgaatgggggtatgtatgagccatggtggtggcgggggagctgatctcgaacctccagatttgggggctagggtttgtgctctaatggggatgcactttgttgtgcgtgtgtgtagggagcaggatgggtacgaggtgctgcgcaagcttgggagggggaagtacagcgaggtgttcgagggattccggcccgggggtgacgagaggtgcgttattaagatcctcaagcccgtcaagaagaaaaaggtaggctttgccctcatcaaaatgtagtatgcctctgcggtggaactttcaattgtatggtccaaatttagcttccccacagatgtctcagtaatatttgtcatttctgttagacttacattgcctgcttgaggaatctagggtacacatgagcattaggaaatgcagtttaggctgattcctcagctggtcgtaggagtttgggatgatgtggctccatgagtgttattttgccttgtgtgataaacaaaatcagtagaaaaacttgtcactttcaaatcttatcgatgttaagtcttattagaggaaagtgtagttcaatgaggtaggtgttatgttttttgcttggttgcatagtgttctcgttgcatcttttactatagttcatgtgtattcttagcaatccttactgaattcttttatgatgatgcagataaagagggaaataaagatacttcaaaacttatatggcggaccgaatattgtaaagctacttgatgttgtcagggatgatgaatcgaagacacctagtttgatctttgaatatgtcaacaatactgatttcaaagtactctacccaacactattggattacgatatcagatactacatttacgaattattaaaggtaataatctgaattgcagaatcctatgtctgtaataatcaatgtttttatttatgctatcttgtctatggaacatttctttgtactgatggtattttgagaattttacatgcttggttctaatttctaagaatgtatcatatcattaggagtttggtaccaacttgtcagatataatccactgcttatgtatttttcttcaaacatcacaatggatcgtaggaggttacggagtaaaataatgggactgaaatctatgctcatgtatactgtatgctgataaataattaatttaaattgtcatggtagtttttattcctagatacctttcctgtttaaagctcatatgcatagaaagtggtatgatggatgggtcgattgcgtcaatatgacttggacaaggtttggaagataaaacgatagtttgcctacatgacaatgatgtaacacatctgttcgggaagttggggttatgttcctatcgattgaggcgcgtgtgcaagcacccagaaagaagttttgcttaaaaaaaatgtaaaaggggaacaatcttcaatggccgtgcgagcaatcatcattaataaacctctggttgaattaatcatgacattttgaataacatgtctattggagccagccttgtaaattctagcgagttcaaattaattaaatcaatactagagaataaatagtagtaaataagattagcacggggtatctactacacaacatcaactacattacttcttaatttttcttcgaaatctattctgtagcattttctgacctgtaggttatctgtccgaccagtctctttagtaatgtaagcatgacatttggcaggcttttaccgtgatgtcttttggccaaagtttgcatcgtgtaaacttaacttgccaacgataaggacaatcacagtgcactatgcagacatttgagtctattgcaaattatctgtaatgcttcttggttctcctgttttgaaactttcaaagagagtgaacatactaccgtttatatgtattttataactgtgatagatatcagaagagaccatatttcacatattcataagcagtgagaatgaaattagttcacttgatttattttggaagaaccataaaaggcaacagttgatgttgtcaagttttggtatttttcacatctattttgttctgtgggactacttctgccagattaaattctgcaaaccagattcccatgttctcgattaatgtgctaacgcggtttacaatcaagccctcatcctatttacatcagagatcagactaccttcattttgatggtctttaacttatccaggtgtgtctgtaggcactagattattgtcattcacgaggcatcatgcatcgagatgtcaaacctcacaatatcatgattgatcatgagaaacgccagctttgtcttattgattggggtctagcagagttctatcatcccaagatggaatataatgctagagttgcttcaaggttagtctcccttgcattggaagttcaatgtttcagacttgttcagcttattaagaaggaacttcacttgcatgcctaaccctctgagatccttttatgttggatctgtatttgaggaaatttcaagatctcttttccataactcaatggaaagggtcatgcagggagtgagattcacttcattgtatggtaccattcacatatagttataggataatttcatttacagcaagctttcttaataatttcattattccccactcaagctgatccagtcggttgctattctatagtatcttctgtaaatttcccatccttgacttactgcatgtgtgtgctctcgtgctgtgttattgacagatcttataagggccctgaacttcttgtggatttgctagattatgattactcgttggatttgtggagccttggttgcatgtttgccgcaatggtaagtgcaagtttagggtcagccatttatctttgataacagaaccttattgatatacattatggtaatcttaacagatattccgagtcgaccctttctttaatggtcaggataactacgaccaattagtcaaaattaccgaggtatgtctgtccgtagcttcttaaacttctaagtatttctggcagctttcttgtgttgatttatgcttgacttgtgctttgggacatgtttagctagggttatctttaaatttagtaagattttctgttatagctctaacagaaatgctttagctacctactgaattgaagtaggaactttttctatttggtaactgtgaccaaaccactacgtatacagatgtttacctgccttgtgcaaagaagcaaggcttcgcagtgcatttctcagaactgaagcagctactgattacaaaaaaatgtttattgtgaatgatatatgcaatatgtcattatcgtaggttcttggaacagaagatttctacaattaccttgaaaagtatggtcttgagcttgacccgcagcttgaaagacttgttggaaggtcatgcattactttggataatcttaaatatacatcattctcataacttagcatgatctaactgaatattatttgctgcagacataataggaagccatggtcaatgtttgttaactcggggaacagacacctagcaagccctgaggtgatttgcgttgcctttcaatcaacctactggcttagtcatctcttatttgatgtattttgacatgtttctacctatataggctattgattttgtagacaggttgcttcgctacgatcaccaggaaaggcctacagcaaaggaagccatggtgacaatccctctcctactttatagaagcatatgccatagaaatcctaaatatatgtgctctaaatgcatatatttgctgtgtgcaggctcatccatatttcaatccagtgagaagcacttaaaacggcaggaagagtgcccaatagtggtatgcggcatatttg

SEQ ID NO: 360 - DNA, 1313 bp, Glycine max
attcggctcgagcacccctgacttgaacctcttaccgtgcgcatcttctcaatccataacaacttcgccaccgttgcaccgaaaccaatcgccacaaactcgggatctcagattcgacgcgccaaaccatgtcgaaggcgcgtgtctacacagatgtcaatgtccttcgccctaaagagtattgggattacgagtctctcacccttcaatggggtgatcaagatgattatgaggttgtgcgaaaagtgggcagggggaaatatagtgaagtttttgaaggcataaatgtcaatagcaatgagcgctgtataatcaagattctgaaacctgtcaagaaaaagaagattaaaagagagataaaaatacttcagaatatttgtggaggcccaaatattgtcaagcttcttgatattgtcagagatcaacattcgaaaactcccagtttgatatttgagtatgtcaacagtacagattttaaagttttgtatccaaccttgactgattatgacatacgctattacatatatgagctccttaaggctttggattactgccattctcaaggcattatgcatagggatgtcaagcctcataatgtcatgatagatcatgagttacgaaaacttcgcttgatagattggggtcttgctgaattttatcatcctggaaaggaatataatgtccgtgtggcttcaagatactttaaggggcctgaacttctagttgatttgcaagactatgactactcattagacatgtggagccttggctgcatgtttgctggaatgatatttcgcaaagaacctttcttttatggtcatgacaaccatgatcagcttgtcaaaatagctaaggtgcttgggactgatgaactgaatgcatatcttaataagtatcatctggagcttgatcctcaacttgatgcacttgttggaagacacagtcgaaaaccctggtccaaatttatcaatgcagataatcagcatcttgtgtctcctgaggcaattgattttcttgataagctccttcgatatgatcaccaggacaggctaacagctagagaagcaatggcacatccatatttctctcaggtaagggcagctgaaagtagcagaatgaggacacagtaacttgatcacatatggatccataaacttgagttaatatatttgggatttgttttatgataccctaacacgcaccttcgttaccgtctgtttattacagagattagttttcctgtggagtgtattgacattatgttgcagttgaggaataatgttattgccagttattgaaaaaaaaaaaaaaag

SEQ ID NO: 361 - DNA, 4501 bp, Oryza sativa
ggttgcgagagagcggaggctgtggcaggggcgcgccgccgtaggtagggtatgagcggcgcgtacagggatcgggggttcggcggcgcggcggcggagatggaccggaagcgcatcaaggacgtgctcgagaagcacctggacaggtcgtccccgtccacatccaggggggcggcggtggccaaggagagggaccgcctcgccgccgcaggggggaagctgcccgcgccgctcggcaaggccgggaaggtctccgatggtggtaaggatctggtggtttgtttgttccgcgcgaggggttgtgtgctgtttgttttgacggtggttggggttggtggcgtctggtgctacattgcctcaggtctttgcctgctttggttagatgatgatgcagcttctgtttgtttctcgggtagaatcttagggtgaaatttggtgcgctgtcgtgataacgtaggcttctgtatactttctccgatggatgaaatgggatgtaagagtctggatgttcaccgcattaactggagctgaagtaagcgaagttctacatttctgtttgaacttcacgtgaataccatcccacgtactgcattaattgatgttatgacttaaatatgttcacgaaacatcggttagttctaaacaatgttttaaaaagcggtatgtagttttgtgcggtcaccccatattgtagcacttatgcggcatagtcagacgcttatgcggtataatcgaccacttgtacggctaagcggtacaaggttggggcacctgttccttgtatgtggcgaccttctttttagatgctggttctagaagcagtaacaattactaaataaataaacgtgcactggaagtttatgagaagccggtcaaagtagggtcttaatgcagtcaaagcatgcaatggtgaaagaatcagatgacagaagctacaataaacgtaggcaagtatgggttagggcaccttatgatatagaattcttaggcaagttggtttttgcgaggcattagggtaactggccacatggaatggaattttggactggtagttattctaccatggcagtggctgtttaattaggtatgcatgagacacaattagagcaatgtatttttgttgcagtggcaattaatgcgatgagttaaagaggtagcgaagagtttgagacgcgtgaatgccattttgcatacagtcgtcttaacaggataatattgaatttatcgaatgtttagcagccccctttatatgttgatgtactgtaacataggactgaactggcaacggcatccatatgtagccctaacaaatctcagaagagaaaactaacatgtccaattgaaggaccttctatatgagatgacccaatgtcttgaatagtttcagtcatattgtattgtttgtttgtctttggggccagtggagatctgaagaatttctctatctgtgagactaacatgatattgaaggcaaagagcaattgctaaaagcattaacatgatgtcatgatgttatattagtgccttgataggttactgctttatgaggaactcgtttggcatgaaaaatcctccatttgcttccttactttattggtttttgtctctgtagaacatttattttgctttcagatgtcaattactctattggaattttgggcatgtcattagctgtaatatatacagtgttgaaataactttcagctgtgtagtgacaaatgataaaaactcgacccaaggggagagacatcccgaaggcattacacttaaggtcgaagaaaaggccctgaaagccggctcttgcttgtacaagggctccattgccacaagccgtatcttaacccatactttagggaccacacaccgagggtccttttgtttgtgagaaccagggttgaaaccctggttgacaacttcacaactggaggacttgctgccgtgctataagcatgttctcaaaaacttgaccaacctagggggaactaggtgccttttttatttaagaagaaataggcacctgaattcgcttcgatgaggacttgaacttgggcggtctgggcatcaatgtcctcgaccaactgataatgtctttatacatttcacagctcatgttgaaccaaaaaaggggcataattgcaagcttacagttatatctgtagccagtgggcagcggtaattaattgtagtttttgagtgatcagtttccataataagaaccgggaggaaccaaatgtgatggcatagcacttggggagttggggtataggcagcattgattgatctcaactcttttgtttccatttgtgtcatacattccagtttgaccgatgtttgcacgtgtagagccgtcatgatctgatcacacaggaagactctctttttgtttgaattgaaaagggaactattccagtgcctccactgatgactcactgaacatgctgcttcactttgaccattttgtttgtcaatttcgcttgatatgcaaccagggcggtaacacacctattgtgtggttgatgtgaacagaaactggtacatcataatagcaccaaaagaagaggatagattgcacaatagataagtagagcaccagcaagcagaagattgaacctaggactagcatcttagtactccaacaacaccttctttaatgagttatgaaggagggggtaggaggttactttgacttggaaaccatagaaactcttggggatgttatatcaaactacactgaacttagttttacagtgatatgaatgtttgtgcagtgatatgaatgtttctttaatttctctgtgcatcgatatgaatgtttgtggtttttcaatctgtaagaaaactgcttgcttttattatacacttgaaattcataatattgtttggcagggtattacttgtgactattgctttactgcagtaactgcaattattaatatgtaattttttaatcatcattaggtgcctctaatcccttttttcttttgggtgcagcagaagaatttgaaactgacagtgaagattcagatgtcagtggttctgagggagaggacacatcttggatttcatggttctgcagtttgcgcggcaatgagttcttctgtgagatcgatgatgattatatacaggatgatttcaacctttgtggtctgagcaatcaggtgccatattatgactatgcacttgatcttatcttagacatcgagtcttctaatggtgagattatttttctcttaagaaagctactaattcattatttgcagtaaaatacactgttcatataccatttatgaatgtcactagctgcaacctatatttttcataccactttgtatcctaacatacttttttatgttcatcaatctcattttctaaaggagccatttccaataacctatttataaacattccacagttcaaagtctgaaacatgtattgtatacacatacacccttctaagtcagaccatttgtatacaggtgatgtgttcactgaggagcaaaatgaattaattgagtcatctgcagagatgctgtatggattaattcatgcaagatatatcttaaccagcaagggtctggctgcaatggtaatctgctagcagtttgaccatatttgataggctatgcttgcttccttgactacttgaatactaaattattctgcttttgccttctgcagttggagaagttcaagaactatgactttggaagatgcccccgggtatactgttgtggccaaccctgtcttcctgcagggcaatcagatattcctaggtctagcacagtgaagatatactgtccaaaatgtgaagatttacattatccaagatccaagtaccaaggcagtatccttttgattgtttgtcttagatgtgttttatatgaactgctttttttcttaataaattgtactcatatatggagttaaaaacgaggtgatatctgatagggcataaattagaaattgtgatttcctaagcagaatcagacttattattcgcaacagctaaagcaaagcacaacacgaacataggcagaattatgaatacatgacccatttgtgctgctctctaaaacacatcctttaaaaaatcaaactactgagtttttatgccacctgtaatggatttcaccactctcagtttctccaagttataggttggtttttaggcagcacttgaaaaggggctctgtgtagaggattctcattcaaacatggttttcctttattttttttatgcgactcatacaatttgattagatttgtttggaacataaccatgggtaaacaaacattgattttgtgctatcatgaatattgtgttactatttttcttgcacttgtatctcctttactttgctaagacattgacggagcgtactttgggacaacattcccacatctcttcctgatgacatatccacacttgaagccacaaaagccatctcagcagtatgttccaaaagtttttggcttcaaacttcacaagcagtcatgacaa

SEQ ID NO: 362 - DNA, 1239 bp, Saccharomyces cerevisiae
ttctcctatttcaatcaactagacgtagttcaaggattgcaaactgtcctgctttcttttatctggtctttttatcccgaggtattgttgtatataccactactctgtgattttttttcactcttgggaaggaaagaaaaagtgaaaacatcaactggtaagtgtctaatgacaaaaacaggaggtagttggtacgtgcaaaacacgatagtgacgttaatccgaatctgtaaattggtgaattggtatttagaagcgaccattagctaaaagagagagaaaactatgtcgcaagagtttgtggaagactattcacgtacagggtcctcagacgacgaggatagtggagcttatgacgagtggattccatcgttctgttccagatttggtcacgagtacttctgccaagtcccgacagagtttatcgaggatgatttcaatatgacctcgttatcccaagaggtaccccactaccggaaagctctggatttgatattggatttggaggctatgagtgatgaagaagaggacgaagacgacgtggtggaagaagacgaagtggatcaagagatgcagagtaatgacggtcatgatgaaggcaaaaggagaaacaagtcgccagtggtgaacaagagtattatcgagcacgcagcagaacagttatacggattgatacatgcaagatttattctgaccaagccaggcctgcaagcaatggctgaaaaattcgaccacaaggaatttggaacgtgcccccgttactattgtaatggcatgcagttgctgccttgtgggttgagcgatacagttgggaaacacaccgtaaggttgtactgtcccagttgtcaggacttgtatcttccccaatcatctagattcctgtgcttagaaggtgcattttgggggacaagcttccctggtgtgttcttgaaacatttcaaagaattggaagagtatgtggaaaggaaaagtaaagagtcctacgagttgaaagtttttgggttcaggataaatgatgaggcagtatctggtcctagaatgaagtggttgagacaatatccatccacggaggaggactgggaagaatttgccaaatgcgagttcgagacaccggcggtttaacccttgatttattttcctctttgccctaccatatacatatgtactttacctatttacattgtttcagtttttatatcaccactattattattattactattaccactttggagtact

SEQ ID NO: 363 - DNA, 1342 bp, Zea mays
gccgctccaaagcagcccgtggttacgtcagcgcccgcgtactgctcccttcttcctcgttgctccgcccccttttgtcgtcgcgtcctcctctcgaggcctcggcagtcggcacgaggacgcgcgatcccgtcaccgctcacctccttctccaaacactgactccgcttcccgtccccatcccgctgcgcaagatcgggaggggacgaagagaggtcgaccgggaggagatgcaccgagaccgaggcgtctctgcggcagcgatacccggtgaccggaagcggatcggcgagcctatggacagatcgtctccatctacgtcgtgggggttctccggagggcgcgagaaggagcggatcggcgtgggcaagcagccggagatgcctcgctccggcggcggatccaccgccatgtccaagagcaagctctctgacgaatcagaaactgacagcgaagaatcagatgtgagtggttctgatggggaagatacttcgtggatttcatggttctgtagcttaaagggcaatgaatttttctgtgaggttgatgatgactacatacaagatgatttcaacctctgtgggctaagcaaccaagttccatattatgactatgcacttgatctgatattagatgttgaatcttcccatggtgatatgttgacagaagagcaaaatgaacttattgaatcagctgctgagatgctctatggattgattcatgttcggtatattattacaagtaaagggctgtccgcaatgctggataagtacaggaacgttgagttcggcagatgccctcgagtgaattgcagcggccaaccatgccttcctgttgggcaatcggatgttcctcgttcaagtacggtgaagatttactgccctagatgtgaagacatctacactccaagatccaaatatctaagcaacatcgacgggacttactttgggacaacattcccccacttgttcctgatgacatacccgcatttgaagccccagaagccgctgcagcaatacgttcccagggtatttgggttcaaaatccgtaagccatgacaaatttgaaggttgaatgtataaaaggttcaaatagcgccctgttatctgctggccccgcagtgttcacacgacacgtcatcggaatacacctgacccgcggctgacctccctagtctggtttcttgctctggcctgaaattctgattgatgcttgtggtttctttagcctagtgaatcaatccatatttttttacgatcatacgtattatggctttaatggtttaacaaccatctatatttttgttggcacggttcatattcgttttttactctgattgttt

SEQ ID NO: 364 - DNA, 1284 bp, Zea mays; identical to SEQ ID NO: 143

SEQ ID NO: 365 - DNA, 824 bp, Zea mays
gttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 366 - DNA, 1685 bp, Zea mays
gcccgggccgactccactccaatccaatcctggggcgggcgactgcctccttccctcgatctattctccatcttgtcctccctttgctaaaaataacgaggcagaggcatcttcgatttgacgtgcgcttcctcttcctcgctcgctctcggtcgcagtgatggctgatgtcgacgagtaccgttgcttcattgggaacctgtcctggtcaacgactgatgaaagcctcaaggatgcgttcagcaaattcggcaacctcactgaggcaaaggtggttcttgacaaattttcaggacgttctcgtggtttcggctttgtaacttttgatgagaagcaagccatggaggatgctattgagggaatgaatggactggacttggacgggaggaacatcactgttgataaagctcagccacaaggacctggtagagaccgtaatggtgaccgtgattatgaccgcgagcgtggatctcgttatgaacgtggtcgtgactatggtggtgggcgtgcaccgcgaggtggtggtggtggtggtggtggtggtgactgcttcaagtgtgggaaacctggtcattttgctagagagtgcccatctggggatggtgggagaggggacagatatggtgggagagatgacaggtatggtggcggtggcggtggcggtggcggtcgttatggttctgaccgtggtggtgaccgatactctggccgtagccgagatggcggcagctatgggggtggcgatcgctacagccgtgaccgatcaggtccttactgatggccttagttcttgattgagaagtatgtgccatccaggcatatgacttggtcatagtgcttggcgcttggatcctgcatgtttgcttgatgtgctatttggctattaaaagatggattttgtcactgtgtttgatgaccctggtcctaattaagcttatgcctgtgatacgggggattggatggcaagttagtgtccgcatttgtgttcttttcggggaagcaaggggttgactactataatctacttgaacacacctacagctacaagaaaaaactatgttcttgttacctcttctgaaagcaagtgatgaatcgtccattagagaaaattaactggcttctttttggttatttgttcttgttgtggattggttgatactgtggttctggatttggttacttgcgtcctaagatcattttagtctggccagttgatccacgaatgcaaagagattatcctttggttccattctatgtgcctttagcattggagggcctctatttatggttgcttgatgaactggttatgtttgcttcgccatgttggtggggtgttccttgagctgtcccgtgttccttgtgacttgtgagaacaccagaggttatgcttgcctgagtggatgtgatgctacctggttgctgttcctttgacaatgcaccaatgtcctatcgcagcttatatactctggttccagattaattactggtgcccctttgagaggagttatgatgatgttattattcatcagcagcattctaattgcccttgatttagtgtagcctttttttcttagttcaccgaatctcaggatgcaaacgttaggttacttttactgttcgtactaaccaattgagcttttgtactaaaaaaagtatgttacattaagctgctccaggttccgttt

SEQ ID NO: 367 - DNA, 835 bp, Zea mays
agctggcaggcacatgacacatcgccccagccccaagtccaaagccgcgagaggcaggggcgcagcaaaaccctagccgccttcccgtccttttcctttcataaaccccaagccgcgccgcaatagctcgccccctcgttcgccgcctctcctgctcctaccgcagctctccctcaggtttagtgttcgcaatggcggccttcaacaagcttggtggccttctaaggcacagtgctctggtgagcggtatcactggtggctcttctcctgcagtgttcaatgctgcacggctcatgtctaccaagctatttattggtggtcttgactggggtgttgatgacgtgaaactaagagaagcatttagcagctttggagaggttactgaagcgagggtgatcacagacagggagactgggaggtcaagaggctttggctttgtgaactactccgacagtgatgctgccaaggaagctatttctgcaatggatggcaaggaaattgatgggcggcaggtacgtgtcaacatggctaatgagagacctgctgggaaccgtggtggtggcggctatggtggcggcggctatggaggtggtggctacggaggtggtggcggctacggaggtggtggctatggtggtggcagccaaagctatgatgcttgaggggggcaggatcctattaagtgcattatcaaccaagatatttgaaataatgaactttaggacttggtatgacgttttatgttaagcattgtcaggttttgctattcgtgttatgctgaattgttggaactcctagatgcagaatattacgtattggttttggttcaaaaaaa

SEQ ID NO: 368 - DNA, 717 bp, Zea mays
cccacgcgtccgcaccgccgccgcctttcgtaccgcggcccctaaacccctttcctcgttcccctccgtctctcagttaggcacaatgatgctagctaataagcttggtggtctgctcaagaatgctacgagttcaaatatgtctgtctaccaagcaatcagatgcatgtcatcatccaagctttttgttggagggctttcttatggaaccgatgatcacagtctcagagacgagtttgccaaatatggacaagttattgaagctaagattatccttgatcgtgagtctgggaggtccagaggttttggctttataacttacacgtcttctgaggaggcttcggctgccatcactgccatggatggaaagactctggatggacggaacatacgggttaatcatgctaacgagaggacaggtggcttccgcagcagcggtggttatggcggtgggctgtttaagatggcccagggcttcctcaagtagatatattgtctggccaacgtacgtgtactcttgtagtatctgttacgtaattagcttcaaaataatgttcccctcgcctttatttgctgttcaagtccctgtaataaccgagaacgttaattgtagcagtgtgttttttatatgattaaataagtactatgttgtataaaaaaaaaaaaaaaaaaaaaaaaaaaaaaaaaaaaaaaaaaaaaaaaaaaaaaaaaaaaaaa

SEQ ID NO: 369 - DNA, 1201 bp, Saccharomyces cerevisiae
gagatgagctgcctactgctcaccttgccgtttccaaaaaagagttagaaccgacaaattcatccaaagaaaataatgagcaagacagccgtgaaagattctgctacagaaaaaaccaagctaagtgaaagcgaacagcactacttcaattcgtacgatcactatggtattcacgaagagatgcttcaagatactgttcgtaccttatcttacagaaacgcaattatccaaaataaggatctttttaaggacaagattgttttagacgtcggttgcggtaccggtattttatccatgtttgccgctaaacacggtgcgaagcatgttatcggtgttgatatgtcaagcattattgagatggcgaaggaattggtagagttgaacggattcagcgacaagatcaccttgctaagaggcaagttggaggacgttcatttaccctttcctaaagttgacatcataatttctgaatggatgggttactttctactatacgagtccatgatggacaccgttctttacgctagagaccactatttggtagaaggcggtctgatctttcccgacaagtgctccattcatttggccggtttggaagactctcagtataaagacgagaagttgaactactggcaagacgtttacgggtttgattattcgccatttgttccgttggtcttacacgagcccatcgtcgacaccgtggaaagaaacaatgtcaacaccacctcagacaaattgatcgaatttgatttaaatacagtaaaaatatcagatctagcgtttaagagtaactttaaattgacggccaagagacaagatatgattaatggtatagtcacctggttcgacattgttttccctgcaccaaagggtaagagacctgttgagttctccactggtcctcatgctccatacactcactggaagcaaacaatattttatttccctgatgatctagatgctgaaactggtgacaccattgaaggtgaattggtttgctctccaaacgagaagaataacagagatctaaatatcaaaatttcttacaagttcgaatcgaatggcatcgacggtaattcaagaagcagaaaaaacgaaggttcttatttaatgcattaagacttttgtttgctggagaaagaaaaaaatttgaaaagcaaataaacaaacttgttcatattattgacgcgaatatgtg

SEQ ID NO: 370 - DNA, 1765 bp, Zea mays
cccacgcgtccgctgtcctctcctcccttctcatcatttcgccatgctgccatcgcacctcaacggccactccgccctcgggcgccgtcgcccgcgcctctccgccgccgccggggagtctccggcggcagcgggggtagaggcggcggctccgctggaggagcacgaccgcatctacttccaggcctactcccatctcggcatccacgagactatgatcaaggaccgcgtaaggaccgatgcttaccatgcagcgatcatgcgccaccagaaatttatcgaggggaaggttgtgctggatgtggggtgtggtactggaatactctctgtgttctgtgctcgtgctggcgcaaagcgagtgtatgctgtcgaagcctgtgaaattgttgtccaggctcgtgaaattgtaaaagcaaacaacctaactgatcagattgtggtcatccatggacgtgttgaggatgttgaccttgaggaaaaggttgatgttataatatcagaatggatgggctatatgcttctctatgagagtatgctgccaagcgtcctatttgcaagagataaatggcttaagcccgggggtcttattcttccttctcatgctacgctcttcatggcccccgtaacaaatcgtgagagatatgaagacagcgtcgatttctggcgtgacgtctatggcataaacatgtctgctcttgtgccacttgccaaaaagtttacatctgaggaaccctccattgaaacaattggtggagagaatgttataagttggccatctgtgttcaagcgcttcgattgctataattttacagctgaggaattcaaatctatcacttcaaaatacaaagtttcatcaatgatgttagctcccattcatggctttggtttctggtttgaggtggagttcaacgagcctatagagtcctctcataattttccttccagtttggatccacttgagattatacagaagaaaaggagacgatcctcagaagatatagttctgtccacagccccagaggatgagccaacccactggcaacagaccattttgtatttcccggatcctatagaggtgaagcaggaccaaattatagaaggttctgtaacagtgtcccaaagcgaggagaatccacgttttctgaatattcatctagagtgcttcacaggaggacagacattggttaaggactgcgccatgccgatgaactggtgtttttatgcttctagtggcttgatttcaggcgcgcaatggggtgttggcagggaggagctgacaatatttcagatttctttaatggaagtggagaatttgtactaaaaaaaaaaaaaaaaaaaaaaaaaaaaaaaaaaaaaaaaaaaaaaaaaaaaaaaaaaaaaaaaaaaaaaaaaaaaaaaataaaagaaacagggtggccggcttaaagatgccaagttaaagttcttgtgtaggggaagctaaattttttttatagggccgcctaatacaaattcacgggccgggaaaatcacagcggtagcccaaggtaaaaccctggggttacaaaactaattcgcctggcggacattcccttttaggacctgccgtattacctaaaaaaccgaaccgatcctctttccaaaatgggacccccctgatgcggaatgtaaacccccctggaaggggcaattacgcgcagggggacggggagattcgccaaggggtaccgtcacttgtcagggccttatcccccttttttgcatttttcccttcttcctagacaaa

SEQ ID NO: 371 - DNA, 1474 bp, Zea mays
ccctttaaaacgcacaactccataaaccctagcggacaaagccacttgctcacaccagaaccctctccgcaatctccccgcctcgctcccgcctccacccaatggcgtctctccctaacggtggcggcgccgccgcctctggctcatgcggcgcgcgccctgtggacaaggaggtggacttcgccaactacttctgcacgtacgcctacctttaccaccagaaggagatgctctgcgaccgcgtccgcatggacgcgtaccactccgccgtcttccgcaacgcgccccacttccagggcaaggtggtccttgacgtgggcaccgggagcggcatccttgctatctggagcgcgcaggccggggccaggaaggtgtacgccgtcgaggcgactaacatggcggagcacgcgcgcgagcttgctcgcgccaacggcgtcacggatatcgttgaggtgatacagggcaccgtggaagacgttgaccttccggagaaagttgatgtcattatatcagagtggatgggctactttcttttgagagagtccatgtttgattccgtcatttgcgcacgtgaccgctggttgaagccagatggtgtgatgtatcctagccatgctcggatgtggctagcacccataagaactggtttgggtgacaagaagagggaagattttgatattgctatggatgactggagcctgtttgttcaggacactcaaacttattatggtgtcaacatgaatgctttgacaaaggcatatcgtgcagaacatgaaaaatactatttgaagtcttcaatatggaacaatcttcatccaaaccaagttatcggtcaacctgcagctatcaaggaaattgattgcttgacagccactgtcgatgagatccgagaagtcagagcacaagtcacattgccaatcagaatggaagctagattatcagcactggctggatggtttgatgttcattttcgaggtagtgctcaaaaccctggggtggaggaagttgaattaactacagcgccagatgagcatggtggaactcattggggtcagcaggtattcttgctgactccacctctgagtgtgactaaaggagacaacgttaacgtttccttctcgatggttcgctcgaaggaaaatcatcggcttatggatatggagttcacatatgaattgcacgagttatctggcaggaagcacccagcagtcaaaaccaagatgtacttagagtagaacaagatggaaagacggaacctcacgacgccgttgctgaaacctttgctcagaagctgagcatgtagtgtgcttgttacacccatgatgggtacattgagaccatttatgttgtattagtaatatattgtttgattgcccaattaacggggtgagccattgtttcatcacaacatcgatgtgttagcagataaccacatcgccgttttaagcaaacattgagtgcggaaaaaaaaaaa

SEQ ID NO: 372 - DNA, 728 bp, Zea mays
gttctcctcccccttcttaccaagtcctcctcggggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgtccgttctacctttggattaggtgttggtacccctgttgttccctttgtttgctcccgctatgaaacgagacgagagaagaatgagcaaggtttttgttcgc

SEQ ID NO: 373 - DNA, 1629 bp, Zea mays
cttcaccccccctctcggtctcaccctcctggcgacgactgggcggccgaacggccgtcgccgccgccccacgccaggtttcaaagtcttcgtcaggcccttctccggcgactcgagcaccacagggtgacaaggatagctttctcgggtcactgaaggaagacatcttctcgacgcggtagaccttctgacggttggctggttgtgctataagtgttcaaggggtggattaggaccgggaaactctgtactgaagggaaggtcaaaagtgtcaagagagcttgttccaagatggatgaaggtcagggagttaggtattggtgccacatgtgtcaggaggtgatagatcctatgcccgagatgaagtgcccaggctgcgagggcgggtttgtggaggagatggactccgaagacttcgagccagctgcgaacgcgaggtctgatcgctccgtctctctcttggctccactgctgcttggtatgatggggggttcgtcgcgcagatcaagactcaggagggaggccatggttgaagctgatgccgaccaggatgacgaagaggatgattcagaccatgagcttgaactttccaggaggaggcggaggaggaggcgctcatcagcgcttttcagtgtgcttgaggctatgcgtgaccgtgatgaagtaaggggctcggatgacaccgacagtgatacagagagagacctggagagagggagaagggagaggatggagaggcagagggagaggttaaggcagatcgagagggtgagtgctcgtggcagagagaggacggaaagcttaatactgatcaactccaacaacgaggctattattctgcagggaacattcggatctgatgacaaccaggaggactcaagcaacacaagttctggtgtatcacttggggattactttcttggtcctgccttagacactctcttgcagcgtttggcggagagtgacctcagtcgttctggcacaccgcctgccaagaaggaagcagtcgccgcgctaccaaccgtgaacatcgaggaagcgttgggctgttcagtctgtcttgaggatttcgagatgggaggagaagcgaagcagatgccctgtcagcataagttccactcgcactgcatactcccgtggctggagctccacagctcttgcccaatctgccggtttcagttgcctactgaggagacgaagaacaacccatgcgaatcagccagcaccgcagggaccgtgaacggcggtggagacaacgctgctgcaagcggcagcgatacagaaagtactaaccacaatgaagatgaccattccgatagccctatcttctctgctctgagcacactcttctctgatccgttctcatccgacgatgatgaaagtgttccacactcttacgagaactgaagatagcgtcggacgcaggcttgcaatatggtgaagacgttctgcttctgaggctggcatctttatattgtagcttctgtacatatctctctgaacggtcgccccccataagacaaactattacctctccgttttactgaaaactatgtggcttgtaatctgctagtgcttgctatgttcacttgcctcgaataaatgttatcctttagcgtgctaaaaaaa

SEQ ID NO: 374 - DNA, 1374 bp, Zea mays
gccctgtggtgtactggtgtgtcacgcccctcgtcactcaccccgtcagccgcaaccccatcttctattcttcccgacggcgctcctggcagcaggaacaagatgtccaatagggccacacattggtgttatgcctgtcggcggccaattcgtctccgtgggcaggatatcgtatgccccaactgcaatgatggttttatccaggaaattagtgagatgggtggcatattgaacacttatgggctaattgaaccagactttgaagagcgtcgagctagaagattcggaatgatggatgccatgtcttcccttatgcggcaacggatggaagaaatgggaagagatggtttgttcgatattcgtggtagacaaggaacaggtactgaatatggaaggagaccaactgctgttcctacattggtatttggcggcatcccttctcctggagttgatagcggtgatgttaatgttgtcctcaggggaggccgcagagttggcgctgcccaaccaaatttcagtagtttagttgttggtcccagtctggaagccctttttgagcagctacttctccagaacaaccgtcaaggcccagcacctgctccacagtcagctattgactccatgcctgtggtaaagataaaccgcaggcatcttgacgacgatccacagtgcgcagtttgcaaagacaaattcgaggttggagcagaggcacgggagatgccatgcaagcacctgtaccatactgactgcatcatcccctggctggttcagcacaattcttgccctgtttgccgccatccactgccatcacagagatcaggcagtaccagtagcgcccggccttcagcttactacaacgaagccgctgatcctcctggggtcaccagagcagatcttgaacctgctccaagagacggtggcagggaaagccaggaaaggcgccgctccttctcgtttctgtggccgtttggcccgtcgagttccagatccagttcttaccagtacgaacagaatgttgatgagcctgcagtatacgatccaaaccagatagcatattctgagtggcactatgaccactgactgaaaccctgcagcaagtgcaagctatctgcaattcgtgccttcaaccctcagctttggagaggcattcatcagctgtaatggctgcttgccgtataaaaaaaggatggttcttgcctttatattgtgttcagtgcagccttgctccgtatgtccgtcgtatatataatcccttgcgtgtagtaagcggtgaactgaatgcatccagaatatcatgtcatgataaacttgaatatagtttcatggtttatttcagactgaaaaaaaaaaaaaaaaaaaaaaaaaaaaaaaaaa

SEQ ID NO: 375 - DNA, 1233 bp, Zea mays
gttactcacttgggaatcaatgcacatttccctttttaatcatagtgccttgttgacaccttttgtctctgtgcaagcaggaaggatttggaggatgacagaagctgcagttacaaggtactggtgccatggatgtgtgagggttgttgaggaggccatgggggaggagatcaagtgcccattttgtggtggtggattcattgaagagatgattggtgaggaatttgatgggttggccagccagcagtcagagcgggattcatcacaatggggagcgtcgaacaacccctttgagcagccaagggcggaggcggacagtgaggatgaagaagatgatgatgattacgatgatgatataggccgtgcatttgagagtttcatcaggaggcatgggcggccatcagctctccgtcgggcgtttgacagcatccaggacgaccttagagctgatagggatagtgacttctccattctgatcaatgccttcaaccaagccctcgctttgcaacgctcagtgcttgatgctgatgaggcccgagatgaccaaggtggatctagcaatgatgatggcttgatggaagaatatgtcctgggggctgggctaaccctgctgcttcaatatttgactgagaatgatccaagccagtatggcacccctcctgcaaacaaagaggcggttgacgctctgcccactgtccaaatagcagaggctgtcagctgttcagtctgccttgatgatcttgagctagggtcccaggcaaagcaaatgccttgtgagcataagttccactctccttgtatactgccatggcttgaactccatagctcctgccctgtgtgccggtttgagctgccatctgaagagacagaagatttggatgagcctagcaatgtggacagaacagagaacacccatgaggaagtcagggccgatggccctgaagatgacagtgagagcagtaacagagcgtgggcccttgttccttggttcagtgggctattctcaacacctgaaccacaaactgtcagaggcgctttcactgatcagcagactcgctccacttctggaaccaacatgaatgctggcgaaagctgatctcttcctcctttgtgaataatgcccatacatctgagaatagcaatggaccttgtcagtagataacttatttttctgtactgataatccttcttggatgaatcgcaaggtacaaagtttgtgacaaaaaaaaaaaa

SEQ ID NO: 376 - DNA, 1489 bp, Zea mays
gccgggccgaggccatgatcgatgcagggaggaggatgctgccgctgctctggcctaatcactagtataaagcaggcggagacagccggcccctctggcctcgctgctcccccttcctccccgtccccacccacatgccctgcctccgccccgccccgccctgcccaagctgagttcccccaccccccaacaaacaattactagagtagctgcattggcggggaaattaaagcgctagaagctcagcagcaatggcggagcaggcgggcgccggaaggtactggtgccacatgtgcgccgcggccgttagccccgcggagggcgaggtggagatgaagtgcccgttctgccacagcggcttcctcgaggagatggagaccgcccgcggggccgcgaccgacgacggtgacggcgacggcgacggcgcggtggctcaggtgcaccccggcgccgaccgcccgagctccatctgggcgcacgctatcctcagcacggtcgacagctccgcccgtcgccgccgcaaccggcggcagcaggaggccgccagcgacgtctacgactggaacgaccccgagttctcgctgcgccggcggcgcgtcaccgcgttcctgcggctcctgcacgagctccgggaccgccagctgcagcggctggagtccgctgccggcgtcgccctcgaaggcgaccagctgaccccgttcggccggagcctcttcatcggcgcagctggcggcgagcatggcgtggcgctgggcgactacttcctcggccccagcctcgacgccttggtacagcagctcgccgagaacgatgcggcgcggcacggaacgccgccggccaagaaggaggccgtggaggcaatgccgaccgtggaaatcgccggcggcaacgatggcgacgacgcggccagctgcccggtctgcctggaggactacgcggccggcgagcgcgcccgcgagatgccctgcaggcacaggttccacggcaattgcatcgtgccgtggctcgagatgcacagctcctgccctgtctgccggttccagctgccggccaccgacgacaagagctcatgcagcggcggcgacggtggtttcgtcagtgtcgatgcggatcgtgaaggcagtgacaacggcgggggtgatggtagggcaagctctccgggcaacgccgagctagctgaagctgaagagagtggcaggcggttgccgccatccttgcagtggctcaacagcctgttctcgccgtcggcgcagtcctccggtagcggcggcagcagttcgcatcattgggagaactaagcaatattgccatggttgctgccgcttgaaagcttggcccgttggttggtcccaatgtacataggaaggagcaggagcatgccgggttggtgccatgtaaaaatctggagccttttttcagtttggctcatgttaatggtctctgatatgtatcatggctgtaaaaaagaacagaaatgggcaaatgtatg

SEQ ID NO: 377 - DNA, 1278 bp, Zea mays
caccaatacactacaccataccagaaggagcaaaaataagacgagatggcggacgagcgcttgcctcaaacggccggcgcccgcacggctctcgccagagctactggatcctcggcacggaaacgcgcccgcgatagttaggtgcgcctgtgggcccggccggctcgtcacttacataggcgcacgcacccccgcctggtgcgtcgtcgatcgctgctttgctggcgcgcggcggccctgtgtggcacagtagaggtctgctgaggacgacgaccggaggcgtgctgcgtggatggtcctcatggccgggatgctccccggcgtggagtgcgcgcggcggcggcgggtccggcagggcggggcggggatgggagcggaggcggccggaggaggcacggggcggcggtcctccttctgcctgtacgcggccggccacggcggcgccggcaattctggcaagcggagcggcggcgtggtgcacgggcacgggtggacgctggacagcaatgcccgggaggccaaggagcggctggaccagaagctcaggaccaagagggaggccgccatcaagaggcaccacagcacggggagcataaagctgggcgtgccgcaccggagcgccggcgcggacgagcgcggcgagagctccgcgccggcgatggccggcgtgcagcgcgaggtgtactcgaagaagggcgtgatgcggcggctgatgcggtggagccggccgcggtgggccgcggcggagcaggcggagtgcgcggtgtgcctggacgagttccgcgcgggcgacgtgctggcgcacctgcgctgcggccaccgcttccactgggcctgcgcgctgccctggctcgagggcacctcgcggtgccccttctgccgcgccgccgtggacgccggcgccgccgccgccgccgacggcgcctagaagcggccgaggctctggtcttgctggggcttgccctgggctgggacggcgcggggcgccttgtcgctgtcggcccacgccagccacgccacccccatggcgttgccacgctaggcagtggctagtgggggtggtcatggtgagtggtgaccggcctgcttgtgcatgtggcgcggagcggaggaggacagcgagacgcgcacgacgaacccgtgagtgccttggcagtttttgcacgctttgcgcgcgcaaaggcacggttggtgcacatttgttggttgggccgtttggcccccctttgccgtgtcctcctcccatcatcgcgagcaagtgatgaacggttttgtttt

SEQ ID NO: 378 - DNA, 1204 bp, Zea mays
ctggttcactggccaattcgttgcttcgtggggctttggagtttggagccaatcttgccccttaaagtgtcggtggcagcgttttgtgatcatcatgagctttgtgttccgagggagcaggaccgacatcgaggccggtggcttcccagggttcgctcccgagcgccgcgccatgcgaattcatgcagggagcaggccggtgaatagcaattccttggcttttcttctaactgttcttgttttgttcatggtactgaactcgcaccagatctctcccaatcttctgctttggcttgtcttgggagtcttcctaatggccacgagcctcagaatgtatgccacgtgccagcagcttgctcatgctgcagctgccaacagttttctcggccacactgagctgcgtgtgcatgtaccgccgtccattacccttgctacgagaggccggttacagagccttagacttcaactggctcttcttgatcgtgaatttgacgatttagattatgacactctgagagcattggatgctgacaatagcccacatgctccatctatgagtgaagaagaaataaattctcttcctgtcttcaaatataaagttcaggcacaacagaggcatccccctgcccgaaaaagtgatgggccatctcagctatcggtttcttcaactgggtccggcaatgaggaaaagcaggatggtttaaaagcagatggaaccagcaaaccttcagaggatgaactaacatgtagtgtttgcttagagcaagtcacggtgggtgatctgttgagaagcctaccatgcttgcatcagtttcacgtaaactgcatcgacccatggctgcgccaacagggtacatgcccaatctgcaagcaccaggtgagcgatgggtggcatgctacaggcaacggtgaagaggatgcttcttacatggtgtgagtagctgactaggagtaggccatagctaactaccagtagctgctaactgaatccgtggaacatagttttcgaggtgacgggttggactgatctagggatgtgatctaatccctttctatcctaacaaaaccgcgtgtggaaacagttgtccagtacggttcttttacaggtaacgctcatttcaatcattctctgtaacggggcgtttggatcccttcattttagaggaattggaattcactcaataaagtaacttatttagtttgg

SEQ ID NO: 379 - DNA, 1085 bp, Zea mays
gtccgtgaccattcccgacggccttcccaaaagaaccggaaatttacaacccagtccaccacgggccacaatccccaaatctaacccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggggaccaactggcggcgtcgggcccgggactggcagagcggttcctcagggccttccggccggcgctgtacgaggtgctggcgtcgacggcgacgacgtgcgaggcggacggcggcggcgacgactgcagcgtgtgcctggccgggttccgggcgagggccgtggtgaaccgcctcccctgcggccacctcttccaccgcgcctgcctcgagacctggctccggtacgagcgcgccacgtgcccgctctgccgcgcccacgtgcccctccccgccgacgagacgccgctgctccgctacccggagttcgagtgatccggtcggtaaaaaccaccaccccggtcccccaccccacccaccccccggcgagcggtgagcggtgaccccccgtcgcgcgcgcctcggctgtgtgctgcaagttccgtgtggccttccgtgtacgcgtagcaaaccaaagaagaagaaaaaaaaggtgtaggagcagtagtagtagtgcagggttgctgtcgcttgctttcccctttcgcttcttgtattccccctcccattctctttgcgttttccgttccgtgctgtcgcctgtagcgtgtaaatactccggttcgcacttggcagcagaggcagagtgtagagtgctcccgtggccgccgtggctgtggctgatggtgtagcactttttacgtgctcagctcgtgtagtagtacattgcatccttcttctattcaattctcccccgactggctaaaatatcgaggactgttttggaattggaacggttgtatgtgtgcgtgcagttgcatactgtaataataactccacagcaaaaattacagc

SEQ ID NO: 380 - DNA, 1379 bp, Zea mays
attcggctcgagcttcccttctttcccctttgcttgctgctgcctgcttctcgccgtcgccgcctcaattccctcctcgttgtccgtcgcctcgtccacgcgcacctcgtcctcctctccgttccctccacctcctcgaccgcaccgtcgtcgtctagctagcggagcgagctgcgaccagatcggagagccaagcacccaggaagagggggccggggaacaagaagaagccgccggaagccgggcgtggacgtgtggtggttttctgccggcggctgacaagtggtgtaggctacccgctctggccatggatccgtcgggcggcgcgttcctgccgccgctgcagcaagggagctcctccttcccgcggtcctccagcaacgcgtcgctcgccaggagcggcagcggcggcggcggcgttggcgccgggcgcgggaccaggggcaggaagatgatgcgcagggtctgccgcggcgtcatcaccttcatcttcgccatcgctgggctgttcctgggagcggtgaccggcggtctgatcgggctggcgacggagagcgggctgttccgcggcaccgggatcggcgccatcaccggcgcgctcgtctccatcgaggtcgtcgactcctccatccgcctctggcaggcgcgccgatccgggatctggagcatcctctacgtgctgaacgtgatctacagcctcctgacgggcaggctggtgcgcgagaaggtcgacccggcggtgcagcgggtggtccgcagccagatgaacgcggtggactcgtcgccgttcagggagtcgccggacctgttcgaggtggaggccaccaacggcatgccgcgggcgtccatcgacaagctccccgagtcgtggatcaccgaggagtacaggcgcgacgccgtcggcgacctctccggctgctccgtctgcctccaggatttccaggtcggggagaaggtgcggagcctgccggactgctggcacgtgttccacgtgccgtgcatcgacggctggctcatcaagcacggctcctgcccgctctgcaggaggaagctgtaggcggatcgaccggacgacgccatggacgatgttcttctctgcgatcgagccgatgatgtgtgtgtgtgtgtgcccccgccgccaccaccgatagctgctgctagggtcggaggagggaggaggaagaagagactgacatctatagaacccttaatttatagagagggcttttgctttgctacttgtacgtgctctactacgtacctattgcaacttttttttttgattcaccatgatcgacctccttcctcagatccatccatgcatgtaatataccctggaccggcttgtgcttcgttcgatccaaaaaaaaaaaaaaagg

SEQ ID NO: 381 - DNA, 793 bp, Zea mays
ccacgcgtccggatctccatctctcatccgctagctagctagctaggcaagacagtcgagagtcgacaccatggccatggcgacgcaggggcaggccgaccagcagcagcagcacgggcggtctgagcccaccaccagcgtcgccgccaaccgctgggggccctactccggcgccggcgacttcgccagcaacatggccgtcatcctggccgccctgctggccgcgctcgcgctcggcctggcgctcaacgccgccgtgcgctacctgctccgccgcagccgccgcgccggctctgttggtggacagggcaacggcagcggcgtgctgatgccgtcggacgacccggctgagaagccctctgtggaggtggagctgcaggcgccgccgcccgccctgctggtgtactccgccgccgggacgacgctggcgggcgccgcggcggagtgcgccatctgcctcgccgagttcgcagacggggacgccgtgcgcgtcatgccggcctgcggccacggcttccacgcgcgctgcatcgagcgctggctcgcggagggccgccgctcctcctgcccgacctgccgcgcgccggccgtgcagcgcagcctgcacgcaagtgaattactctaaataaataattgccgttttagtgttgctatttaccattgcttgtactgcctctgtaaatcaagaagaagaaataaaattataactcttaggtttgggctcaaaaaaaaaaaaaaaaaaaaaaaaaaaaaaaaaaaaaaaaaaaaaaaaaaaaaaaaaaaaaaaaaaaag

SEQ ID NO: 382 - DNA, 2191 bp, Zea mays
ccatctctctctctctctcctgcgccgactcatcttcaccctcgtatcacctccctgctgctgctgacgctgctgccggcaagatcaaatcgttcaaaagaccctggatttcggcgaattctagatggatcatgtgttttaggtgattggtgctttcgacctcattagtgccttttgttcaattgctggacccaaggagcagagttctgtcgacatggcatctccaagaggaaggatgtcatttccccttcgttcctttctgatgatctgcctcatggctcagctgggagcttccaatgttgtactcatggcgaacaacactaccctgtcgttcgacgacgtcgaggcaatttttactccagcagtgaaaggttcaggtgtaaatggtgtcctttatgctgtggaacctatggatgcatgcagtccattgagaacaaaagcgataggaggctctgtctcaacatttgcgttggttataagaggcggttgccatttcgatgacaaagttagaaatgctcagaatgctggattcaaggctgctgtagtatatgatactgaagacaacggtatccttgtttcaatggctggaagctcgtctggagtccacatatatgcagtgtttgtctctaaagcgtcaggggaggagctgaagaaatattcaggccaaactgacgcagagttgtggataataccaacatacgcgaactcggcttggtcaatcatggcaatttcatttatatcactgcttgttatgtctgctatcctagccgcgtgtttctttgcgaggagacaccagataagacgggacagggctcgacttccccaaactcgggagttccatggaatgaacagccggttagttaaagcaatgccaagtcttattttcacgaaagtgcaagaagacgactgcacatcagcaacatgcgccatttgcttggaagactacagtgctggagaaaagataagggttctaccttgtcgacacaagttccacgcagcctgtgtggacctatggctcacctcctggagaacattctgccctgtatgcaagcgggacgcgaatgctggaacaccagagccccctgtatcagagtcgacgcctttgctctcatcatccgccattcgcttaccagaaccaaccgcttcggtttccttctggtctacagtggcagcagcagcagcagcgtctccccccaggccaatcagccggcatccgtcgccatcacggtccatatcccgcaagcactccgtttcaggttccagcatccctggcacccctatccccaggtttcacgcaagctcatcatctcctacctgcacaagtggaagcagtttggacctcgcaaacatgccgtcgtctccatggcctcgcgcttcgcaccttgcatctgctcactcttcgtgcggtggccgcctgtccccgccgatccacatcaggaatacctctgcagcgcacgtctcgcgctctgcctatggatctcccagccgttacgtaggctcgtcgcacatgtcccgtggatctccgagttgctactaccttggatcttcttcagggcagcagcatccttacctgaggcactgcaccttgtcaggcacgagcctgttcaccatggtgccccaatcaccgcaacagaaccagctgcagcacggtggagactcggaaaaagatctgtcagctgctgcaccattccgtcagctctactacctgcagcattgtccagattctggcacgtcgtctcagtcgcttccagggtgctgattcttcattcttgctgcaaaattcaccattttaaaaaacattgatggtggctccagtaaagcttccggccgtgaggaatcttacatggcaccgaattgacatgtggatttgagctcctcagttcaccatgatgatgagagaaaaaaggtgcgacagaattgcttgtaagaagagagaattgcaccccccagaatgtgtggcttcatcttgaagaagcaaatgcccatgtcgggcttcaccagcgtttagcgtgtactgatacagctctgtagtaattctagttgctgtttgtctatcgaggtttgagccggtagcattccttcctctcttttttgttttcctaattttgaattagttatatgacagacaaggttttcaagaaaagaaataacaagttttacccctgcatttttataaaaaaaaaaaaaaaaa

SEQ ID NO: 383 - DNA, 800 bp, Zea mays
gcaggttcctaacccccacccacctcgcccaaattgcaaccttccccgagtgctccaggtcccgtggccggcccccagatcctctccaatcccaatccaagtatcgaacggatcccatcggtggcgctcgagcgagcgagtgcggccggaaccgagcgaagatgggcatctcgagcatgccggcgcccgaggacagcctgctggggttcgtgctgtacaacacggcggcgtcggtggcgatcctggcggggctggtgcgcgccgcgctgctgttcctgggcctggcggcggcggcggaggacgaggagccgcggcagcaggcggaggccgtgacggtcacggccgtggggcccagcctcgcggaccggttccggagcaggttccggccgtcgcgctacgggcggcgccggggcggggactgccgcgtgtgcctggtgcggttcgagacggagtcggtggtgcagcggctcccctgcggccacctcttccaccgcgcatgcctcgagacctggatcgactacgaccacgccacctgcccgctgtgccgccaccgcctcctgccccccgccgctgccgccgacgaggtgccccggattgcctgattagcgccctaggaattgagagtaggcgtagcactctgcacctcgcagcagcagtgtctctgtacaggtttttttttttcttttcctttttgttcgggggagagagaggacagaacggagattgaaggaagaaaatggtggcaacaaagctgttcccctttcgtttctccgaagctctctgttgtctttattcattcc

SEQ ID NO: 384 - DNA, 2746 bp, Zea mays
gacaaaatttcctccacccattctcttcctcctcttcttccccaccgactccaccgatccacatctttctatctgaatttcctctcgtcttgcccaccggtccatctgtctgttgcctctctctctctctccctctctcgcaaccaatcggttcttgtttcctccgtctgctgggttgattctctctctcttcctctccgtggagaggagaggatcgagaaacaggagacaggaaagaagagaaatcagaacggagcctgttcttttgcctggattgcggttctcgcgagttgttcagaaactctgggccagtttctggtcctttaaaatactggaacgaggaaccatcagagatgctaaggcaacagaccaattgatgttatctcgctaccctagtttggatcatcacaatgcaaggacagaggaattctgtggagcattttgctgatgtttttggattcgacattgcatctagttcaggcaaccctgtgatggatcagcagtcatattggaacaatgttcttggatcagtagaatcgcagaatcttcaaggttatcagatgaatcacagtgatgctgccatgccatatgggaatgagacacagcaagatggtacatttcttggtttctgggaatcaggcgaagcaagtgcaagtggcagctctaacaatgccaaaacagagcatcttagtattggcggtggtctgaggattggtgaaaggcgactggtagctgacaatggcatttctctggatgtggatatcaaccttaacgccaacgttaacgatctatgtggtcaaagttcaaatgttaactgtacatctcagggccctgagcactatggtggcggtgatcgtagtgttgtaaattctcagccaactgacctgagattacacccatacaggactttcctactagatgcagagcaagcagattcttttactttgaaccctagtgaaaaccctttgtgtgatttttcactgatgcaagaaagcattgaccaaagacccggtagttccctggatggacgccggctagcctgcaagagaaaaaatgttgaaggacccaatggccagagttcagcaggtgctagcactagtttttcccacaggaacgacaatgctttccataacattgcttcttcaagttacaatcctgcacctatcagaaatccgtcctcacccaattgcttgccggttccaagttctatcgatgatcaactcccacgatatggaactaatgcagggctctcagccggtacctatgaccttaatggaggggtcaacaatgctgggaattcgcagagaagtttccgggcaagaattactacgtctcaacagattgctccctgtagtgtatggccctcttcaaatgctatcagacttcctaattcatggaatcatcagccacctcattttcaaagtgcatttgatgatacccaggaggttattcctgtggtcagcagcctcaacttgcaataccagcatccagtgaatgtttctagtgtgccaccggctgcaaaccgtttcactggccatggagcttcatcatcgagagctggcagtttggagaacagaattcttggtagtcaagaggctcctacaaggaatgtggtgcctgccaactactctgatttagttcccccgtctgtagtagacccgagacgtttgctgccagaaccatctaattggagttctgatgtccgaggcactgcaatatcaggaagtattcctcctgtatcaagagctaataacagtgcaactgttaatccgccagcaggattcagtcaccaaaacctcacccggcgccatcctcgaaatttatcagaggagattggtcggctatctggagcacttcgcggccatcaacccccacgcttaaggccggggtttctgttggagcgccagggcgatggtgtttggggtgttcctttatcaacaaggggtagagaaggaagaaggttaatggagattcggaatgcacttgaaatgatccatagaggggagaatgtaaggcttgagtctatcttctatggcggtgttgacattcacgatagacacagggacatgcgccttgacattgacaatatgtcctatgaggagctattagcactcgaggaaagaataggaaatgtcggcactggcctcagcgaggaagctgtgataaggttgctcaaacaaaggaaattttcatcttggacactaaaagcatctttggaccctgaaccatgttgtatctgccaggaggagtacgctgatggagacgacctcgggaggctggactgcgggcacgacttccatgctggctgcatcaagcaatggctggtggtgaagaacgtgtgccccatctgcaagagcaccgcattgaagaagacctgaaacccgaacgaaggctcgtgtcagagacacccccccccccccccccccatgtttctatgttcactcgacggttcgcgagatcatttgccgattcgtattgctacgctttttttggtcgggaaaattttgccagccacctgcgattgggaaaggaaaagagagaaacagagagagagaggatgcggttgcggtcctctgtaaactgctgctgcagtaaataatccctggaatatgtcttccctgcattcaaccaaatatttagtagtagctgttatagtggacgtcgtaggattaaaaccttggaagagagcctgttggctgttgcccaccacttgccataattatgttcgatccggatttcaattttc

SEQ ID NO: 385 - DNA, 2035 bp, Zea mays
cgcttcccccttccacccgccgatcgccctccgctcgctccaccgcggcgggcgatcgctcatctccccctaacctcccccgctcgcgattcccgaggcgaggtgccacccaccgcagatttcttccgacggacggttggctcgctcaccccctacttcgctgatcggatcgcgtgctgcccgaggtagaggtgatgataaggcatagttgtttgacttagcctgccttagctatttcttgaagctaagggaaataataattggtgttatggcatttagaaatatggtttgtactccccaagtcattaatcttacatcagactcagagagagggcaagctcaaggaggcaatggtagtgagatatctgagcaaggtgcacaacatgctgtcagagttgtaggaaatgcaatgaacattggtctctctggtgtgcgaagttactatgatatgagcataaatcatcaccatcagtctgttcataacccacccccgaatttaggtgttgattctggttttgtcttcgcatcaaatatgtacaatccctgcatgtcatcaacatcaatgaacagacatgtttctcatgctcagagctttggatcagggaatcaagtgttgcctcaaaaccaagtcccaggaactatggatgagagtagcagaaatgacagtattggtgaaagtgctagagagcatattaaaaggaaaaatgctgcagttgctggaagctatcattttgttaatggatttgcaagctcaagctcatcttctcatgcacctcaaaatcctatgcttgggccttgggacccttcttttgaatcaactgtttcttctaatgttgcaccattcaacccatcagaatatcatggacacaacaacagttggccgtccttagaaggatcttccataacaggaagtaatggattcaactcaatggttgttcatccagactcagtacagcgtgggaactatacatttccacccactcatattagccattcatggatgtcccatgctacaaatggtattgctgatggagttccccagtgggaatatgccaatgcaactgctaatattcaaggcagatttgcccattcaggagccacagaaatcgcaaatgttggttttcatgaatatcagaatggcccttcaactatttgtcggggaccagtaccttatttccaccagcatgcgatgcatggcatgcaagctcttgatcctactcaaatgcaagttccttatcaacaatgccacagtaatggtttcttgcatggtggtattaattaccctggaaaccgtctccaattaggtccacgaaatccagttctcttcaccagttctgaacgtgcttttgggcctccacagcatccgttcctggcaaatccagttaaccaccgcaacataaggattctaccacccgagcatgctacaataatggatttttcgagattgtatgaagtgtcaaatactgtagatgagcatagagatatgcgtctagatatagacagcatgacgtatgaggagcttttagcattagaagagcagattggagatgtcaatactggtctgacaaaaagtcacattgtagataaattgaggactagcctatatgttccaggaatatcgagcatgtctgatcagccatctaaatcttctctagagaatgatgcttgcataatatgccaggaggagtaccaggctagagactgcgttggcacccttgactgcggtcacaggtaccacgcggagtgcgtgaagcagtggctgatggtgaagaacttgtgccccatctgcaagacgacagcattgtctgccaacagaagacaaggacagtgagcgggaatggagaagcctgttggttatttgctttgacaaacgttcagctcaattttgtatataaagaagtggtagacaatggcgctacctgtatttgttgttcactttgttgtgactgggagtactcagcttcctgaaactgtacagccataacatttgttatttttcttcaaatgtagaatgttttaaatcgctcagttcgcc

SEQ ID NO: 386 - DNA, 1253 bp, Zea mays
ggctaccgccgccgccagatgcgcaggtcttcgtcggctccttctacttctcaggcaacgagcacccggcagtaccgatcgggtgttcttcactgggtccgctcctgcgtgctagaactagaagaatcctctgctcggctcgaacttggaaggggggaggcgagggatggggtccctgctttgctgcatggggtgctcggaggacgtctcggcagcgccgcccgtgagctgcttgtgcctactatggcctttccattattaccacaatttgaactcgggctctgctgcttgtcacagatgtgatacacgggtggcacctgatggtggaaggagtcctcctgcaaatcaagtggattcattggatactttgggtctccctccaaggcctttgccttacgatgatcctcaatccagccctcgcatggtgcaacacccacttgtatcaggacacgacaaagcaccaacgcatgtccagaaactaggacagcctgcagaaactaagaatacccatactgggtcaacttgcacagctcataaggtttctgcgtcctcaccaaaacagcactcagaaggttcaagaatggatgatggagtacaattctgtgattcctctgacagtgaggatgactgtccagtatgcctggaagaatatgattatgagaatccgaagattgcactgcaatgcaaacataatttccaccttagctgcatttacgagtggatggaaaggagccaggcttgcccggtctgtgcaaagactatgttgttcaatgaggatgaatgaccccgccgatggaagtcttcccagacgctggattcatgggctactcgtcagaaaaagaaggagcaaaaaatggtggttctaggaagcaagctaatccgaaagacggcaagtgaggcattcggccgggcctttgggtggtgccctttagataggcgcatttctggttgatatggaagctggaacttggaagatggtgatgaagtttgtttgtctcttgatggttggcttgttcagttccttttgtggcttctgcctgtctgattgggttgtaaataagaaagtcttatgtagttaatcgtaggccaaactttctctgctatcttaggctcttcactaatctagtttgatagtgtttagagtctagatagggttctggccgtgttcgatcttttgggatgatgtgccgcgtggttgtggatgtttcaaactttcctatttcttaatgaaatagggggcttcgccccttcgt

SEQ ID NO: 387 - DNA, 1341 bp, Zea mays
ccgcagaatccgagtccaatagctctcctccccagggctttcaacttctccaaaccccatctcgccgccgaggccgagcgagcagagcagaacaccacgtcggcggcttttccctgtctctccgctggatactacacccgccgccgcagcgccgatcctgtccgagtcaagcggagcgggggatcggattggttgcttccttccctccatctcatgttggtggactgagagatggagttttaatttcaaatagcatctagaggactgccactaagcttttaagttggtatataatgggtggctgttgttgctgttcgtcgagaacatctgaagcagttagagcacgagcaccagttgatatatatcatcaacaaaatcttgaggagcaggagccattgtcttcaatttttgatggatcatctccagcctctgcaattgttgcagtagacacaaatctggatacttccacacctgacacatatcgagcgccgcctgcacccttgccttatgatgttattttggcagtcccaaataaccctggtttggagaagccagacactaagagcaaaactgatgaccaacaagagtccataaatgatcaggagtctttaaaggtggatgagtcatgtaagaaaagtgtcactgaagataaggctgatgaggaggatgtttgccctatctgccttgaagaatatgatgaagaaaatccccgttctataactaaatgcgagcatcatttccatctttgctgcattctcgaatggatggagcgaaaagatacttgcccagtttgtgaccaggtttggtaaccttggtggatcatcactcgaagctgttcgttactgagaaagtgcagcaactaatttacttttgatattgatccattccgggtggctcgcatggtaatgaattgagggggcaaaaattgaaaggatgaatgtcatgaaatgtatttacaacgcctcctttgtcatgcgttgtgtcatgctatatatatgccggcttgcgggttcattcagttcaaagtccaggactatccttttgcttttctgaattcagagtttcagacatctgctggttcttccaggttccggtcagctgtgtatatcatatattaggtggttgcaggtaaaaatggtctagagggtgggggttgctttgtacaatccacatggtatttaagcttcatgtatataatcttttctgtttctcttcgttttgttctgctgaatacttgcagatccttactgttctgataaaacttactgactcccaaatctgtgccagacaaaacgtgtttcaggaacataatacatctgatagcacttgttaaaaaaaaaa

SEQ ID NO: 388 - DNA, 1678 bp, Zea mays
ctcctctgcctttccccatcgtctctccgtctacacctcatcataatcacagagcgctagggaggagagagggggaagagagagggctagggtttcgtgctccctcacgcaacgaatccgagccggatcggggggtgcgcggagtcaccggcggcccggcgttgcctgggctgtgatacagttgcaatggcatctgtaactgatgagacagctaagattgagggtttgacatctgctgcagcctttgtggagggtggcattcaggacgcatgtgatgatgcatgcagcatttgccttgaggctttctgtgagagtgacccttctgcattgactggctgcaaacatgagttccatctccaatgcattcttgaatggtgccagagaagttcacagtgcccaatgtgttggcagcctattactatgaaggatcctaccagtcaggagctgcttgaggcagtagagcgtgagaggaatataagaactaatcaaactcggaacacaactatatttcatcatcctgctcttggggattttgagctgcagcatctgcctgttggtaatgatgctgagcttgaagagcgtatactgcagcatctagctgctgctgctgcaatgggaagggcacaccatcttggaagaagggaggggcacaggggacgatctggctctcatggtcgtccacatttcctagttttctctacacaaccaaattcaccttctgctggcacaatctcttcatcttctgctcatatggagggagaaaatgattcaaatcctgccacacctagagctagcgagtcatctccacgagctattcgcattggagaagtgggaaaccaaagtcctgggatgcttacctacgatgctgaacaggatgctgtcgtttcttccggaaatagcactcctgtatcgagtcctaggttttttaacaggagacactccactggacagtcaactccagacagggctgggccatcggatattcagtctttctcagactccctgaagtcccgcttaaatgccgtctctatgaagtacaaagaatctattacaaagagtactcgagggtggaaggagagattgttttcacgtaattcatccgtggcggatcttggttctgaagtgagaagagaagttaatgctggaattgcgtccgtatcacggatgatggagcgtctggaaactagaggaaatagcagaacaagtgatagcccggcagcatccacttctgaagttccccctgctacagaatcaagcaatgaaagggttacagagagcaactctgctgctgctgctggtggtggtggtactaccactacgggtaccagcgctagcaacgcctccgccccttgtgttgcgacatccggttcaaattaggacatgtttgtgagcctggcggcagagcagaagtgcagtaacatgatgccgtcatttttttctcaaccactgcataaacggctgcaaggggaaaaaaccaaacggtgatttgatgtattggctcgataaaatggtggtgcgtgtggcctaggagaagtcggatttcatcttctgttttcgtctctttgtaaaaaaaatcgtctgagggcagatgtttaccggtataaataacggatatgtcatcttcatagtacgtggatcagttataaatatgattggaacagcaaagcttgctgctgtt

SEQ ID NO: 389 - DNA, 746 bp, Zea mays
tttcctcgttcccaatcatcttgccgcgcgccgcacgtagctagggtttcgtcctgtcgttgcacccgcattactagcattcaatccacgccaatggctgagaagaagatggttacgctcaggagctccgaccacgaggagttcgaggttgaggaggcggtggcgatgaagtcagagatcatccgtctcttgatcgaggacgactgcgccgacaacgccatcccgcttcccaacgtggattccaagactctcgccctggtcatcgagtactgcaacaagcacgtccacgccgccgccgccgacgactccgccgccgcggagaccagcaacgcctcatcagctgcgggcggcggcgacgtcgacctcaagaagtgggacgcggagttcgtcaaggtcgagcaggcgacgctcttcgacctcatcctggctgccaactatctcgacatcaaggggttgctggacctgacctgccagacggtggccgacatgatgaagggcaagtcaccggaggagatccgcaggacattcaacatcaagaacgacttcaccgaagaggaggaggaggagatccgcagggagaactcctgggccttcgactgatgtagtctccccgtccgcggacctagctcggtggttattactgttagattcgatctctagtgctagtttgttcgtctgcacttatcttctgatctgaaacattaataagtagttcgtttgtctacagttaccagttgataaaaaaa

SEQ ID NO: 390 - DNA, 1583 bp, Zea mays
gccgttgaagccaaaatttattacgataaaattttgatcctttcatttgttggacattggatcaactggtgctgttatacatagaaaggagttcattgtaatttctcatctatatttagtggtgccataatcatttttccactggtgttcggcaataatgtcggagagcgagttagcagtaataaaaccagaggcgttaaagacttatatctggcttcagtgctttgatggttccattcagcaagtggaggaggaggttgcaatgttctgccccatgatatgtcgtgaaattgtgaaaaatggcacagggtcgtccaaaaatcatgctattgcgctccctgaaagagttaatccagccagtttgagtttgattcttgactactgccggtttcatcaggttactgggcgctcaaacaaggagcggaagtcctttgatgaaaaatttgttaggatagaaacagaaagactctgcgaattgacttctgcagctgacagtctacagctaaagccacttgttgatcttactagtcgagctcttgctcgaattattgaaggaaagacacctgaggaaatccgtgacattttccacttaccagatgacttaacagaggaagagaagttggagcccctaaaaaatgtaaatgatgatcctaggattcgcctattgaaccggttgtacgcgaagaagcggaaagagctccaggagcgccagaagctgaaggatgtacaagtacaaaaggaggaaaaagatgagagatctttggatgagttactttgttttattaatggggatggaggttcaggaggtggggaaagtagtaccaagagtaagaaaaagaataaaagaaggaaggatcatgctaagaaccccgcaaaagctgactctgagtctgtaaatgtggagggagctgcttgtgtggttccgtgcaaagtggatagcagtaatgtttctagacttccatgccaaagtccagatatgcaagatgatgtcgagtacccctttgaagatgctgacctcgatgatggacttgatcctgcaatgaaagaagagcttgatagagaagttgaggactttgcaaggaggttgaattcagtttggagcgagtcacatattggtggtaatggttctgtgcagagatttcctgggtttaatcacaggtgagtgttaagctggcaagatctgaaggcagaagcagaggagatttgtgggcatacagcttggaagggattaaaggccaaacaggccaccttggctcctgtgtgttgtaaaaccttgataactcaggaaccaagcatgcagaaatgcgcaagttcccttggccattttcctgggaaggaggccacctagttgggatgaccctttttttttttctttgggaagggagggttagaggtctgtcttgactcaattttttgttttccttaactgctgtgttgccagttttcctgaataggggaagagaggagtgttgcctgttagctctgttacagatgtccatggaattctgttgtaacactgtattgtggtgcacatagaaatgtgattccctgtattgtggtgcgcaaaaaaaaaaaaaaaaaaa

SEQ ID NO: 391 - DNA, 889 bp, Zea mays
caatctttcgccctcttcgcgcagcagctacagagctagggttccgtcctcgatccgatccggcgagtgctcaccacctttccccacttccctccgatcgaatcgatggcggccgagggcgaaaagaaaatgataaccctcaaaagctcagatggtgaggagttcgaggtggaggaggcggtggcgatggagtcgcagaccatccgccacatgatcgaagatgactgcgccgacaacggcatcccgctccctaacgtcaactccaagatcctatccaaggtaatcgagtactgcaacaagcacgtacatgccgccgctgccgctgccgcagcctccaaggccggttccgacgacgtgggtgccgccgccgccaacagcaccgccgcctccggtgaggacctcaagaattgggatgctgacttcgtcaaggtcgaccaggccacgctcttcgacctcatcttggctgcaaactatctcaacatcaagggtctgctggacctgacctgccagactgttgctgacatgatcaagggcaaaaccccagaggagatccgcaagaccttcaacatcaagaatgacttcacccctgaggaggaagaggagatccgcagggagaaccagtgggcctttgagtaaggaggtgctgagccctctgatctcttatgcctaggtttcgtcatatctactaccttgcaatgctctgcttttaaatgtcatcgtaatggttgtaagtattttgggagtcactttgcttgagaatgtgttgggtaaaactgatgtggtcaatggtcggttattactatgaaaggacatcggctgctgccctaagaggtcaaaaaaaaaaaaaaaaaaaaaaaaaaaaaaaaaaaaaaaaaaaaaaaaaaaaaaa

SEQ ID NO: 392 - DNA, 2127 bp, Zea mays
ttttctcctctctgcttgctccagttccaagcaccaccgaatcagggcgagtgggagcagagggaaccccatgtctccgcccctcgctggagtagattctcggcgagccggcgtggagctgccgcggtagaaagccagctgagcctgcgagcgcctgatccgcccggagcccgatcgggatcgatgggtggggaggcgccggagccgcggcggctgacccgcgctctgagcatcggtggcggtggcggcggctgggttcccgatgagatgctgcaactggtgttggggtttgttgaggacccgcgcgaccgggaggccgcgtcgctggtgtgtcgccggtggcaccgcgtcgacgcgctctcgcggaagcacgtgacggtgcccttctgctacgccgtgtccccggcacgcctgctcgcgcggttcccgcggctcgagtcgctcgcggtgaaggggaagccccgcgcggccatgtacgggctcatacccgacgactggggcgcctacgcccgcccgtgggtcaccgagctcgccgcgccattcgagtgcctcaaggcgctccacctgcgacgcatggtcgtcacagacgacgacctcgccgagctcatccgtgccagggggcacatgctgcaggagctgaagctcgacaagtgcaccggcttctccacggatggactccgcctcgtcgcccgctcatgcagctcactgagaactttgtttttggaagaatgtcaaattaatgataaaggcagtgaatggatccgcgatcttgcagtcaactgtcctgttctggcgacattaaatttccacatgactgagcttgaagtgatgccagttgacctagagcttcttgcaaagagctgcaagtcactgatttccttgaagattggcgactgtgatctttcagatttgatagggttcttccaatctgccacatcactggaagaatttgctggagggacatttaatgggcaaggggaactcaccaagtatggggatgttaaatttccatcaagaatttgctccttgggacttactttcatgggagcaagtgaaatgcctattatatttccttttgctgctatactaaagaagctggatttgcagtacactttcctcaccaccgaagaccattgccagctcattgcaaaatgcccgaacttactagttctcgcggtgaggaatgtgattggggatagaggattaggtgttgttgcagatacgtgcaagaagctccaaaggctcagaattgagcgaggagacgatgaaggaggtgtgcaagaagagcagggaggggtctctcaagtgggcttgacagctatagcggtaggctgtcgtgaactggaatacatagctgcctatgtgtctgatataaccaatggggccttggaatctatcgggacattctgcaaaaaactctatgacttccggcttgttctgctcgatagagaagagaggataactgatttgccactggacaatggtgtccgagctttgttgaggggctgcaccatgcttcggaggtttgctctgtacttgagaccaggagggctctcagatgcaggtctcggctacattggacagtgcagtggaaacattcaatacatgcttctcggtaacgttggggaaaccgatgatggattgatcagtttcgcactgggatgtgtaaacctgcgaaagcttgagctcaggagctgttgcttcagcgagcgagctctggccctcgcaatactaagtatgccttccctgaggtacgtatgggttcagggctacaaagcgtctcaaacaggccgagacctgatgctcatggcgaggcccttctggaacatagagtttacacctcccagttcccagaatgctggtcggttgatagaagatggggaaccttgcgtagatagtcatgctcagatactggcatacggctctcttgctggtaagaggttggactgcccacaatccgtggtcactttgtatcctgcgtgagtgtaaatagactgagggcccgtttggtgcccatggaaccgttgtctggaacaatttctggtaggattgcttgctgatttgtataggctttgatcagctggaaacaaatgaacaaggcctaagctcgtgtctttctctcaaaaa

SEQ ID NO: 393 - DNA, 2336 bp, Zea mays; identical to SEQ ID NO: 119

SEQ ID NO: 394 - DNA, 2106 bp, Zea mays
aacaacctcggcttctacgactacccgtaggagtcgaagtcgactggcgtagcgtaggaggcggcggttccaggcgaccatccaataatcgccaccctcacgcgagaaatccccggcaacttttggggaactacacgtgtatggagttttattagtattccaggggcatcacaatggcatactttcctgatgaagtagtagggtatatccttggttatgtaacgtcgcatcaggaccgcaacgcggtgtccttggtctgccgggcatggtacgacattgagcgtcatggccgccattcggtgcttgtaagaaactgttatgcggtgtgcccagagcgtgtacatatgcggtttcccaacatgcgcgcactgagcttgaagggcaaaccgcactttgctgaattcaaccttgtcccggcgggttggggtgccactgcaaatccatgggtggatgcgtgcgcccgtgcatgcccaggtcttgaggagctccggctgaagtttatggttgtgactgatgaatgcctcaagttgctttctctatcctttaccaactttaaatcacttgtccttgtttgttgtgaggggttcagtactaccgggcttgctaatattgccaccaattgcaggtttcttaaggaactagacttacaaaagagttgtgtgaaacatcaagaccatcagtggattaattgttttcccaagtcttcaacatcactagaatgcttgaatttttcctgcttgactggggaggtgaatgctgttgcactggaggaacttgttgcaaggagtccaaatcttaaaagtttaaggctgaatcttgcagttccatttgatgttttgtccagaatcctttctcgcacacctaagctagaggatttaggcacaggatcctttttacaaggcaatgaccctgctgcatatgccagtttatgtagagctcttgagaactgcacttcactgaagagtatatctggtttttgggatgctccaggcttttatgttcaaggaattttgtcaaattgcaagatcagaaatcttacatgcttgaatctcagctatgctacattgattcagagtacccagcttatcggtattattcgtcattgtaagaagctccatgtcttatgggtgttagatcacattggtgatgagggcttgaaggctgtgtccttttcttgtcctgatcttcaggagttgagggtatatccaagtgttgttgcaccaagaggtactgtgacggaggaagggttggtagccctatcttcgtgtcggaagttacagcgtgtgctcttctcttgtgttcgaatgacaaacacggcgctgatgacaatagcaaggtactgcccacggctaacgtccttcagactatgcattcgcaagcccaggtcagcagacgccgtcacaggacagccactggacgaaggctttggggcgatagtgcggtcctgcagaggcctgaggcgtcttgccatgtccggcctcctcacggacagcgtgttcctgtacatcggcatgtacgcggagaagctggagatgctctcggtaacgttcgcgggggacaccgacgacggcatggtctatgtgctcaatggctgcaggaacctcaagaagctggtaatcaaggagagccccttcggtgacgccgctctcctcgcgggcgcgcacaggtacgagtcaatgcgcagtctctggatgtcgtcctgccagatcaccctgggtggctgcaaggcccttgcggccaccatgccaaacatcaatgtcgaggtcatcggtggggcgagctttggtgcgatggatggtggtgtcagcggtgcgaggaaggtggacatgctctacctctaccgtactctggctggacctagatgcgatacgccaggattcgtctcgatattgtgagctgtatctatggctactgttggtggcgttcagggaaacccgatgttcttaaccgtgcctgctgtgggctgtggctgtgctactctgtctggtagtgtttcggaaacacgatgtttatttgcgtaaggtagtgtttggttctggaaccattttaaaaaaaaaaaaaaaaaaaaaaaaaaaaaaaaaaaaaaaaaaaaaaaaaaaaaaaaaa

SEQ ID NO: 395 - DNA, 2146 bp, Zea mays
aatcacagcggcaggggacagcaaaaatctccatgcccacgctcggcctagatctccggcgagccggccccgcgcggtagccgattcactctccgaccccgacccgatgggcggcgaggtgccggagccgcgccggctgagccgctcgctcagcttcggctgcggcggcgtccccgaggaggcgctgcacctcgtgctcggctacgtggacgacccgcgcgaccgggaggcggcctcgctcgtgtgccgccgctggcaccgcatcgacgcgctctcgcgcaagcacgtcaccgtcggcttctgctacgccgtggagcccgcgcggctgctcgccaggttccggcggctcgagtcgctcgcgctcaaggggaggccccgcgccgccatgtacgggctcatccccgaagacttcggcgcctacgcggcgccctgggtcgccgagctcgccgcgccgctcgactgcctcaaggcgctccacctgcgccgcatgaccgtcaccgacgaggacatcgccgtgctcgtccgcgcgcgcggccacatgctacaggtgctcaagctcgacaagtgctccggcttctcaacggacgccctccgcctcgtcgcccgctcctgcagatctctgagaactttgttcctggaagaatgtataattgccgatgaagggagcgaatggctccatgaactcgccgtcaacaattctgttctggtgacactgaacttctacatgacagaactcaaagtggagcctgccgatctggagcttcttgcaaggaactgtaaatcattgatttctctgaagatgagtgactgcgatctttcggatttgattggttttctccaaacctccaaggcactgcaagaattcgctggaggcgcttttttcgaagtcggagagtacaccaagtacgaaaaggtcaagctcccacctaggctatgcttcttggggggtcttaccttcatgggtaaaaacgagatgcccgttatctttccgtattctgcgtcgcttaagaaactggacctgcagtacactttcctcaccactgaagatcactgtcagcttatcgctaaatgccccaacctactggttctcgaggtgaggaatgtgattggggatagaggactggaagttgttgccgatacatgcaagaagctacgaaggctgagaatcgagaggggggacgatgaccccggccaagaagagcagggaggagtctctcagataggcctgacagccgtagctgtcggctgccgggaactggagtacatagcggcatacgtatccgacatcacaaacggggcgctggagtccatcggcaccttctgcaagaacatgtacgacttccggctcgtcctactcgacaagcagaacaaaataacggatctgccgctggacaacggtgtccgagctctactgaggagctgtaccaagcttcggcggttcgccttgtacctgagaccgggagggctctcggatgcaggcctcggctacgtcggacagtacagcgggaacatccagtacatgctgctcggcaacgtcggcgaatcggacaacgggctgatccggttcgcgatggggtgcgccaacctgcggaagctggagctgaggggctgctgcttcagcgagcgggccctggcggtggccgtgctccagatgccctcgctgaggtacgtatgggtgcaggggtacagggcctctcagacgggccgggacctcatgctcatggccaggccgtactggaacatcgagttcgtgcctccccgtcccgagagcgcgtgtcgggtgatggcggatggacagccttgtgtcgacacccatgctcaggttctcgcgtactattccctcgctggaaggaggccggactgtccgcggtggctggttactttgcatcccgcgtgactgtagatacggcaaggtgtccgagtgtggttactgttactaccagctgcttgtgtaccgtaatgaactgtagtgccgacgtactgtagcggaggtgtagtgtagtgcaataataagttgcggtgttgcttgtactggtatctagtcctaggaggatgtatactaagttatgctgtgctttcttctccccggaattgtattctgttgcttccactgtaaatatcagaaatggctttttgctaaaaaaaa

SEQ ID NO: 396 - DNA, 966 bp, Zea mays
cctccaccaccattcatcagaaagcgaagcaccagcctctgatgccaagccaaagcacacacacctcctccagcctttcttcctctacaaccccaattcttccctgcagctctgctgctgccttgtttcgatcggtcatggcggcggtggccacagagactccgttccatgtcctggcggtggacgacagcctcccggacaggaagctcatcgagaggctcctcaagacctcttccttccaagtgaccactgtcgactccgggagcaaggcgctgcagttcctgggcctccatgaccaggacagcacggttcctcctgtccacacgcaccagctggatgtggctgccaatcaggatgtggctgtgaacctgatcatcacagactactgcatgcctggcatgacaggatatgacctgctcaagaagatcaaggagtcgtcgtctctcagagatatcccggtggtgatcatgtcctctgagaacattccttcaaggatcaataggtgcctggaggaaggagctgacgagttcttcctaaaacctgtgcggctatcagacatgaacaagctcaagccccacatactgaaaagcagatgcaaccaggaacagcaccagcaaagtgacagtcacagtggcgaacgcaggaaccccacaatcagcagcagcgatagcataaacaaccgcaagagaaagggtgcaggcaccgaagaaatcttgccccagctggcaaacagatcaaggcacagttaactgagaactgactagtacagctaaaaccttttctttttcactttactttggcttactgatttgtaacgtagatgttagccctggatttgcaaaacggaacggaatctgtaaactgatactgcttgagtcgaatcgatcgaagtgattctgcaccaaaaaaaaaaaaaaaaaaaaaaaaaaaaaaaaaaaaaaaaaaaaaaaaaaaaaaaaaaaaaaa

SEQ ID NO: 397 - DNA, 1485 bp, Zea mays
ctcttccgggatggaccaataacattttatatctggacgccccttatcgccctcgttatttacatcgctgccaccctcctctccgccgtcgccgccgccgccggggatggggggagcgcaattccccggcgacaacgacgtcgcggaagtagacgcggcccgcgacggagaggtggaccgccgtgacgtgggcaagatgaagcacgggtgcgagcattaccggcggaggtgcaagatcgtggcaccgtgctgcaaccaggtgttcccctgccgccactgccacaacgaggctacggcttccggagatcggcatacaatatgtcgtcaggatgttgaaaaagtagtttgcctactctgtgaaacaaaacagccggtgtcacaagtgtgcataagctgtggagtcaatatgggagagtacttttgtgatatatgcaaattttatgatgatgatacagacaaagggcagtaccattgcatcgattgtggcatatgcagggttggtggcaaggaaaacttcttccactgtgtgaagtgtggatcctgctattctgttatactccgtgataaccatcagtgtgtggagaactcaatgaggcagaattgcccaatctgttatgagtatctatttgactcattacaaggaacaagagttcttaactgtggacacacaatgcacttgacatgttttgaagaaatggtggcgcataacaaatacacttgtccaatatgctctaaaacagctcttgatttgacacatcattgggaaatgttggatcaagagatcgaagccacgatcatgcctcttgtgtatcgctacaagatttgggtgctttgcaacgattgcaacaaggtctcagaggtgaactttcacgtgattggccacaagtgcagccactgcagatcgtacaacacccgaacgacatcgcgccctgcagatttatcgggaagcagctcaccttcaacagactcatccgacaacaacatatagagaagaaaccattgacagagccaatatgattgaagaaccgaaggaggaaatattgtttcggggcgtgcgtgcttgccaaacttgaagactcccagccgtttattggccctcatcttgtctagattcagttcattccatgagtctttgctgttgtggcaacttccagcttgcgcatcgctgggtcaacaacccacatggccggcgtagctgtccctttgaatcttgttcgcagccgtgattttatcactgtgggtgaaacgtaatcacatacttactgtaatctactatggctgaagatgtgtgcccccctgactcatgccttgtgtgcttgtgctgaactgtttatgaattcccgtgctgttccgtaacactatattgccatttgtgtttccttatctgtcaagtaccgccaagtgtgcggtgaaattgtaatttatttgcaatgaatagaatcttatatctatacctaataataaagactcaacatttctaaaaaa

SEQ ID NO: 398 - DNA, 1962 bp, Zea mays
tgagatgatctctattcgcttggaaagtagagataggttaaatttcggtctgaacggtgaaaccttaaataaaatcttaggatgctgtgtgagagaagcatgctggctccctcaaaggtatgtttgattgaagaatcaacggattgaaaatctcttatggatagaagtgcttattaactaaagattttgaagaagaagctgctgtctgctggagagaatggtgtggacaacgcggtaaatttggtgcagatggatggtgtgttcaaattgatcggagttctctggatggatacctatcgagtagtataattcctctctcagctcactgtccagacaattagtgctatctgtgactgttgggcaatcaggttatcgagattttgctggttggagctgtccggcattgctttcatcttttatcaatatgccggtctttggcagcatatggcgattcagaactgtgcgcagtggtttcctcgaatttaggaccccccaactgcattctgtattgagaacattcctgctaaatacatgatacttgcaggtattgtgttgtgtttgcaacgtgatagcttgtactgggaacaaaggtcaagatgggcgccttggacctacaccttgactttgcttctgctcaacatggacaagccaagttaaaggaatatgccaagagctctttgttgtctgatggaaactacaatacagacaagatcaatggttcaaaccctgatgactatgagaaatttgagaaagggataatgcactatgggtgtccacattatagaaggagatgccgcataagagctccttgctgcaatgaaatttttgattgccgacactgccacaatgaaactaagaattccattaaaattgataaaatgaagaggcatgaacttccacgccatgaagtgcagcaggttgtatgctcattgtgtggcactgaacaggaggtgcgacaagtatgtatcaattgcggtgtttgcatggggaaatacttctgtggtttgtgcaaactcttcgacgatgatgtctctaaacagcagtatcactgcaacggatgtggaatatgtagaatcggagggagggagaatttcttccactgttcaaaatgtggatgttgctattcaattgcgctgaagaatagtcatgcatgtgttgaaggggcgatgcatcatgactgtccaatctgcttcgagtacttgttcgattcgacaaatgatgtttccgtcctgccttgtggtcataccattcatgtaaagtgcctgaaagaaatggaagagcactgccagtttgcatgccccctttgctccaagtcggtttgtgacatgtcgaaggcatgggaaaggctcgacatggagctggcaactctgtctgactcctgtgatcacaaaatggtccgcatattatgcaacgactgcggggcaatatcagatgtgcagttccatttgattgcgcacaagtgccagaattgcaagtcatacaacacccgccagatttgaagtaagaatcgcaagtcacacaacaccgtcagatctgaaatagcaaatcctgtgggggtttctgcatttcttcaagaagcgtgatggactgatggccccttcccgtgagctgctgagcaccgggatatctggcaagacactcatcactgtatccactccactgggtcctgcggaggcaaacagctcgagattgtatatctgctgctagctgccgcccttcgttatgcataagcctactcttgccgttttactcctgtcgctccgtgattctagtgtaataatgtcatatttactgttgcttcaagtatggcccgtacggctgcggttgaacggcggcggcggctgctgagccacagtaccttgctgttgctgagactgcacccagccacagtgcgccgccgccgccgcagcttgtagctggacttgatttatgaaggtgccggaagagttcttggttgcgggt

SEQ ID NO: 399 - DNA, 1324 bp, Zea mays
ggcttcatcagctcattcaattctcgttccatccctcgtctcttgtgtcccgcctccgttccataattcaccagcgtcgtcctacccatatctcccatcgtcttctccctcgcgccatcagcttccccaagccagcggcgaccatgatctccccggacaccatccgcacggccatcggcgtcatcggcaatggaactgcactcgtgctcttcctctccccagtgcctacgttcatccgcatctggaagaaagggtcggtggagcagtactcgccgatcccgtacgtggcgacgctgctgaactgcatgatgtgggtgctgtacgggctgccggcggtgcacccgcacagcatgctggtgatcaccatcaacggcaccggcatggcgatccagctgacctacgtggcgctcttcctcctctactcggtgggggctgcgcggcgcaaggtggtcctgctgctggccgccgaggtgggcttcgtcggcgccgtcgccgcgctggtgctcagcctggcgcacacgcacgagcgcaggtccatggtggtcggcatcctctgcgtcctcttcggcaccggcatgtacgccgccccgctctccgtcatgaaaatggtgatccagacaaagagcgtggagtacatgcccctgttcctgtcgctggcttccctcgtgaatggcatctgctggactgcttacgcgctcatccgcttcgacctctacattactatccccaacgggctgggcgtgctgttcgcggtggcgcagctggtgctgtacgccatctactacaagtccacccaggagatcatcgaggcgcgcaagcgcaaggccgaccagatcgccatgaccggggtggtcgtcgacggcggcaagaccaacaaccaagccggcgcgggccaatactgaccgacgatcaagtgacgatcgacaccaatatgctcaagcaagaagccagcggcaaatcaattatgtcgccgctgggttttatgtattttgtgattctatatgcacgctgcttgtccgtcccggccaatggaaaaaaaagggggaagaaaaaatgtctgtcggtatatgtgttctcgccgaataactctcgcgcatagctagctggtggggctgagtcactgccttcgctatatgtatacgtgcaaaaattagaggtggagggttgttttagctaatcccaccttaattccaaggcagagtgacctttttttttctccttctgtttcggctaggattttgctataattgagcaatttagcgcgacttgttattggtgttggtgtgtctcaatcaaatagtaaaatgttcaattttactctttc

SEQ ID NO: 400 - DNA, 1132 bp, Zea mays
aacaaatctagggttccaagcgagcgaataccttcctccgcctgccgatctccccgcatctctcgggctaagacgattcgaggcacgagcgaagatgccgcagcggcattcgaaaaacaacaacgacctcgccttcttcacgtacgaggagaagcggaagctcgggtacggcacgcagcgggagcgcctgggaaaggactccatcaagcccttcgacgcctgctgcctctgcctcaagccgctcatcggcccgctctgctgccccaagggccacacattctgtaaggagtgcatcctcgagtgcctcctctcccagaagaaggacatcaagcgcaagctagcagcacatgaggcccagaaaaagcaggagaaagaagaggaggaagagaagctaattctgcagaaggctaaggagttggatgcctttgatcagcagaatcatggagctgttccccagtaccatgatcgcagtggttcccaatacaagaatgggtttcatggagcaaatagtgtgaaggtcacttcttttgaagaggaagcccttcgcaatatgaaggcattctggctcccttcagctactcctgaagctacggtcaaggtagacttgccctccaccgacactgtttgcccggaggggcaggagaagcttaagttgaaatcgctcttccctatctcgttcacagaggaaactgctgatcagaagagcagcaaggcaggaaactcctgtagctacatgtgccctagttgcaagtccactctcacaaataccatgtcccttgtggcggtgagcacctgtggccatgtcttctgcaagaaatgttccgacaagtttctagtgaaggataaagcttgcttggagtgcagcaaaccattcagggagaggaatctggttccattggagaaaggaggaactgggtttgctgcacatgatgaacgcctggaggcaagagatttcaagtatttgggtagtggctctgggttagggctagtgaagcctgccccaaaaacttactaaccttgaataattatagctgatgttgtgtattgtttaccatggtgtcatgaaattatgtaacctggagaattttgttttatggcatcaaaatcgttgtattcagaacagttcatcttc

SEQ ID NO: 401 - DNA, 1080 bp, Zea mays
cctcacttaaaccctcctccgctcgacgacaccacacgaaaatatacgtcagaataaaccgcagcaaatcttctccggcaccggcagcgcccaaatccggcaatccgctgctccgaatggactcaggttacaatccccggacggtggaggaggtgttccgggacttcaagggccgtcgtgccgggataatccgcgcgctcaccactgatgcggaggatttcttcaagcaatgcgacccggaaaaagaaaacttgtgcctgtatgggtttcctaatgagagctgggaagtaaatttgcctgctgaagaggtgccacctgacctcccagaaccagcattaggcataaactttgcaagagatggaatgcaggaaaaagagtggttgtccatggttgctgcacatagtgatgcatggttactttctgttgcattttacttcggtgctcgattcggtttcaataaaaatgacaggaagcgcctctacagtttgattgatgatcttcccatggcttttgaaattgttagtgggaagagtgaaaccaaggcaccagcaccaccaagcagtagtaaccacagcaatatcaaaccgaagtccaacaacaaaaagaaaccaccggagcctaaggtgaagcagccaaagccgcgtgcccctgcagaggaaggcgaggaggaagatggcagtgcaagcgaggacgagcacggggagacgctgtgcggcgcgtgcaaggaaagctacggccccgacgagttttggatctgctgcgacctctgcgagaagtggttccacggcaagtgcgtcaagatcacggcggccaaggccgagcacatcaagcagtacaagtgcccgtcctgcaccggcggcggtggcgtcagcaacagcggcaccaagcgagcccgcccatcatagctgcgacttttagtgatgtaaactgcttagaaaaactgttgcggacatagcgcccatcatagctgcgactttttaaatggtgctgtaaacttttgtagtgcgactaggccgtttgtcaccctatcatacttggcttcaagtaggttttttgtttttcagttttcaaaaaaaaaaa

SEQ ID NO: 402 - DNA, 1666 bp, Zea mays
attcggctcgagcgcacgcaaagcacggacgggcgcatacagctttccctttcgcgagtgcgtgccccttctcttctctagttctcttctccgtcgcgtcagagatcagggagagaccagagcaaacaacaaccaccgcttgtttcatcaagaatcgtggaggagaaccgaaaggtgtagtagccttttccggtagggcatctgctagagccggccggttgaagcaggggagcgagaggaggagggcagccgagcaggagcatcgcagtggtggttaagcagcagcaacgacgacgacgacgacgctgagaggtttccccgttcccgacggcacgtccaccgaggcggcgccatcgcgatgggtcctctggcgccgctgaggtgtaacccgccgccgccgttctccaagtcgccggggtccctgctgctgctgtccaagtcgctcaccctctactgctgagccgagccccctcctcgatcggttccatgggcgccgtggcctcgtcggcgggtggggcccggggaggcgatggcacggtgctgggcgacctgccggagaactgcgtcgcggaggtgctgctcaggctggacccgctggagatctgccggatggcgcggctcagccgcacgttccgtggcgccgcgtccggggacggtgtctgggagtccaagctaccgaggaactacgcgcgcctcctcgccgttgctgcggccggcgatggggaaggtgggcaggccgccgcgtcggcgccgggggcagagctgctgcccaagaaggaactgtacgcgcggctttgccgtcggaaccgtttcgacggcggcaaaaaggagttctggctggacaagggcggtggaggtctatgtatgtcaatttcttcaagggcgctttcaataacaggcattgatgataggaggtattggaacttcattcccagtgatgaatcaagattccgcacggttgcgtacctctcgcaaatctggtggtttgaagtgagaggggaggttgaattcttcttcccagaaggcacgtacagcctattctaccgcattcatctcggccgaccattcaagcgtcttggccggcgagtctacagctcggagcacgtccacggctgggacatgaagccggtgcgtttccagatgtcgacctccgacggacagcatgttcagtccaagtgctacttgagcgatcccggtatctggatcaaccaccatgtcggggacttcgtcgtgaaggactcgagcaggccagtgaacatcaggttcgcgatgattcagatagactgcacgcacacgaaaggcggcctctgcgtggattcggtcgtggtgaaacctcagcacctctcgcagaaaaaaagcgccctggacttacgtgtagactcgtcgaacaagttgctgctgctgtctagggaggagggatatgatccatagtttccttttggattgttctactaccagatgtgcgttttgtttacagaagtgcggttttttacatttgcacttatacgcgtattttgcagtcatgtaatgtaattgaaggggtaagtgatttttttagttcctcttgtcccccctaggaacatgttggacctctgtaaattgttcgtttgaactttgaaatgtacatcggctgtgttctgcctatcacaaaaaaaaaaaaaaaagg

SEQ ID NO: 403 - DNA, 1419 bp, Zea mays
agcgatttcgccgggggggagatcttgccattccgtggagcaccatccgcggtagcctagccgcgactggggatcggggcttgcgggccgtggagccacccagaaggtagccgggaaaagcttgatccggccggggacggggccttcggaggttcgtccctcgatcgggtgtcgtctgcgaaagccgggtcgaacaaatcgtcgcgactggaggcggcgcggggtcatgggggcgtgggtctcggtcctgctcgggatggacggagccgcggcggccgggcctgctgctgtgggcctgggcgacctgccggagctctgcgccgcccaggtgctgctccggctcgacccgccggagatctgcaggctcgcgcaggtcaaccacgcgttccgcggcgccgcgggggctgacttcgtgtgggaagccaagctgccggagaactacaactatctgatggagttcgtggggagcggcgacgaggggaagcggaggcggcggcgggccgggaagaaggagatctacgcgaggctcgccaggcctgtgccttttggcgacggcaagaaggaattctggttggacaagaacaaaggcatgatctgtatggcactgtcgtccaaagcactggtgattactgggattgatgacagaagatactggcaacacatgccaacttcagaatcgagattccagtctgtagcctaccttcagcaaatctggtggtttgaggtggttggtgaagtcgatttctgcttccctgttggaacatatagcttgtacttcagggtccatcttgggaagttctacagacgatttggccgccgccagtgcacctcagagcatgttcatggttgggacaagaagcctgttcgcttccagctatcgacctctgacgggcagcaggcattgtctcagtgctacctggaggagcccgggagctgggtcctgtaccatgctggcgattttgtggcctcaaagcctgaccagctgatgaagctgaagttctccatggcacagatcgactgcacgcacacaaaaggcgggctgtgcatcgactcggttcttatctatccaaaagggaaggggtttcaccaggagagggtggtcaggtctcagaaatgagggttgtagatgttgtggaggtattcacattaggatgttagagcaaatgcagcttgcagcctgatcttatttttactttgggctctagttcgcagcagaggtgaagtgtatgtggttgtagaactcaggtattgtgtggtcaggtgaccaccagagtgctctgtcagtcctttggcaaggtcgttttcgccccccttcagctgaatttggacagcgagatagccatgaaactgtactgaaatgagttcgaaggtgtcattcccagtttctaatttgctttctactgcttagtttcggaaaaa

SEQ ID NO: 404 - DNA, 1723 bp, Zea mays
cagcctccaggcccatgtgaaacggtggatggcccgccctacgcgacccgggttctgcaccctgccgtttcttctccattattcccagcgggcgcgctcgctctctctttctccctcccctcctcgtggcgacgattgggggcagtcgctgccgccgtacgccaggtgcccagatcttcttcatgcccttctccagcgacgagtatcagaagctgtttgtgcttttaaggatgcataagcgtatggcggttttgatggtatccattgtttgaacgatgggaggatagaagaccattctctgcataaataggcttcataagtattattgctttattgctttaatattatcatatgattgagtgcacaatgccatcaaccttacttgatgatctccctaacgaagttgctctccagtgccttgcacgggtaccattcttgttccatccgacgcttcagttggtttgccgctcttggcgagcatcagtttgcagtggcgaacttctcaaaattcgtaaccagattggtacgacagaagagctcttgtgtgtgttggcgtttgaaccagaaaacatgtggcaactttatgatcccctacgagacaagtggataactcttcctgtcatgccatctcagattaggaacatagcccgctttggcgtggcctcagttgctggcaagctctatgtaattggtggtggcagtgatcgagttgatccgcttactggagatcacgacaggatctttgcaagcaatgaggtttggtcttatgatccgctgcaccgtgtgtggtcccagagggctcctatgcttgtggctcgagcgatgtttgcttgttgtgcactggatgggaaaataatcgttgcaggaggcttcactaactgccgcaaatcgatatcaaaggctgagatctatgaccctgaagctggcatatgggagcctcttcctgaccttcgtctggctcatagctctgcatgtactggacttgtcatcaagggtaagatgcatgtattgcataaaggtctatcgacagttcagattctggaagatggtggcagtcattgggctgttgaggatttctcttggttgcaaggcccgatggcgatggtcggtggagagctgtatgtgctgagtaacagctgtattatgaagcaacgtggtgagaacttccctgataagatggtatcgtgtgcatctgagttccagagcaggatcggtttcgggatgattggtgtgggtgacaacatatatttggttggaggagtgattggacctgggccgagaaaccaatgcatcaagctgctctctgatgttgatatcttgaacgtcacaagtgagagaccaacctggagaccagggtcgccgatgacgcattgccgagggagcatctgtggctgcgctttgttgaggatttagcgtcttcccagtgtgatagtgtgagtattccaccattgctgaactgatcggtgacgtcctaagttttattttattttcaaaagggttgttatttacgctttccttttggatcctttgtagcattgagggcatgactcaatgttggattgccaatgagatatatactatattgaccatgaacagtgttccagaacacactatatacttcatcattttcatttggcatttaaatattttggtggttttaaatgacatcttgctggtttgaataaaaaaaaaaaaaaaaaaaaaaaaaaaaaaaaaaaaaaaa

SEQ ID NO: 405 - DNA, 1938 bp, Zea mays
cctccattcccttccctgctcctctaccccttcctctcccggcgaccagctggcctctcctttgttgaggcgagagacccccacccgatccggcgatggacgccgcgtccaggccgcctccgccccacggagcaggggtccgcgtccgcgccccgctggtggagtctgtctcctgctactgcagattagatacaggccttaaaactgttgttgaggccaggaagtttgttcctggcgcgaaaatgtgcatgcaacctgaagtcaaacaaaacaagcgcaagtcaaggggctcaaaaaaggaaaggtgcaggactcaagcaccacttttacctggccttcctgatgatcttgctattgcctgccttatacgagttcctcgacttgaacagcccaaactcaggatggtttgcaaaagatggaaccgtcttttgtctgggaattacttttactccttgcgtaagaaaattggagtggcagaagaatgggtgtatgtctttaaaagggaccgtgaagggaagatatcctggtatgcctttgatccactccaccagctatggaagtcactcccaccagttccacaagagtattcagaagcattgggctttgggtgtgccgttctgagtggttgctatctgtacttgtttggcgggaaagatcctttgaggggttctatgaggcgtgttgtattctacaatgctcgtacaaacaaatggcaccgggctccggatatgatgaggaaacgtcacttttttggttcttgtgtaataaacaattgtctctatgttgctggaggagagtgtgaaggaatacagagaacactgcagtctgcggaagtttatgatccaaataggaacagatgggcctgtgttactgaaatgaacaatgggatggtgcctttcattggagttgtatatgatggcaagtggttcttaaaggggctagattcccatcgccaagtaactagtgaggtctacttaccatcatccaatacatggtcagcaattgatgatgagatggtcacaggctggcggaacccaagtatttctttcaatggccgtctctattcagctgactgccgggatggctgcaagcttagagtctatgatgagaacacaggaacatggacaaggttcatggacagcaagcaccacttgggcagctcacgtgcctttgaagctgcagctttggtgtcgctaaatgggaaactctgtgtcatcaggaacaacatgagcataactcttgttgatgtctccaacccaacaatgagtgttgagacagatagtgcgcgcatgtgggaaactgttgttcggaagggccagcacaggtcgtttgtggcgaacttatggtcgagcattgcaggacggaacttaaagagtcacattatccattgccatgtgctgcaagtttgagggcaggttttgttagtgggaacatgatcaagttttttaagaagcaaaaggttcagatcagtgacagaaccctccatttcgaaggtagtaaggtttcattgcagaatcgcggggaaaaaggtcattggcgtgccactgctgcccccaaagtcccaaatagttatttgctctcttccagaactgaaaattccaattactttctggcaacatttgaagactcttatcattaatggataaggtttttcagattttgagtgcaaaccagaaagtgagtaggaacttccctagtgtaatgacattttccccttgctggcaggctgggaaatgtgtttggtggatatattggtctcttatcatatttatctatctttgcatcgtgtaatatgtggcatcttactgtgtaatgttggtgtatattgtagtggcggactagctagactccagggttagagtagtcaggattatgcctagtatgcttcaatttttttgttggtccgttcataaatatatgacgccattgacgtttttt

SEQ ID NO: 406 - DNA, 1841 bp, Zea mays
cggctcgagcggctcgagccgatctggcccagctctgggttgcgcgaacagtcggaaccctaattccctccccggcgccggcgccggcgccccctagctgcgcccccacgaccagcagaatccagatcgaagttttgctcttgccgcggccccgcctaaactccaaaagtgcgaaccccctaactcatcgatcccagcctgcctccgcctacgcgcctcgtgacggcgtggacccctcccctatctgcgtgctgcgcgcatccgcctgcggcctgtcccgtgcagccgtgcctcctccgcgcacatctccagggtctagccgagagcagaccgccgtgacgccaccactcgcgctcgcgctcctgacatcgttgtctgccttctctgtctaagatcagagcagagctccatcgaaagcgtcgcccgcctgcttggatgatcaatcaccacgaaatagtgcagtttgggaagctgtacaatagagacatggaatcagctcctgctcatacccctcttatacatggtcttcctgatgaggtagctctcatttgcttggcaagagttcctcggcggtatcataatattctcaggcgtgtctcaaggagatggagagctctgttatgcagtgaagaatggcacttgtgccgcaagaggaataacttggacgagccgtggatctatgtaatctgtagggaagcaggcatcaaatgctatgtgttggctccagatcctccaagccggtgctttcgaatcatgcatgtcattgaacccccatgctcagggaggaaaggtgttaccattgaagctttagacaaaaagctatttcttctgggtggctgcagttccgtgtatgatgctacggatgaagtatattgttatgacgcatcctcaaatcgctggagctcagctgctccaatgcctacagcaaggtgctattttgtgtctgcatcccttaaggagaagttgtacataactgatggatacggcttgacggacaagtcaccaaattcatgggacatctatgacccggccacggactcgtggtgcacccacaagaacccgttgctcacccctgacatagtgaaattcgtcgcattgggggaggagctggtgaccattcaccgagcggcgtggcacaggatgtactttgccggcgtatacgacccgctggaacgcacctggaggggcagagggaacgagatcgctctctgctactcgagcccgacggtggtcgtggacgggacgctgtacatgctggagcagtccatgggcacgaagctgatggtgtggcgggaggacgccaaggagtgggccatgctcggcaggctctccgacaaggtcactagacccccctgcgcgctcgtggccatcggcaggaagattcatgtggtcggaagagggctgagcatggtcaccgtggatgtggacacggcggcaagggtggacgggttcctggttaccacctctgtaggcccgttggtggaggaagacctgaccccggagaggtgcgtggtgatcaccatctgaaggggtgggcgtgtccaagcttccttgacgccgggtgtattgtggtaactgtgactgactatcgtcgctggcgccgaacatttggctagctagcgtggatgatatatactgcgatgtgagtgaattcaataagaggcttggctctccatacagccaataactatagttagcatttgtatctcgtgttgtttgggctgcttttgtcgactgctggctgtaagaacaatatttgagcttcgtttgttgagtactgtgcgtcccagatggatgggattaatacaagctaatgtgatcctcgtcaaaaaaaaaaaaaa

SEQ ID NO: 407 - DNA, 1246 bp, Zea mays
ccacgcgtccgccgctcctccctccccgacaccgaccgacccctcgtccgctcgcctccctccccgatccccaccgccatggccgccgccgccgccgccgcgtcctcctcttcctcctccgaggttccgatcgccgcccgcacctgcgtctccgtcggcgaggtggcggtgggcgcggtggctacaggcagcggcgaccgggtggcggcggattgcggggtgtgcgccatctgcctcgacaggatagcgctccaggagacggccctcgtcaagggttgcgaccacgcctactgtgtgacctgtattttgaggtgggcatcctacaaggagaaccctctctgcccacagtgcaagcatccattcgaattcctcagcgtgcaccgctctctcgacggctgcctacatgactacctgtttgaggagagtgtttgcctccttctgagggcagcttggtttgaacctctgatcgtagaggctcacgaggaggctctggaagaagaagagtttctccaccagcagtaccaatacgatgatgacgaagatgatcttgacgaggaatcttattacatgaacaggtccccaagcatccgtattggtaacaggagatggggtgacaatgggtacatcaggggaggcaggaaagaggcgaggccagtgaatactgatgtggctgctggtccatccaggactccgaagaagaaagagaaagccgcatcctcttcggcgtcggtgtcagtgtctggttcggggtcaggatcggggtctgtatccaaggatgtcgctggaaggcgggcgaagagggcgcagaagcgagaagctgcagacaaggcagctgcagagaagcacctgaagcacctgcagaggttggggctgagaaaatcgccagagcctgtagtgcccgaggaggttgggccacaggtgaatgagtgacttaagccgccgcctagtgctatatggtgctgctaaaaacactgcagccctttgggccacaaaataatcttccactgtgaagagcttgagcgtggccttgtatcatggcagcttttcgcctcgttgtacatagtctagtttctcatcactgttttagattcagcacagaaatgcagctgctgtctgcacgactgttgcagctatgaagctgtatgtacctcactgttggtgcactattttagttattgctaatcacaggggatgcaatcggcatctgtgttgattactaaaaaaaaaaaaaaaaaaaaaaaaaaag

SEQ ID NO: 408 - DNA, 605 bp, Zea mays
gtcagggctgagtgtgccacaagtggatcattggaggggaggaagaagctgaccactgtgtctccatcggagtcgggcctagtgggttgatcaacatggttgtttgttagttggtcatggtagcactatgaaggtcaagattcttcagtggcatgcagtggcttcttggacgtgggatgcacaggatgagacatgtggcatatgcaggatggcttttgatggctgctgtcctgactgtaagttccctggtgatgattgcccactcatttggggtgtctgcaaccatgcttatcatcttcactgcatactgaagtgggtcaattctcaaacatccacacccctttgccccatgtgccgtagagagtggcagtttaagggctaaggtactatggacatctagaactgcaccaagcgactctcagttctcagagaagactgatgtttttctggtacttctgtgatgctttattttaactactacatattgttttccgtacttagtataaatcctgatgtcagcgcctgatcctgtgtatgcttccaagcttgtagtggaacaaatgaaattattgcttttcttagggctgatttcctaaaaaaaaaaa

SEQ ID NO: 409 - DNA, 681 bp, Zea mays
gagaaattgtacacatattccctgcctctcgctagcgccttccctccgcaaacggaaggctctcgtgaccaccgggatgtccgccatggagaccgacatcaacgcgccgccgccgcccgccccagctggcgagggatcctctgcggccggttcgtcctcctcccgcaagcccaacaagcgcttcgagatcaagaagtggaacgccgtcgcgctctgggcatgggatatcgtcgtcgacaactgcgctatctgccgcaaccacatcatggatctatgcatcgagtgccaggcgaaccaagccagcgcgaccagcgaggagtgcactgttgcttggggagtctgtaatcatgcttttcacttccactgcatcagcaggtggcttaagactcgtcaagtgtgcccattagataacagtgagtgggagttccagaaatatggccactagttcctgggcaccctcatgtgatgttggggcttacttctagtgactgctaccactcgagtgtatttttttctgccaaacagctccatcttttactgctttggatgcttgcatgtatcacaggtcaattatcactagtagtacgtccacctgggactgtatttggattgttcgttgagaggatagtagttccattttataaatgttatgtggattttcataagtgagcttgaattgtg

SEQ ID NO: 410 - DNA, 1997 bp, Zea mays
cccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtgtcgaagaagtcggggcttctcttcgagcggcggctcatcgagcgctacattgaggaccatggcaagtgccccatcaccaaggatgagcttactatggatgatatcgtgccggtcaataccaacaaggtcgtgaagcccaggcctttgcaggctgcaagcattccaggactccttgggatttttcagaacgagtgggatgctctcatgctttctaattttgctttggagcagcagctacacacagcaagacaagaacttagtcatgcactctaccagcatgacgctgcctgccgtgttatagccaggttgaagaaggaaagagatgaggctagagcacttttggctcaagctgagagacagattccagcatcagttgcaggagctgctcctgcagctgttgtttccaatggaaaaagagcaatggaagatgaaattggccctgacggaaagaagattcgtcctggtatcaaccctgtcatgattgatgaacttacagagtgtaataccatgctttcagcacagcgtaagaaaagacaggttcctccaactctggcaccattagatgcactcgagagatacactcaaatctccagccatccccttcataagacaaacaaaccaggcattttgtccatggatgttcatccttcaaaggatgttgttgcaactgggggtatcgatacaaatgcagtaatctttgatcggtcatctggtcaaatcttgtgcacgcttactggtcactcaaagaagataaccactttaaagtttgttccacgggatcaactctttgtaactggatcagcagataagactgttcgcatttggcaagagaacgagaatggaaactataactgcgtccatacattgaaagatcatactgctgaggttgaagctgttacagtacatgcgactcagaagtattttgtgagtgcttccaaggataattcgtggtgcttctatgatatttcaacaggatcttgcctgacacaggttggcgaggcttcaggacaagagggatatacatccgcgtctttccatccagatggtcttatccttggaacaggaactactgatgctgttgttaaaatttgggatgtgaagactcagtcgaatgtcgcgaagtttgaggggcatgtaggaccagtcactgctatgtccttctctgaaaatggttacttcctagcgactgctgctcatgatggtgtcaagctttgggatcttcggaaattaagaaattttaggaccttctctccctatgattcagatacgccaacaaatactgtggaatttgattttagtggaaactatcttgccattggtggttcagatataagggtctaccaagtagctaatgttaaggccgaatggaatctcatcaagacattaccagatttatctggaacagggaaagtaacttcggtaaagttcggagcagatgctaagtacatagccgtaggttctatggaccgcaatctacggatatttggcctccctggagacgaccaaatggaggaatcaaccacagcggcagagtgaggaaaatccatggtacctaatttcctcctcctggtatactccgcaatatgttctgatgatgggtagactgagtgcaaatggatacatcacgagagaagggtcctcgcggcgatgaactggcttgagcttcggtcggtgtaaacaagctgtgacattattgtattgtaggcctcactaattcgtctgatggggatacaatttgttttgatgagtacgagtgtacgacgctaaacagccaaagttctatgcat

SEQ ID NO: 411 - DNA, 1757 bp, Zea mays
ctaatttctcgtggaggcgagcagatagacaggagagagaacgcacgcaagaacgcgctctcctcgcgattggacagggcgcgaacaccccgaggacgcgcgcgatccccgaggacacgggggtgacagcctcgccgtcgccggggcggccgtttcgagctccgtcccgcctcggcccggctcagatttggtgggatccggccaagaaatcccgcagttggtgaggaggagaggaggggagaggaagggagggcggaggggatgggcgtcggtgcggagcccaaggatcaggcggcgacggccgctggggtgccggcagagcaggacgaggcgggcgggaaggaggacaaggccgccgcggtgtcctgctcgatctgcctcgacgcggtgctcgctgcgtccggggagaggtccaccgccaggctgcactgcggccacgagttccacctagattgcattggatcagcatttaatgccaaaggggttatgcaatgccccaactgccgcaaaatcgagaaagggaattggctttatgcaaatggttctcgatctgcccatgatgttagcatggatgaatgggcccatgatgaagacctttatgatgttagctactcagatatgccatttcgcttccattggtgtccgtttgggcgcttaacccaacttccatctttatttgaggaaggagaatcatcacctccagttacatttcatgacttcatgggacaacatgtgtttacggagcaagtagctgtatctgctgcagcagggacaactaatccttgcccctatgtggcatacttgcatcctcttacaccattgacgtcattgtcaagctcccatgtccctgacagaactatggatcgtcctgcataccatgatcattggaaccccatggctgggccatcagatgttaggtccatgcaaacaatgcaacctgctgattttcatcatagccattgggcacatgtgccccattcttatggtcaacccaacagcaataacgagcagccaggaatcccctttggagcaagggctgtacgggtcgatggtgatagccaacgccgagcatctgttgtctctccatcttacttcagtaatggatctggttccagatctagacctcccaatgttcctcctctgatgcctcagttcatgagggctcatggcagcatcagcgaacagtaccaacagaattcatcatctagcttatttgctggggcccataggtcaggaggcatgcgacctgccccaacacctctaccagagaaccccacctttaccttgttcccgccaggttcatctggccatagctcgatggagactgatgatgctgggggaagccggttctacgcctgggagggtgaccggtttgccccatacccgttgatgccggtagactgcgagacaagctggcggacctcacagcagcagtcccaccagagcacatcagagcctacatctgctccaaggaggctgtttgggcaatggctcgctgtcggcaggccatccccatcacccgaggggtcttcgtatcgtcaattgcactcaccgcggatgtagaccctcgccgctgaaagaaacgatgggaagcccattgtattaagttaagccgggctgtgccgtgaaactttgggacgatgctcgaggggacagaaactggaaacgatccggctgaggatatttcgatttggtttatgtgaattccatctcgtacatatttgaaatcaagttgggatgctgggagcttcgaatgt

SEQ ID NO: 412 - DNA, 1709 bp, Zea mays
attcggctcgagcgaaaccgctagaggcagagggaggcgcagcacgaggaactcgttggtggcatcgagcgagcggtgcgagtggcacgagtgcgtgcgcgagcaagatcggagcttttccttcgtcgcagttgtggggaacgcggcgagcgcttccgtgatgggcgccggcgcccaggaggatgaggaggagataaccacggtggccgagggaggagtcggagaggaggagcaagcggcggctgagggcgcaggggaggaggagcagttggagcagggtgcagggggcgagggagagggtggggaggagaaagctccggcggtgatgttgtgctcgatctgcctcgacacagtggtcgccggaggcgaggagaggtccaccgcgaggctgcagtgcggtcacgaatttcacctcgattgcattggttcagcatttaatgccaaaggaatcatgcaatgccccaattgtcgcacgattgagatggggaactggctttatgcgaatggttctcgatcatcacaggacgtaaacaatgatgaatggggttatgatgacctatatgatcatggtcactcagagctggcaacctttgtgcctcttcgcattcagtggtgtcctattgggcgcctagaacttccatccttatttgaagaaggagagtccccagctccagctacttttaatgatttcacgggacaattcaactctgagcccatggtaccggtacctgccacacctcatcctggtccgtatctagcttattttcagcctgccccgacaccggtatcatcaagctcccttgtcgctgagagaacaatggatggtgctgcatatcatgatcactggaacactctggctgggctatcagatggccgacgaccctgggcgtactatcctcaacccaacagtgataatggtatagctgagcagcaaggactccctctgggggcaatggcggttggaggggttgatagtgaaagccaacaacgaggatctctctccttattttatggaaacgggtctggaagaccaaggatcccaggtgttcctcctatggcaccacaatttacaagagcgcatggcaacataaacgatcagttccagcagacagctagcttatttgctgggtcacagcaatcaggaggtatgcgtccattgggagcagtagggccttccgtgccaccacctccggagaacacctccttctgtctgttcccgccagcttcatccgtccccagtacaatggaggccgaggatgtcaacagagcaaaccagttctatgcatgggagagggatcgcctggctccttacccgctgatgcctgttaatagtgaaggtacctggtggagctcttcacaacagcagccccctccggagcctgctgcatctgcttcgaggaggctttctgggcagtggattggtaggttgccattgccaccaccagagaatagatcgccagacggctcgtccttccgtccactgcacatccctcggatgtagcgcaggaactggcaaggcgtaagttaatagtacaaacgtgggaaaccctgttggttgtaagtggtaacgccactgtaagaaagccccgtcggatggtaaaccttgtgataaaattcaggatgttgaagaaaccgaccctgaggtgaaaacatttttggcccggggtttatgcaaaaaaaaaaaaaaaaaaaaaaaaaaaaaaaaaggc

SEQ ID NO: 413 - DNA, 1230 bp, Oryza sativa
gcttctccaattttccaagcctgcctccaagcgcacgccacgatcttctagaagcgattcgcgcgcgccgccgcctcctcccctccccttccccggagcgaagccgccccgccgggggggatgtcgccggcggcggacagcgcggcgtcgaagcggcaggcggagctgctcaagcaggagggcaacgccttcttcaagaaggaccgcatcagcgccgccatcgacgcctacaccggggccatagctctctgcccaaaggttgcagtatattggaccaaccgagcactttgctacaagaggcggaatgagtgggttagggctgaggaagattgtagaacagctattcagcttgacagccactctgttaaggcacattacatgctcgggcttgcacttctcaacaaggacgaattggccgagggaataaaagaactagagaagtcgttggagcttggaaggggtgcacatccagcaagttacatggttgaagagatctggcaagagctttctaaagcaaaatacatagaatgggaaaatttatcaagcgaacgagtccgtcaattgcataagctgaaggaagcatgtaaagaagctcttaggaattataacagccttgacaatcctcctgcatatgtccccgaggaacagctaaatgagcttgaggaagtttttcggaatgccaggaagtctgatattccaacagaagttcctgatcatctctgctgcaaaattactcttgatattttcagagacccggtgataaccccaagtggaatcacgtatgagagggcggtgattcttgatcatcttcatagggtggggaagtttgatcctgtgacccgtgagacacttgaaccacaccaactggttcctaaccttgccatcaaggaagctgtccatgcatttttgagtgaacatggttgggcttacaggatgagatgactactttgaattacacctgggcttggagctttggaggcaacatttcagattgcaatatacatgtttcggttagtcaacttaaatgtgtcattttgtttatctttacatatttattggtggaaaaggttttacctgggatggctgtgtacagattccccttctctagctatccctcctctctactctgttcatgtgtaatgcttggtatcagattatcacttatccacagtaaaagaaaattaaagtggctgtcatactccttgttctctgattattggtttttggcgc

SEQ ID NO: 414 - DNA, 1117 bp, Zea mays
ctccaggttccagcgtgcgcgctctcttcccctctccgtcggcgacgactacgccgggtcttcttcagacccaggtcgttgccgcctacgccaggtgcccaaatcttcttagggcccttcgccggcgacgagcacacaagcttggttgacccccaacaaattgcaaaatgtcagccaatgtcggtgaatcaaccagcggtggcagcagcaatgatgcagctggggggagctttgaatgtaacatatgctttgagctgcctcaagagccaatagtgactctttgtggccacctcttctgctggccatgcctttaccggtggctgcacatccatgcacattcgccagagtgcccagtgtgcaaggctcttgtggaggaagacaagcttgttcccctttatggacgcggcaaggatcgtgttgacccaaggtcaaagaacatgcccgagggtgagattcctcaccgcccaactggtcagaggcctgccccagccccccaggccgatgctaacaacaactttgccaatgccaatccaaatgcgaatccatggttcatgggcacaggagtccctttggctaatgcgcgctgggggaactacgcattctcagctgctttcgggggactattccctatgcttagcttccaagttcatgggtttccagatgctgctgcttatgcgcagcctgctgggttccactatgggtatggccatgggcatggattccatggcggccatatgggacacgcccatggcgtccaccgacaagcaccattggggcaacagcagcaggcagatatctacttgaaggccctgctcttcatgattggaattctagtgattgcaagcctcattgcgttttaaaatttgttggcaacgtctaccaggaggcctgctcgtcacggctgggacgtggaattctgggaatgcaatcctcctgacatgtcagagtccgttgatagcttgacatttgtgatggcatattggcccatgaaccgccagaatttcagtgtgtttgtactatagcttggcgctgaatgttgcataagttattattctgtttgcatgaagtgttcatagaatatgtattaatgtctagataagtacctacgtttcgtaac

SEQ ID NO: 415 - DNA, 2623 bp, Zea mays
gctccctcctccaccaccttccagtcctgtccagtgccgccgccttgccctgccctcccctcccttcccccgattaccctcgcggttgacctcgccaatccggtcccgcctccgtataaatccgcccttctcgcccccgctccgaccacaaaccctagcggcgcgccccggcatgggctagggttcccgcggcgatggagtgggacagcgattctgacggcggcgatgacgaggaggaagaagaggtccgccccgggggtggggacgcgggcccggggttctcgctggccatcgagggcgtgctgggcgcgtgcggcatggtggtctccgacgcgctcgagcccgacttccccatcatctacgtcaaccgcgggttcgagagctccactggatacagcgccgaggaggtgcttgggaggaactgccggttcctacaatgcagaggaccatttgctcagaggaggcatccccttgttgatgcagcagttgttactaggattcggagatgtttagatgaagggactgaatttcatggtgatctgttaaattttagaaaagattgttctccatacatggccaggctgcaattaacacccatatacggagacgatgaagtaataacacactatatgggcattcagtttttcaatgattctaatgttgacttggggccatcttctggctctgtgacaaaggaacttgcaagatctacatggattgcacctggcaacactgactcaccaactccagtaggcaagggtaatttgtgggaacattctagtctctttctgctgagtgatgaggtaatttgccagaagatcttgtccaaactgtcgcccagggatatagcatcagtaaactctgtttgcaagcgacttcatcacatgacaaggaatgaagacctttggaggatggtttgtcagaatgcatggggcactgaagctactcgggcccttgagactgtggcaggatcaagaagtttggcatggggccggctagcacgagagttaaccacccttgaagctgttgcctggaggaaattgacagtcggtggtgcagttgagccatctcgctgcaacttcagtgcctgtgccgtagggaaccgtgttgttctatttggtggagagggtgttaacatgcagccgatgaatgatacatttgtgctggacttgagtgccagcaagccagaatggaggcacatcaacgtgagcgcagctcctcctggtcgctggggccataccctgtcatgcctgaatggatcacggctgattctgtttggtggctgtggggggcagggtctgcttaatgacgtcttcattttggatcttgatgcacagcatccaacttggcgtgagattcctggccttgcaccccctgtaccacggtcatggcatagctcctgcactgttgatggaaccaagctggtggtttctggtggatgtgcggactctggtgttcttctcagcgatacctacctcctagatgtgacaatggaaagacctgtttggagggagatacctgcatcttggtctccaccttcaaggctggggcactcgctatctgtctatgatggcaggaaaatcctgatgtttggtggccttgctaaaagtggtcctctacgacttagatctagtgatgtgttcactctagatttaagtgaagacaagccttgctggcggtgcataactggcagcaggatgccaggagctggtaatcctgctggggtcggcccaccacctcgcctcgaccatgttgtcgtgagccttcctggtgggagagttctgatatttggtggttctgtggcgggtcttcactctgcttcaaaactttacctcctggatccaacggaagataagccaacctggaggcttctgaatgttccagggcatcctccacggttcgcctggggccacagtacttgtgttgtcggagggacaaaggcaatagttcttggaggacaaactggagaagagtggacgctaactgaaatacacgagctttctctagcaagctcattagtctgaagatgggaaggtcccagcaagctttccagcttccttgaagcaatgtctctggagacagctacctgttcatatgacttgaggcagattttttttccaacagtggtgtgcaagcacaagcacaaaagggttggtgaagtggacaaccagacctgattacttgtgccatgcctgggagtcagctggtctaaaagtaggaataagttacctctgctgctgctgttcgtatgatctgaaatgatggaatagctggcatccataagctaatctcagttcttatcatgtttcaaatgggacactggcattatgtcgctggagcccctgatgcaacaggtaccctgccttctggttgcgcctgccttcggtgacaactgatgctgtggtcttctgttttttgacccatcaactgctgtgaagcttctttgttatgcttttgcgccacttcgtgcttactcaattgctgctttctggagaagctgtaacacagacacacctgctgtatttaattttgcctttcgtatcactttgtgcttacctcagctgttagtgatacctataacattttctttttaatctgattatcaaaggatgaattatgaaaa

SEQ ID NO: 416 - DNA, 2028 bp, Zea mays
cccgcacccaacccaaccacggacgcacgccgaggagggagaaagcgggtgtggaggggcggccggccggcctcgcatgtttgacgacgcgggggccgtggcggtgaagcggatgaggctgtgggaggaggacgaggtggaagtggaggaggaggggatggaggtggacgcggagccgggatggccgtggggaacgccggcggcggggctctccagggcggcggcgatcgtcgtggcggacgcggcggatcccgacttccccgtcatatacgtcaacgccgcattcgagtccgccacggggtaccgcgcccacgaggtgctcgggcgcaactgccgattcctgcaatttcgggatccacgagcccagaggcgacatccccttgttgatcccatggtcgtttcagagatccggcgatgcctcaacgaggggattgaattccaaggcgagctgctaaatttccgaaaggatggcgctccactttacaacagattaagtctcattccaatgcacggggatgatggctacgtgacacatgtgattggaatccaactattctccgaggcaaacatcgatctcagcagcgtgtcgtatccggtgtacaagcaacagaccaacaacaggcccatcattcaagatctgaactcagcttcccatgagcatgctccgaaagtccagagtgcagaccactgcggtatgcttcagttgtcagacgaagttctcgcacacaacattctgtctcgcctgtcacctagagatgtcgcatccattggatccgtctgtaccaggatgcatgagcttaccaagaatgatcacctgaggaagatggtctgccagaacgcgtggggaagggatgccactgtcaagcttgagatgagcaccaagatggtaggatggggccgtcttgcgagagagctaactactcttgaggccgcctcgtggaggaagttcacggttggagggcgcgtcgagccttcccgatgcaacttcagtgcctgtgctgttggtaaccgcttggtccttttcggaggggagggtgtcaacatgcagcctatggacgacacctttgtgcttaacatggaggctgcaaggccggaatggcgccgcgtgaaggtttccgcctccccaccaggccggtgggggcacactctgtcgtggctgaacgggtcatggctggtggtatttgggggctgcggacagcaaggtttgctcaatgatgtcttcgtccttgaccttgacgctcagcagccaacgtggagggaggttgcaagcgagggtcctccactgccacggtcctggcacagctcatgcaccttggatggttcgaagctggtcgtctccggtggctgcaccgagtctggcgttctcctcagcgacaccttcctgcttgacctcaccaaggagaagcctgcgtggagggaaattcccacatcttggtcacccccatcccgcctcggccacaccatgtccgtctacggtacgactaaactgctcatgttcggtgggctggcgaagagcggctcgctccggctgcgctccagcgacgcctacacgatggacgtcggcgaagatagtccgcagtggaggcagctggcgacgaccggattcccaaacgtcggcccaccgccgaggctcgatcacgttgcggtgagcctgccctgtggacggatcatcatattcggtggctccatcgcgggactccactccccggcgcagctgttcctggtcgatccagcagaggagaagccgacgtggaggatcctgaatgttcccggcaaaccccccaagttcgcctgggggcacagcacctgcgtggttggcggcactagggtcctcgtcctcggaggccacaccggggaggagtggatactgaacgagctacatgagctctgcctggcaagcaggcccgacgacgacgacgatgaccgctactgactagtttcgttgcacatggtgttttatatgcttcgtaactacatccagtctgttgttgggtaatcggtatgacaaaaaatagcggaaaattaatt

SEQ ID NO: 417 - DNA, 3247 bp, Zea mays
cccattctctcacacccaacacccagctatcacaccctgatccccgaggccgcgcgtcggggtgaggaggaggggccatgatggagtcggcggcggcccagtcctgcgcggcgtgcggggacgacgcgcgcgctgcctgccgcgcgtgcagctacgcgctctgcagggcgtgcctcgacgaggacgccgccgagggccgcaccacatgcgcgcgctgcggaggggactacgccgctatcaacccagcgcgcgccagcgagggaaccgaggcggaggaggaggtggtggagaaccaccacaccgccggtggcctgcgtgagagggtcaccatgggcagccacctcaatgatcgccaggatgaagtaagccacgccaggaccatgagcagcttgtcgggaattggtagtgaattgaatgatgaatctggtaagcccatctggaagaacagggtggagagttggaaggaaaagaagaatgagaagaaagcctcggccaaaaagactgcagctaaagcacagcctccgcctgtcgaagaacagatcatggatgaaaaagacttgacagatgcatatgagccactctcccgggtcatcccaatatcaaagaacaagctcacaccttacagagcagtgatcattatgcggttaattgttcttgggctcttctttcactaccgtatcaccaatcctgttaacagtgcctttggtctctggatgacatcagttatatgtgagatctggtttggtttctcctggatattggatcaattcccgaagtggtatcctatcaatcgtgagacttatgttgataggctgattgcacgatatggagatggtgaagaatctgggttagcacctgtagatttctttgtcagtacagtggatccattgaaagagcctccactaatcactgcaaacactgtgctgtctattcttgctgtggactatcccgttgagaagatctcatgctatgtatctgatgatggttctgctatgctcacatttgaatcgctcgcagagactgcagaatatgctagaaagtgggtgccgttttgcaagaagtacgccattgagccacgagctcctgagttctacttctcacagaaaattgactacttgaaggacaagatacacccatcttttgtcaaggagcgtagggctatgaagagagactatgaagagtacaaggtgaggataaatgctttggttgccaaggctcaaaagacacctgatgaaggctggatcatgcaagacggtacaccatggcctgggaacaatcctcgtgaccaccctggcatgatccaggttttcctgggtgagactggtgcacgggactttgatggaaatgaacttcctcggttagtgtatgtgtcaagagagaaaagaccaggctaccaacaccacaagaaggcaggggctatgaatgctctggtccgagtgtctgctgttctgacaaatgccccttacattcttaatcttgattgtgatcactatgttaacaacagcaaagctgttcgtgaagcaatgtgcttcatgatggaccctactgttggcagagatgtctgctatgtacaattcccccagaggttcgatggcattgatcgcagtgatcgatatgccaataggaacgttgtgttctttgatgttaatatgaaaggacttgatggcctccaaggcccagtttatgtgggaactggttgttgtttcaataggcaagcactttatggttatgggcctccatctctgcccgcacttccaaagtcttcgatttgttcctggtgttgctgctgctgtcccaagaaaaaggttgaaagaagtgagagggaaatcaacagagactctcggcgagaagacctcgagtctgccatttttaaccttcgcgaaattgacaactacgatgagtacgagaggtccatgctcatctctcagatgagcttcgagaagtcttttgggctgtcctcggtctttattgaatcgacccttatggagaatgggggcgtccctgaatctgcaaacccatctaccctaattaaagaagccattcatgtcattagctgtggatatgaagagaaaactgaatggggaaaagagattggctggatctatggttcagttacagaggatattctgactgggtttaagatgcactgccgtggctggagatccatctactgcatgccggtgagacctgcattcaagggatcagccccaatcaatctttccgatcgtcttcaccaagttctccggtgggctcttggttctgtcgagatcttcttcagtcggcactgcccgctgtggtacggttacggtggcggccgtctgaaatggctccagaggctctcctacatcaacaccatcgtgtacccgttcacttctcttcctctcgttgcctactgttgcctgcctgccatttgcctgctcacaggaaagttcattatacctacgctgtccaacgctgcaacgatatggtttcttggcctcttcatgtccatcatcgtgacgagcgtgttggagctgcggtggagtggcatcgggatcgaggactggtggcgcaacgagcagttctgggtcatcggaggcgtgtccgcgcacctgttcgccgtgttccagggtatcctcaagatgattgccgggctggacaccaacttcacggtcacggcaaaggccacggacgacactgagttcggggagctgtacctgttcaagtggacgacggtgctgatcccgcccacaagcatcctggtgctgaacctggtgggcgtggtggctgggttctcggccgcgctcaacagcggctacgagtcctggggcccgctcttcggtaaggtgttcttcgccatgtgggtgatcatgcacctgtacccgttcctcaagggtctcatgggccgccagaaccgcacgccgaccatcgtggtgctctggtccgtcctcctcgcctccgtcttctccctcctgtgggtcaagatcgacccattcgttggaggaaccgagaccgtcaacaccaacaactgcaacacgatcatctgctgattcaccatcggtcagctgctgtcgtgccgcggcggacgtgtttctggtgttgcaaacgtgggttgcctgcctgatgcgggtctcctctgtctatctcgcatctgggcttttgccccaggatctgaagcgggtggtgtaggttagctttattttgcgtccaagtgttgattgatgttgtctgtgttatgaaaagttttggtggtgaaacctgaaatgtt

SEQ ID NO: 418 - DNA, 3860 bp, Zea mays
gaattcggctcgaggcagcagcaccaccactgcgcggcattgcagcgagcgagcgggagggatctggggcatggtggcggtcgctgccgctgccgctcggatctagagggccgcacggtatccgccggcctcgtcggtgtcggtgtcggtgtcggtggagtgtgaatcggtgtctgtaggaggagcgcgaagatggcggccaacaaggggatggtggcaggctctcacaaccgcaacgagttcgtcatgatccgccacgacggcgacgcgcctgtcccggctaagcccacgaagagtgcgaatgggcaggtctgccagatttgtggcgacactgttggcgtttcagccactggtgatgtctttgttgcctgcaatgagtgtgccttccctgtctgccgcccttgctatgagtacgagcgcaaggaagggaaccaatgctgccctcagtgcaagactagatacaagagacagaaaggtagccctcgagttcatggtgatgatgaggaggaagatgttgatgacctggacaatgaattcaactataagcaaggcaatgggaagggcccagagtggcagcttcaaggagatgacgctgatctgtcttcatctgctcgccatgacccacaccatcggattccacgccttacaagtggacaacagatatctggagagatccctgatgcatcccctgaccgtcattctatccgcagtccaacatcgagctatgttgatccaagcgttccagttcctgtgaggattgtggacccctcgaaggacttgaattcctatgggcttaatagtgttgactggaaggaaagagttgagagctggagggttaaacaggacaaaaatatgttgcaagtgactaataaatatccagaggctagaggagacatggaggggactggctcaaatggagaagatatgcaaatggttgatgatgcacgcctacctttgagccgcattgtgccaatttcctcaaaccagctcaacctttaccggatagtaatcattctccgtcttatcatcctgtgcttcttcttccaatatcgtatcagtcatccagtgcgtaatgcttatggattgtggctagtatctgttatctgtgaggtctggtttgccttgtcctggcttctagatcagttcccaaaatggtatccaatcaaccgtgagacatatctcgacaggcttgcattgaggtatgatagagagggagagccatcacagctggctcccattgatgtctttgtcagtacagtggatccattgaaggaacctccactgatcacagccaacactgttttgtccattcttgctgtggattaccctgttgacaaagtgtcatgctatgtttctgatgatggctcagctatgctgacttttgagtctctctctgaaactgccgaatttgctagaaagtgggttcccttttgtaagaagcacaatattgaaccaagagctccagaattttactttgctcaaaaaatagattacctgaaggacaaaattcaaccttcatttgttaaggaaagacgagcaatgaagagagagtatgaagaattcaaaataagaatcaatgcccttgttgccaaagcacagaaagtgcctgaagaggggtggaccatggctgatggaactgcttggcctgggaataaccctagggaccatcctggcatgattcaggtgttcttggggcacagtggtgggcttgacactgatggaaatgaattaccacgtcttgtctatgtctctcgtgaaaagagaccaggctttcagcatcacaagaaggctggtgcaatgaatgcactgattcgtgtatctgctgtgctgacaaatggtgcctatcttctcaatgtggattgtgaccattacttcaatagcagcaaagctcttagagaagcaatgtgcttcatgatggatccagctctaggaaggaaaacttgttatgtacaatttccacaaagatttgatggcattgacttgcacgatcgatatgctaataggaacatagtcttctttgatatcaacatgaaaggtctagatggcattcagggtccagtctatgtgggaacaggatgctgtttcaataggcaggctttgtatggatatgatcctgttttgactgaagctgatctggaacctaacattgttgttaagagctgctgtggtagaaggaagagaaagaacaagagttatatggatagtcaaagccgtattatgaagagaacagaatcttcagctcccatctttaacatggaagacatcgaggagggtattgaaggttatgaggatgaaaggtcagtgcttatgtcccagaggaaattggagaaacgctttggtcagtctccaatcttcattgcatccacctttatgactcaaggtggcataccaccttcaacaaacccagcttctctactgaaggaagctatccatgttatcagctgtgggtacgaggacaaaactgaatggggaaaagagattggctggatctatggttcagttacagaggatattctgactgggtttaaaatgcatgcaagaggctggcaatcaatctactgcatgccaccacgaccttgtttcaagggttctgcaccaatcaatctttctgatcgtcttaatcaggtgctccgttgggctcttgggtcagtggaaattctgcttagcagacattgtcctatatggtatggctacaatgggcgattgaagcttttggagaggctggcttacattaacaccattgtttatccaatcacatctgttccgcttatcgcctattgtgtgcttcctgctatctgtcttcttaccaataaatttatcattcctgagattagtaattatgctggaatgttcttcattcttctttttgcctccattttcgcaactggtatattggagctcagatggagtggtgttggcattgaagattggtggagaaatgagcagttttgggttattggtggcacctctgcccatctcttcgcggtgttccagggtctgctgaaagtgttggctgggattgataccaacttcacagttacctcaaaggcatctgatgaggatggcgactttgctgagctatatgtgttcaagtggaccagtttgctcatccctccgaccactgttcttgtcattaacctggtcggaatggtggcaggaatttcgtatgccattaacagcggctaccaatcctggggtccgctctttggaaagctgttcttctcgatctgggtgatcctccatctctaccccttcctcaagggtctcatgggcaggcagaaccgcacgccaacaatcgtcatcgtttggtccatcctccttgcgtctatcttctccttgctgtgggtgaagatcgatcctttcatctccccgacacagaaagctgccgccttggggcaatgtggtgtgaactgctgatccagattgtgactcttatctgaagaggctcagccaaagatctgccccctcgtgtaaatacctgagggggctagatgggaattttttgttgtagatgaggatggatctgcatccaagttatgcctctgtttattagcttcttcggtgccggtgctgctgcagacaatcatggagcctttctaccttgcttgtagtgctggccagcagcgtaaattgtgaattctgcatttttttatacgtggtgtttattgttttagagtaaattatcatttgtttgaggtaactattcacacgaactatatggcaatgctgttatttatacgcaaagactgatacattcttcggattgtgagcaaacagtcagaacactgtaatctcttaggacaactatataaggcagctgttgtatcatctctaaaaaaaaaaaaaaaaagggcggccgc

SEQ ID NO: 419 - DNA, 1268 bp, Zea mays
attcggctcgagcaacagtgtgcgtcttgtgccgcaggggcgtgggccttcttcctcctcttccggcactccactgctccgtctcccggcctctcgcctctcggcctctccatcgttcgacctcgcgacgcgtcaagtaggggggcggcggccttcgcggagatgaccaccttcctgatcaccggaggcgatttcccgcgacactcctcccccctccccgtgctctgctagacagatagatccgggctcttccttgatttgttcggtgaggacatcatgtggagttttgcatcaaatgccatagctggaagcttaaagaaaaaagcacaaccctcaaaatgcagcatatccaatgcagattattctgatgatgaagtttcttcatgtacaagcagagaggaaggccttgattgtccaatatgctgggaatccttcaacctcgtggagaatgttccctatgtcttgtggtgtggccacacaatgtgcaaaaactgcatccttggtcttcactgggcagttgtcaagttcccgtcccttcctatccagctgcctttgttcatctcatgcccctggtgcaacctgctgtctttccgcctggtttacaagggcaacctcaggttcccacgcaagaactactttctgctctggatggtcgagagcatgaacggtgggagagcaaaattccattccactaaccatgacgagcatcattccacgtggcattcaagtgccggcacaagctccagccatcaacagcgaagaaatgctgctgtaggatcagagagctcttctggcagagagacaggcgtaggccgcaacattttccacaccgacaacattagtgcttctctgcaaaagcttatggtgtgcttcatgcagctgacggccaagttcccactcgtgataatctttctgctgatagtcctttatgctgtccctgcaagtgctgctgttctggttctctacgcccttgtcacgtttttgtttgcactgccctcatttttgatcctctactttgcctaccccagcttggattggcttgtcagagagatcttcgcttaattcgtgctgtctgaaatgtccgcgcagtttgtatccctgcgacaaatgatatatatcggtatatgtattccatgggccacctgccctcgtaggccctgtatagtttcttcttattctctgtccttgtagcactctatttctgttgtaactaacagcttattaaaaatgctctgcaatgcttttatttgcaaaaaaaaaaaaaaagg

SEQ ID NO: 420 - DNA, 1159 bp, Zea mays
tggcgtccgcccaaccctccaaaccaaggcggccaagccccttccatttgccaggcggccacaccatctgatccccaattcgtttccacctatcgagccaaggtgcgacgacggcggtcgcagcgtcccctccctccctccgtaccgctgccgccggtctaccaaacggtgaaatatttacgtaagcgaatcagggtcttgaagatagcttccagatatgtggggttttgcatcaaatgcttgggcatccgggctggggaagaggagtcccccaaattgcacctcttcgagtgctgcttgttccgatgacgaagcatcctcgtgcacgagcagggaagaaggcctggaatgcccaatatgttgggagtctttcaatatagtggagaatgtgccttacgtgctatggtgcggccacaccctttgcaagaactgcgtcctaggacttcaatgggccgtcatcaaagttccaactgtgccgatgcagctacccttcttcgtttgctgtccctggtgcaacctcctgtcgcttcgcatactttacaaagggaacctcacgttcccacggaagaattatttcctcctctggatggttgaggggatgaatggtgagcgggccagatcacgcccagctactcacagcgagcaacatactccatggctctcaagcagcagcagagcaaatggaaatgcaggctgttcaaatcccacaagacgccaccttccgctgccaccgccggttgacactacttcgcccaccaatgcaaatcatgccaaccatggggtccctgtccctctgctgaacgcagagagagtacaagcttcgctgcgcaagtccttgtcgttcctggttcacctgaccgccaagtttcccctggtgttcatcttcctcctcatagtgctctatgcgatccctgccagcgcagcagtcttgctactgtacatccttatcacggtgctgttcgcgctcccctcgttcctgatactgtatttcgcgtatccgagcctggactggcttgttagggaaatctttgcctgagatttccttgttcggtaaaatctcaatactgttgttgagtccttgtataactgaaccttccctagatcttgttgcaagcgtggatgctattgcaaagttttggtttttacaccaaaaaaaaaa

SEQ ID NO: 421 - DNA, 1115 bp, Zea mays
ccacgcgtccgcaccgagtggcgaccgcctgacgcgcccgtgtcggcaagccgccgacgacttgacgtggggcgggggaaacaaaacaacgcgggcagcgccacggcaagcgcgtccctgccacggcgcggacacagagagtggaaaccggaaggggggaagagagatggattcctccacctcggcggcggcggcaggggaggcggccgtgccgccggaggacgacgtctgctccgtctgccacgaccgcttccggatcccgtgccaggcgaactgctcccattggttctgtggagagtgcatcatccgcgtttggaattatggacctcctgtacaggcttgcaagtgtcccatttgtcgccgccttataaatctactggtgcctgctgcattatcagggcaggaggatggtccacaagctcaacgtattctaggagagattcagcactataactgtatatttggtggagcaccacgcagcctaactcagaggttgcaagacctacccttcttcatccgaagactgttcagagaactaatggacccccagcggaccctcccactcgtgttcagggcgcggatgctgatgatggtcgcactgagtgcaatttatgtgctgagccctgtcgacattcttcccgaaagcatgctgggcctctttggattcgtcgatgacctgctcatcctgctcatcgtgttcctccacctcgccgcggtgtaccggtcgttgctcctgtaccgccacgggggccagtagaagtcgctgcgcataaaccgtttgtttagctggtttccatgtggagttctctgagatcgcagcagcggatttggaagatcgccgactcgccgagtagatggcaacgtcacggacggcttagcctgtccctgctctgtaccattctactacgcctgtttttctgagactctgacacggtgaactgaactttggttggttgatgcaagtgaatttcccttcgttttactcgtcaggaaaagaaagggaaagagtttgcgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagg

SEQ ID NO: 422 - DNA, 964 bp, Zea mays
tttcctcacaacctcacccggctccatccacgcggctccaacgccagccacagcacgagccatggactcgcgcgtcgtggacggcgcaggtgggggtgccgacgcctccttgccggccgatccgccgagccccgtgcccgatccggccgcgggcgggatggatgcgcgcctcccatcggacctgcttcgtgcagtgctgcaaaggctgccgccgatcgacctcgcgcggtccgcctgcgtctgccgagcgtggcgcgcggttgcctccgaccgcgccgtggtcgaggccgccttctgtgcgccctggggagtgcggcgcgtcgtcggagagccggcgacgggggccttctggcgggccgcctcccttgggagatttgcgctgtcgcatgcgatccgccgcggggataccgtccccggtgtcgctctcaagtactccgtgcaggtgaccgatatcaaacgattcaacaacatgatgagtgaccatggcatctattcgagggagaggcttctggttccgatcagcaacccagaaatccttcttggcagcacctgctacatcgagatggaccataacgctaagagagaggttgcaatcttttaccccgagggacgcccaggtggcaaaactgactctgtggcaagcattgtctctgcggagaggagaaacaaaaggattctcgagtcggtgaggcggagcctgcacgtcgatgatggcactgctgcgtactacttatctgttactgagggtgatccgagggctgccatgacggagtactccgaggacctgaggtgggagcagcaacgcgcaggtcggtagattcatatatattccaatgacatatgttaagatcatggtgcttgatccttatcatttggtgtatatattgtacaatctggatggttgtaagtataaatacaaactttggtctaatgaatatagatgcatgtacgtgataataaaaaa

SEQ ID NO: 423 - DNA, 1651 bp, Zea mays
cacattcctccctcagtccctcttccccccgtttcatcccttcacacccacagcccacctggtctgtcatcccctttgctacgctccccttgccctgtcccctcgccgcccgcgcccgtggagttcttcgatcgagtcctcggagcccggagcacctggtgcaacaatccggacccgcgcgaggaagggcggagagagagccgaatctgagcctcggcacaagttgggcacccgtcaagattctcggcccgatctgctgcggaacatggagctggacagcatcgagtgcatgtcctactccgacagcatgggggacgacgacaccgacgccgtcacctcgtcccagctccctcgccccttcctcaaatcctcctccaccgccggtactgccgccgtcaacgtggtcgtcgtctccgaccgcgtcggtgccgccgggccggtagcgggagcgggttcgctggtgatttcgccagccacgggcgtgcacgagctgctcgagtgccccgtctgcaccaattccatgtacccgcctatccaccagtgccaaaatggtcatactctatgttccacctgcaaaactcgggtgcacaaccgctgcccaacttgtcgacaagagctaggtgacatcaggtgtctggcattagagaaggtggctgaatcacttgagctcccctgcaaatactactctcttggatgttcagaagtcttcccatactacagcaaactcaagcatgaatcacagtgtaattttaggccatacaactgcccttatgctggttctgaatgctcagttgttggggatatttcttttcttgtggcacatctgcgagatgatcataaagtggacatgcactctggatgtacatttaatcaccgctatgtcaagtccaatccaagagaggttgaaaatgcaacttggatgctaactgtttttcattgttttgggcagtacttttgcttgcactttgaggcatttcagcttggaatggcaccagtatacatggctttcctccggtttatgggcgatgaaaatgatgctaggaactacagctatagccttgaggttggtgcaaatggcaggaagatgatatgggagggaactccccgcagcatccgggacagccaccggaaggttagggacagccatgatggtctaataattcagcgcaacatggctctcttcttctcaggtggagaaaggaaagagctgaaactgcgagtcacaggccgtatctggaaggagcagcagaatcctgactcaggagcctgcattcccaatttgttcagctgagctcagtaacaagaggatggatccaggtgtatattgatacggccgatgtgtttgtgtgagcgtgtgcctgtgctttgcgttttgtcctgccaagctgccattgcagcccgccctaaattagtcagggcgtatttactgttggcaggataatgaaaatactggcttactccttttgtgggctgtgactaagctcccatgaatctcacgataagcatttttctcgatccaatggtgtatactgtatcgttttgggctgaaggctgcagctttttttgctgttatgtttgtctcggtgtatttgtgtgtctgcaaataaagtattgaacagtaactgggtaccttgcataaggtttggttggc

SEQ ID NO: 424 - DNA, 1596 bp, Zea mays
ctcgcgattactactgtaatccccaccacaccacctcccggatctcagggtgggtggagtgcttcttggcgacctttctttgcatgtcaacgcagacaaaaagaacagcgccgccgcctccacgaccacgaccacgccggtcgccgagcctccgtctcctcccgagagatctcgcagccagctagccgccgtacgtggccacatggaggcgccgcggccaaacaacggcaggaagcgcaagcccacgcctcccgccggcctgggggccctccacgacgacttgctcgagcgggtcctcgcgcgcctcccgccggccacctacttccgcctgcgcgccgtctgcagccgctggcgcgccgccgcggcgtccccgaccttcctccacgcctgcgctcgcgtcccctcccgggacccatggttcctcatgctctccgactccgactccgggccccgcccgcccgtcgccttcgacgccgccggccgcagctggaaccgctgccacgccgcgccgggggctgccgtgcccgtggccgcgtcggccggcctcgtcctctaccgcgcgccggccacgggcgcgctcaccgtcgccaacccgctgacaggcgcgtcccgcgcgctcccctcgccgccgcagcaggccgcgcgccagctgcaggccatcgccatgtacggcgccggcggtccctaccgcgtggccctcttcgcgggcgacctccccgacgacctctccatggcggtctacgactcctccagcaactcgtgggaggggcccctgccgctcgcccgcaagcccggggacgactcctgccccgacgcgccggcgcccgacgacacggtctacttcctcagcaagtccggggacgtcgtggccaccaacatgcagcgcagcgcgtctaagcagtactcctcctcagtggtcgtgcgccgcgacggcgacggcgacgccgcctttgcctacttcctcagctactcgggcacagtcgtcgcctgcgacacggcgcgccgcaccttcgcggagctgccccgcatcctccccgtctacttcgagtactccatcgacgtcgtcgcgtgcggcgcagcggcctacgccgtcgtgctttcggaatacctcggcacggccagcctgcgcgtctgggagttcgccgggggcgcgtggcggcaggtggccgccatgccgcccgccatgtcgcacggattccacggcacgcggcccgatatcaactgcgtcggccacggcgaccgcctcatggtttgcgtcacctccgccgaggccaacgcctgcttcatgtgcgacgtggccagcaaccagtgggaggagctgcccaagtacgtcaatgccgacggcgaggccagcgagttcctggccgccttctccttcgagcccagagtggaggtcaccgtataagcgcttatggttatagtgttactacaattaattgctttcttcattaaggcgccatagttttggttcggctcctactccgtgtgattgatttcttcgtgtgtgtgtgcatgtacttacggtaccgaattgtaatgtcatttttcattgacattatttgtcttcaataaaattgcagatttcgtgtgcagtcc

SEQ ID NO: 425 - DNA, 1348 bp, Zea mays
caactcccgagggcccatttcgccgtctttcactccatcaccccctctcccccagtcccccgtccctttcccctcagccatctccttccccctcacctcgccatggcgttcttctctcaccaccatctccagcagccacacccgcagcaggcaccgcccccgaatcagcagcagccggtgcttccttccttcaggaacgcgctaccggtgcctgtggatggccagatcccagcgcccctcaccttcttcaacccgccgcctgccttcccggagcagcccgcgcagacaacgctggtggatgcggtggggctgacggcagctgctgggcttgggtggaggcagccgagggagcaggaactgcttggagaaaactcccagatgtcgtccatcgattttctgcagacgggctcggcggtatcgacggggctggcgctgtctctggaggaccggcgccacggcggcggcggggctgggaactcctccggcgattcaccgctgctcctgctgcccatgctggacgatgacatttcacgcgaggtccagcggcttgacgctgatatggaccgcttcattaaagctcagagtgaacggctgaggcaatctatactggagaaagttcaggcaaagcaatttgaggcactggcctcagttgaggacaagatattcagaaaaatacgggataaagaggcggaagtggaaaccatcaacaaaaggaactctgaactagaggaccagattaagcatttgggagtggaagttggtgcttggcagcaaagggccaagtacaatgagagcctgatcaatgcactcaagtacaacttggaacaagtatgtgctcaccagagcaaggacttcaaggaaggctgcggtgatagcgaggtagatgacacggcgtcctgtccctatggtggtgctgtcaatttgcaactgatgccaaaggagaacagacaaccgaagaatttaacggcttgcagggtctgtaaatcaagtgaggcatgcatgctcttgctgccgtgtcggcatctttgtctatgcaaggagtgcgagagcaagctgagcatctgccccctgtgccagtcctccaagatacttggcatggagatatattatgcatagaatataatttatgtatcacattagtatcgtacgagatactgctatgttaatacgtcaatctattgccgaagttcagaacctatgtaccactattgacttgccactggatcaaaaaaagactgccgtttatggtagatttaacgcagcaaatttctttgcgaaaaaaaaaaaaaaaaaaaaaaaaaaaaaaaaaaaaaaaaaaaaaaaaaaaaaaaaaaaaaaaaaaaaaaaa

SEQ ID NO: 426 - DNA, 1403 bp, Zea mays
ctgcactgcacggtagtcgcgtcgagtcgacgcgcgattcctgccatttgggtgggccagcctttcctggcaatctcggggggcgtttcgcctcgctgcgtggcagaaaggtgtgacgtgtgatgcatcccaaggctcgaatccacgccgacccggtgcgcgaggtcgaccacttcgactgcctgccggattcgctcgtcctgctcatcctgaacaaggtcgaggacgtgcggtcgctcggccggtgctacgccgtgtccaagcggctctgtgggctcgtttccctcgtccatgatgtgtatgtcaagattgaccgcgtcgttgcggtcgacggcgacgccgagggcacgctcaacctgtcctcgccgaagcctcggagcatcttctcgcacttcctgaggctgatgctcttcacaatcatcaagccgttccacaacatgcgcagccctaatggtactgcgaggccattgttcccgcagctctcgcagcactcaccggcacaggtgctcaggaacttcacgcacgtcaggaaccttcggatcgagctcccctctggggatgtgggtactgaggagggagttctcctgaaatggcgagcagagtatgggagcacacttgagaattgtgtgatcctggggggtacccgggttgaccgcaagcctgttggtggagagcatgagccagctttggaggacaatggaagcatgccagagtctttctataccaatggtgggctgaaacttcgtgtcgtctggacaatcagctctctaatcgcggcatcaacaaggcactatcttctccgctcaatcatcaatggccatcccacactacagagcttggtactgacagatgctgatggccaaggcacattgtgcatgggggcaaagcagctggaggagttcagagagaaccagttgtcggcctcggcatgttccaacaggactcaggtcccagcctgcaacatgaagctcaagtacgctccatatgttgaactgcctggtggtatggcgttgcaaggcgctactttggtggctatcaaaccctcacctgagggaagcaatggaagccaccctaaccgcaaggaagccgaaggattcgtctttggagcattcgatgggccatttaaagctgctgtgaagacgctgatgaagagacgcacttaccttctggagatgaatggcttctaggaatcttgtccatcttggtatcgagcttgttggtgctatgcatggtacatttagctgagtgtctcatctgtgtaatattcaagaaggcaccatctctagttgatgcttgctgtctgctgttttagctctttgtacagtgttaacatttggttatataaagatcatatcaagtcctctagtgtaatagtgaatcttatctctctacagttcaccttc

SEQ ID NO: 427 - DNA, 944 bp, Zea mays
cacccgtttccgggaggagagagagggcgggggcgaaggggatggcaaagcgccggcgccacgagttggcgccggtcgtggaggagctgatttcgccgatgaacagcctggacgacggctgcctcatgcacatcttcagcttcctgagcccaatcccagataggtataacaccgccctcgtttgccacagatggcgcttccttgcatgccaccctcggctatggctgcgtgtcgagaggccaatcagagatgcgatggagcctggagtttatccagatctcgaggctgctgtttctgctgctaggccgggtgacaccattcttattgcggctggtggttcccatgttgcatgtaacatccaaataaagaagcctatttgcataattggcgggggcgatcttcctgatgacactgtattgacctgctcacgtggtttcgacaacgcactggagtttctatcaacatgcaagattgcaaatctgactattagagcagaactcggatgctgcttgctgcatcgaggcggtagattgaccatccaggagtgtctgctgcagtgcgagcaaaaccctttggaccacctgtccttcccaataatcagcacagcgatagagtacgatccattctcatccctcaaggagcaagggcacggagtaacggtcgtccgcaccaggatcgaaggaggcgcgagggccgtcaggacgaacggcacactcgcgctgcgccatgtgcgggccatctattcccgcagctctgttttcttctggttcgaagtaggagagaaagtagaagcgcctgtacactagcaaaaaaacccgtgttcgttcttgtatgtcagtgttggtatcaccctagcgtgcgtttggtgaactcggacggctgcctcgtgtctgttgtgatctctttataattataataccccactgatgtttgaaccaaaaaaa

SEQ ID NO: 428 - DNA, 1716 bp, Zea mays
ccagactagcagatagagaggcggagccgcggaggccagcatatctccctcgttttggtttgcgcccaagcaagcgcctcacgcgagcaccgccgctgccgccgttcactttccccctgaacaccagccgccgccgccgccgccgccgtcgccgccgcatgcacgcacgctgcctctgcacgagcggcaagcggcgatccggcgatcctcgtcgatccccgccctaacgcgctgcggtggtccgtgcagacaagatgaagttcggcgccacatatgaggagtatctccgggcagagcgggacaaattcctagggcaatgctcccatgtagaatacaaacgcctcaaaaaggtattgaagaaatgtagagttggtcgctcactgcaagcagatggcacaaatggtgatgagcagcaggaggggagagacgaatcttcaaacatttgtgaatgcaactcatgcacattgtgtgatgagatgttctttacagaactcaacaaggaagcatcagaaatagcaggttgtttcagatctagagtacaacgtctcctccatcttcatgttccttcaggactacaacgctgtatatggcgttttaggcagtgtttcatagatgatcagcaaataatggttcaagaaggcagaatgcttctcaattatgtgaccatgaatgctattgctattcgcaaaattctcaagaaatatgacaagatacatggttctgtgagtggcagagatttcaagagcaagatgcaaactgagcatattgaactgttgcagtcaccttggctgatagagcttgctgctttccatcttaactgcgatgattcagatgctgatgaacctagagctggagagttcttcaagaatggattcttcaagaatttttcctgtgacctgagtggagcacagccactactaacaatgaccatttctgaaactctgaagtatgagtacagcctaacttgtccaatttgcttggacactttgttcaacccttatgcgcttagctgtgggcatctgttctgcaaagcctgtgcatgtggtgctgcttctgtctacatcttccagggtgtcaagtcggcacctccggaggccaagtgccctgtctgccgagcggttggtgtgtttgatcgtgctgtgcgtatgactgaactagaattgctcctcaagagaagggacaaagattactttctgcagagactgcgcgaagagcgaagtgtgatggtgaagcaggccaaagaatactgggactcacaggcaatgctatcgatggggatttgaaagctacaatgttcttaccagttcaattgttgtggctaattacatctgaaggttctctggctaattacatattttagttcctggcaagcgtcaatcaattaagttaactgcgctcacataacagaaattgacatagcagaagctgagcccatcgaagaagcaaacaaaatcagttgcattctatcattctccgcctgattcagatttggaagaatcgaacggatttaactaatttctttgttccttccgttctactacaagcttgaaatgacgaaactcatattgtatttacatatctactgattattgggttatttaccctatttactgattgttggtgtgttatttgcctgtaaaagtgaagtcaaatgttgtccagctgccctgaacctcttaagaccatctccaaagttcaacccccaaaaaaaaaaaa

SEQ ID NO: 429 - DNA, 1583 bp, Zea mays; identical to SEQ ID NO: 168

SEQ ID NO: 430 - DNA, 1130 bp, Zea mays
ccagtctaagccaccacccaggcccagctcacctctttcctctcttctcatgcccacgcgctcgcccatctcatagtccttccccattccgcctctctagctggcctgtcgaggaccctcgccatcctccccaggcgcaccaccaaacggtccaaacccccagcggcggcgctaggatttgagtctcagcgcgccggcaccgccaccgccaccggcggtgatggcagggcaggagcgtaggacaatcgatctggaggagggatgggcgtttatgcagaagggtatcaccaagctgaagaacatcctcgagggcaagcccgagcctcagttcagctccgaggactacatgatgctctacacgacgatatacaacatgtgcacgcagaagccgccgcacgactactcgcagcagctctacgacaagtatcgggagtcgttcgaggagtatatcacctccatggtactaccttcgctaagggagaaacatgatgagtttatgctgagggagctagtgcaaaggtggtcaaaccataaagtcatggttcgttggctctcgcgtttctttcattaccttgaccggtacttcatatcaaggaggtcacttaccccacttaaagaagttggtcttacttgcttccgagagttgatatatcaagagattaaagggcaagttaaagatgcggtgatagctctgatagacaaagaacgcgagggtgaacagattgaccggggtctgttgaagaatgtattggatatttttgttgaaattgggctgggtcaaatggagtgttatgagaatgactttgaagatttcttgctcaaggatactacagagtactactctgtcaaggctcaaagctggattcttgaggtgcgttatggtgatttgcgtgcttatgggtcctgccacagcaagggctgctcgcatttgtaaattggccgttaaaatagacaatcttgacctgcattagatgatatgatgatgatatgaggaataggagaggcactcaagtacttgtttgccatctatgccaatgttttacctatatgtctgtatcaatgtttcagttaactgagatgagattatgcttgggggttgctttgctaaaaaaaaaaaaaaaaaaaaaaaa

SEQ ID NO: 431 - DNA, 1328 bp, Zea mays
ccacgcgtccggttttgctgctgattagacaaatggagcatagcaacacacaatctggagctgctaaggtttctattttaatgattggccaacaagctatcatggatgcatatctctgtctacttcacctgactgctgggatattggttgagtcactcttcaatgccttcgcaacggctgcattcttcaaatttgttgtattttctatttttgaaatgaggtaccttctcgccatatggaaagcaagtaggcctttaaacagtggagaaggttgggagataatgaggcgagagctgtctgttctttacagccgcttttatggcattctgttgggaggaatccttctaatgtatgagctgcacaatttcttacgcccacttctcctcctgatgtactccttttgggtacctcaaattgtcacaaatgtcatcagggatacaagaaaacctctgcacccacaatatattttaggcatgacagttacacggcttgctattccattgtatatatttggttgccctagtaatttcatgcgtatcgagcccgacaagaaatggtccatagctgttacagtattcatgggtatccaagcagcagtgcttctgcttcagcactatcttggttctcgctgctttattcctcgccagatactgcctgagaaatactgctaccataggaaggtagaggacagcacaaatcagcccatcgattgtgttatttgcatgactacaatcgaccttacccaaagaacaagtgaatacatggtggcaccttgcgagcatatatttcactcaggctgtttacagcgttggatggacattaagatggagtgccctacttgccggcgctccctaccaccagcttagatgaggctttgtatcatatataatagtgaacaagaagtaggtagctcagcttatacaaggtgggggaactgatgtacaataaggtgaggctgcaatcgtgtgaaagctatgaacagaactgtagaaaagttttatactattgatttcaagaggtcttgtgttgtgcaaactagcgtatcaagcatcccacgaagaaatcgtccttccccgctcatgcggttatcactgttgcatgcctttgcctgctaccagtatttcggcccagcgttttggtctgagctttgtgcaaagtttgttaacgccgtgaaagagttcgagatgtgcattcttgatttggtggacacattagtagcgtgtttggtttgaggaatgagatctctctcactcacttttttgtttggtttgtggaatgaaatgaattaatctatcaccatttcatttaaaaaaaaaaaaaaaaaaaag

SEQ ID NO: 432 - DNA, 1824 bp, Zea mays
cagaaaaattcctcccaccgcgacggcgacgagcacggggaccctccaccgcctccgcctccgcctccgcctcgccgcgtgcggcctccgcaccgccccgacgtcgacccctccgccctccccctcggccaccgacgcggcgccgcccgccctccgccgccgccgccgccgcggcgggctcggtctcctctggaagctcccctacggccgcgcgccgtcccgcccgatggacgcgctgccgcctctgcagcgcgccacgtcgccgccgccccagccccggccccagccgcccgtgccgtccaggaggtacggcgtgcacttctcggcgtccagcttcatccaggcgccgctcaccacgctgctcgagtactccggcatcctccgccccgatccaggcggcggaacccagcaggatggggccggggctgggccgggcgaggtgtcgatccggattgtggcgcccggcgaggcggggacgtcgtctgagaggcccgaggaggtgatcgtggaggaggaggaagaggatggacacgcaacgagaacgcgcccggaggacccgtcacctgcggctggtggcggggagggcggcagggaatcctcctcatcgtaccagcggtacgacatacagcaggtggccaggtgggtggagcagatactgccattctcactgctgctgctcgtcgtcttcatccgacaacatttgcaaggtttctttgtgacaatttggattgctgcggtgatgttcaagtccaatgatatcctgcgtaagcagactgctctgaagagggagagaaaaattccagttcttgtcgggattacaatattatttgttgttcacgtatctgggttttattggtgttacaagaacggggaccttataagacctctcatgatgcttcctccaaaagaaataccaccattttggcacgcaatattcatcatcttggtgaatgatacaatggtgcgccaaactgctatggttgtcaaatgtttgctgctgatgtactacaagaacagcagaggccgtagctatcgtaggcagggtcagatgctgacgattgtggaatattttctacttttgtaccgcgcattattgcctacacctgtgtggtaccgttttttcctgaacaaggagtatggaagcttattttcgtctctaaccactggcttgtatctcactttcaagttgacatcagtcgtggaaaaggttcaatcatttttgacggcattgagagcgttatctcataaagacttccattgtggctcatatgcaacaagcgagcaggtggctgttgctggagatttgtgcgcgatatgccaagagaagatgcacgttcccatccttttgcgctgcaaacatgtcttctgtgaagattgtgtgtccgaatggttcgagagggagcggacttgcccgctgtgcagggcactggtgaagccagcagacctccggtcgttcggtgacggttcaacaagcctcttcttccagctattctaatctgagagagccaaaagagctgggcaagctggggcgctccaccctgtgcagatgttaggtgtgtgtgtgtgtgtgagtgttgctgctggcaacgcgtgcgagcagtgcggccctgatgcggtgctgggagagtgtacaccgagctgaagctgaaggcgtacatggttttgtattgtgattgtgcatattttcatcccatgtataggcactcgcgggatgcttgagcacctgaggatttttacctgaccttatacgcacaaactactacgtaaatagaaatggtgagtatatacaatggttccggatgcgtcgataaaaaaaaacgttaa

SEQ ID NO: 433 - DNA, 1672 bp, Zea mays
gatcaaccgctcgaaattcgggggaagcaagcgagagcagcagtaagcctcatcgggaagtggagagatggaggcggcgggtcgcctcctcctcctcatcgtctcctccctcctcctgctcttctcgccggagcggccggcggaggccgcgccgccgcgaatccagccgctcgccaccgccgcgctgagccgcctctacgacacctccaactacggcaggctgcagctcaacaacggcctcgcgctcactccgcagatggggtggaacagctggaatttcttcgcctgcaacattaacgagacggtcatccgcgagacagctgatgcgctggtgtccacgggactggctgcgctgggctacaacttcgtaaatatcgatgattgctggtcatacgtgaaacgaggaaagcaggatcaattgctgcctgatccaaagactttcccttcaggcgtcaaagcacttgcagattatgtgcatggaaaaggtctgaaacttggtatatactctgatgctgggaaatttacttgccaagttcgacctggatcactcggtcatgaaaatgacgatgctgcgatctttgcttcatggggtattgattacctgaagtatgataactgctacaatttgggaataaagcctcagaaaagatatcctcctatgcgagatgctcttaattcaactgggcgccaaatattctactctttgtgtgaatggggccagtatgatccagccttatgggctggcaaagtgggcaatagttggcgtacaactgacgacataacggatacatggaaaagcatgacagacattgctgacaagaacaacaagtgggcatcatatgctggacctggtggttggaatgacccagatatgctggaagtaggcaatggtggcatgagcttagcagagtatcgctcacattttagcatatgggctctcatgaaggcccctctattaattggctgtgatgtcagaaacatgacttctgaaacaatggaaatactgagcaacaaagaagtaattcaagtaaaccaagatcctcttggagttcaaggaagaaaaattttaggacaaggaaaatatggatgccgtgaggtgtgggctggtcccttgtctgggaatcgtcttgttgttgctctgtggaaccgttgttcagatactgctaacgttacaatgaaactgccagcagtaggccttgatgggtatgctgcctattctgttagggatctgtggaagcatgaaactctatcggaaaatgtcgtaggaacttttggcgctcaagttgacgtgcatgacaccaagatgtacatcttttctcctgcaaccattgtcgcttcggtttgatcaggaccggtggatccaagatgacagcaccgctattgttcaaggatatgtcacgacaacaagcgccttcggttttcctgctgcattctgttccacccgactgcagaagtccacttcgtgcagaactgtctcagtgatgtttgtatttctcacggaatagctctatttatctcaagattgagcaagctcgcggcttactcggtgtaccggcgttgtatccttggggcatccaggatcttgtacgatttgaaacagtctgaaccaatgatgtaaaacaagatagtgaaaatacaacttcacaaattgcagccgtaaaaaaaaaaaaaa

SEQ ID NO: 434 - DNA, 1714 bp, Zea mays
ccacgcgtccgcgcctgcaactgcaacgctaccacctcgactcgcccctgctagcagcatccgggaagctgccctgccactgccaggctgccacaccgaggtgctcccttgactccctctcctctcctcttctcgcgcacgtggtctgtgcccgtacgcggcggcgctgccgctcaccagaccggccgccgccacgtctgcttccgcgcctccccgcctcctcaccgtccgcccccttttacctgcctgatcattttattataaatgtggggcgagagaactcatcataagcactggcatcaaggtcatggtacctcggggaattccaacaacaaaaagcatgataagcggcagccaaaatttataccagacaattatagctccgtcgatgaggttactactgctctgcgagaagctggcctcgaatcgtcaaatctaatcctcggtattgatttcaccaaaagcaatgagtggtcaggcaggcattcctttagaagaaaatctctgcatgccattaatggcaccccaaatccatatgaacaagctatctctataatcgggcgaacgctgtcaccttttgacgatgataacttgataccatgttttggatttggcgatgcttctacacatgatcattctgtgttcagtttctacccagagaaccgaccctgtcgtggctttgaggaggttcttgtaaggtatcgacagattgtaccacatttgaacctttcaggaccaacttcttttgcacctcttatttatgcagcgatttctgttgttgaaaacagtaattggcagtaccatgtcctcgtgatcatagctgatggacaggtgactgccgcgaatataaatgatggaagattaagtccacaggaacaagcaactatacaagcaattgtcgatgctagctactatcctctttcaatagtaatggttggggtgggtgatggaccatgggatgcgatgcagcattttgatgactgtatccctgaaagagcttttgacaattttcagtttgtgaacttcactggtattatgtcaacaagtaaggatatgtcaaagaaggaggctgcatttgcccttgcagctcttatggaaataccttctcagtataaagcaacgcaaggcctccgacctccagaaaagcaagcacaaaggattggctctcctaggattcttcctcctccaaataaagttcttgaaaatgataatgccgccgccgctgcttcgcaccctcctcaaactgcaagctcgaaatcaactggtattggcaaaagtgctgctgacgagcaggtatgccccatatgtctaaccaatccaaaggacatggcttttcagtgtggtcatctgacatgtaaggaatgtggcccaacactatcaacgtgcccattgtgccgcgctctaatcaccatgcgtgtgaggctctactcctaagtcggttggtgtctggagggatgggaccaaacagaaaggagcaagaactttggggcgcaaggactgcgctacgatcttgagatatggtccatatggatgtcatgataacgatgcatgtacagaaaccttgtccgtgcctattcagtaatgtcgttgatgagtatcttccatcaatcacatgtaaaatttctaatgttatcttgtattagtagcaggggattgcttgttgagtggaataccaccagttgttcagcaacaaaaaaaaaaaaaaaaaaaaaag

SEQ ID NO: 435 - DNA, 2191 bp, Zea mays
acgggcaattggtgcgccgtcttctccgtccgcggcggccatcttggtagcggcccgcatcccctcggccctccaaatcaacgaaccagcgcgtccccgctcctccccacgccacgggaaacttccagcaaaaggtcgcgccatcgataaggggagaaaaggagaagtgtcgccgtccccgtcagcgacggcgctggtaccgacggtccccgcgtcgtgtgccttcctcctccgcgagttcgacgacccgctgtgcgtctgctctcttccgcgcgcccaatcctcgtcgagtcgtcgtgccgctgattgacacagatgtgacagatctactttgttccttgctactttttggcatggtcactccctatttgccatcatcgcacaaccatcgccgaaggctgccaattctattgaaaataggatttttgttaatgatgggagaaaataaattgatgggcaaaagatgggaggacatggacactgatgtccttgtgaagatattcaaggaactaaatttggttgagttgtcaccggtatctcaagtttgtcgtttgtggcgcttggcctgttcagatccacttatttggggcactcttgactttggattgttaaaatccaattttattcagacaagagcatcaccatatatttgggttgatgataggtctgacaggagacttgcaagaatactacgggtggctatggcaattagctgtgggaacgtcaactgcatgatatttcattacaatttgttcatgaaagatgagcaccttcatttcatctcagaaagatctcctcatttaaaacggttggttatgccagcatggaaccgcatcaccaaagtgggaatatgtaatgctatccaaaggtggcaggcgctggagtccttgacaatgcctaccatcggacatcctccatatattatggaagagatagcaaggagctgcaagaatttcacagaacttaagatcatgggctcatttgatcaacaatttgcctcggcgattttgcagttccttccaaagctgaaagtgctgagccttcgttgctcgaaggtgtccatggatgcactgcaatgtttgctgaactcgatggagtatcttgaggttctgaatatttcacactgcctgctgttggttgtggcggcaaatgggcggaagcaagtggttcatgaactggacagccaaattctcgagagagcttcacggctgcgtgaattccactactgccaaagtaggttgtgcgtcgcgtgccagcggatggtggtggatgaaggcatcatgcgctggtacaggtacgaggattggttttggcgtcgggatgaggtgaggtcccttgatctgcaagattatgggaagctgtttgatgttggttgcgagaggttgacgtctgtggattagatgctaataataggggagcaaaacctgccctcctcagtctagaaacttgtttattggcattcataaaacatagcaagtgacgaggggtaacagtagattaataatatcgataacaatgtgcgtgaatggtgtgcgcgtgtttagctactgtaaatccatgaatagttcgtgttgtttggagaagtttgttatagccagtatggtgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaacaaaaaaataaaaaaacaaaaaaagaaaaaaaaaataaaataaattgacaaaaagtttgcccgcgcttttaatgggaaaaacccttcttgttacccaatttagaacatcttgcctttttttaccgtgttcccacaaaataaaaaatccgggccaaggcccccacccaacgactttgcaaaaacttggggagcctcaaaattaaattgtagcgccccatttacctttttataaagggggaggaatgagaagggtgccccccacaataccccttccccttagacgcggccccaagagccggggaagttgccccccctttctttcctttttaaaacatgtcggggggtttgccactcacgccggtaaccgcgggcttccttaagggccccaaacaccgcttttaggctctttctcccttaaaaccaagaagggggtggttcccccgacgggtataagcgggtttccctcg

SEQ ID NO: 436 - DNA, 1472 bp, Zea mays
tcatcaccgcaagcgtgcgcgcaacccagctcccaccgacgactgcaccggccgtcgctgccgcgctacttcggccccttttccggcgacgagcaccaccaggtagctgctaatggagattgacagcctcagagaaggatttgatcgagttgctgagaaacgttcattatcttctgctaaagctctggaagttgttgatcaaatagtgaatgaaattgagcaggctattgtgaagctgcagatgatgaatacagattctactggaaatgttgaccacccatccatccttgcagaactgaaagctaagctcaatgaaatggcaccactaaaccagcttgaaggcagccaaaaggagctcaatgttgctctgagcaaatatctcaaactccttgagaagtctttcaatccagatatatctaaggcatacagaaatgtggattttgaggtccatacagtaaacaatatcatagcgaatcatttctaccgccaaggcctctttgatcttggtgacatgtttgtccatgagtgtggggaactaggcggagcttccttgaagctaccgtttcaggagatgtatgctatccttgaagccatgaaagcgagaaacctcgagcctgctctcagttgggctgccaaaaaccatgatcagctgttgcagaatgggtctatgctggagttcaagctttatcagcttcagtttgttgaaatattgtccaaaggcagtaggggtgaggccaaagatgaggctcttttatatgctaggactcacttggtcccctttgcagccgtgcacaaggaagaattccagaagctaatggcttgccttctatgggttggccggctcgatcaatccccatattctgagttaatgtcatccgcgcattgggagaagctagctgaggagctcacccatcaattctgtagccttctgggccagtcgagggagagcccgctgagtgttgcagtgtcagctggttttcaaggactaccaactctgctgaagctgacgcaagtcatggctgcgaagaagcaggagtggcaagttatgaagcagcttcctgtccccatagacatcgggccagaattccagtatcattctgtctttgtgtgcccggtgctcagggagcagtccagtgacgagaatcccccaatgcggatgccttgtggacatgttgtctccaagcagtccatcatgaagctgtcgaaaagcagctcgagggccttcaagtgcccctactgcccctcggaggctatggcgtcgcattgcaagcagctgcatttctagatgtgttaatcttttctggctgcgcaaaactgcaaacctgttggtacatgtttcccctcctgttccatgttgcaccagtccaataactgtctctctgtaatataaacatctacgtccggataaacatgtagtttcgtctgtattactgatatgtacagttgcatctttgatctaaaaaaaaaaaaaa

SEQ ID NO: 437 - DNA, 1070 bp, Zea mays
cccacgcgtccggaacaatccagcgagctcgaaaaaagggtacgaatacgaaccccaatccagggccggaggagggcgagcgaactcaaaagcaagccgttccagtccaatccgcctcagtccaaatctaatcgccgggtttaggcagaaggggcgggacgcggcgaggtttaggcggggtttgttttgtcccttccgtgcgattctgctctccgcgcgggaggcaagtactgacggaagcgaaggcgaaggcggaggagggggtccccggcggtggaagtggaacgcgccgatgcgcaagtttcaggactccatcaaggccctccaggccgacatcgatcacgccaatgcgatggcgtcggaattcctgagggactacgacggctcggtcatccagatgcgggtggcgtacagcgccgtcgcgcatttcctcctgcagtggaccgactgcaagctcgccggcgcgctcggcctcctcaaggttatgctatacaaggtgtgcgcggacggctcgtcggcgcttcctgattgggagatggaggccagcatcagggagttctacggcgtcattttcccgtcgctgctgcagcttccgagtggcatcaccgagctggacgacaggaagcagaggaagctctgcctgaagaaattcaggagcagggatgagcagctctcggaggtggacacggagagggagctcgagtgcgggatctgcctcgaggttagccccaaggtcgtgctgcccgactgtgcccacatgctctgcatgcggtgctttgaggattggaacgcgaaatcgaagtcctgccccttctgtcgcgcctgcctggaagaggtgaagccgggcagcctgtggatatacaccgacggcagcgacgtggtggacatggataccttgactagggagaacatcaggcggctgttcatgtacataaataagctgccacttgtagtcctacatgtagttgaccttgacgtttacaagtaccgcatcaagtaaaatgcaactgatccttccttggtgaaaaaaaaaaaaaaaaaaaaaaaaaaaaaaaaaaaaaaaaaaaaaa

SEQ ID NO: 438 - DNA, 1154 bp, Zea mays
gcggcggtcggccaggttcgggagatcacttcgtcgcggcgaggagggagggggtcgccgttagcgcgcggcacttggatgagaagggcagcggtggaggaggatgcggaaggcgtacagggactccatcaaggtgctcgaagctgacatccagcacgccaacaccctggcctccgagtttccccgggactatgatggtgcgtgcctgcagatgcggctgtcgtacagtcccgcagctcatatattcctcttcctggtgcagtggacggactgcagcctcgcaggggctcttggtctgctgagaatcctcatatacaaggtttatgtggatggcacaacaaccatgtcgactcatgagaggaaagccagcatcaaagaattctatgctgtgatatttccttctttgctgcaactgcaaagggggatcactgatgtcgaggacaagaagcagaaggccgtatgcatggagaagtacagaaagaaagatgaggatggacgggacaccttatctgatattgatgttgagagggaagaggagtgtgggatttgcatggagatgaacagcaaagttgtgttgcccaactgcacccatgctatgtgtatcagatgttaccaggactggagttcaagatcgcagtcctgcccattctgccgtgacaacctgaagaagacctgtcctagtgacctgtggatatatgttgaggaccaagatgtggtcgacatggagacggtgtcgagcgagaacctcagacggctgttcatgtacataagcaagctgcctctgattgtcccagacgtcatcttcagcgtgtatgattcccacatcaaatgatttccgacgcgaccttctcgacgaccttcagccagtgcccagctccagttaatcttatgcccccatgtcctccattttcatgctttgctcaagcttttggaagtgcctgaactgatttggaaccgcaagccttccggtggtgctttagaaagttgtttagtgcctgcatgcatccttaatcatatgcagccactctgtacatatctgacttcgctcagttaataggggactgtgcttgccccaaatggaggcagggccgtttgtgtctttctcatgtttccattagcgaagcaacgcaaagttctgggcattggaaggtttc

SEQ ID NO: 439 - DNA, 1560 bp, Zea mays
gaaaaattctttgttacgtttttgttgatagcgttgagtgccaaaaatggagcttctccctgttgaagtcgttggcaacattctttcccatcttggtgttgcgcgtgatgttatgattgcctctgcggtatgccgcaagtggcgagatgcatgcaggaggcatctccgtttgctgtccttcaactccaatgactttccacgggacatgactacacgtcagttggagattgtcatcacacagactatatttcagactatggggctgcaacgcctttcgattcacattgataacacccatgagttctctgcagcaccagtgattgcatggctcatgtataccagggagaccctccgaagcctgtcttacaatgtcaggacaatacccaatgtaagcattcttgaaaagtgtggtaggcaaaagctcgaagtgctagatttggaattggaccataacaccatcacaggtgtcgaaccaagctatcagaggttcacttgtctgaaatccctttccctgaggcatgtcagcattttggccttggatttgagccttttagttgctgcttgcccaagaatagagtcattagcacttgatgtccttgaggttgtcacttcagaattacagtctacgatggagctcacaagccatacattgaaaagtctatttgcaaaatcggtaggtgtagataagatcatacttgatgcagataatttggaagttctgcacctgaatgctttaaatctcgatctgtttgagcttaacgggaaaggaacactaaaacattttaagattgatgatgtcagtgttactcatttggatattggggacaatactgatcatttggaggcagtagacgtgagcaacttcacaatagtctggccaaaattctatagcatgatatccagggcatctaatttgcgtatgctacgattttggggtgttgtgtttgatgacgaggatgagatcgtggattcagaaactatagctgtttcatttcctcttcttaggcatctttcattgagttatgaattacgagatgggttacttcactacagccttcagggatcatcattactggagaatgtctcagttctggaacttggttggacagtaataagtgagcactttggaccctgggtgtttggtatgattggaaggtgtccaaatctcaagaaacttgttattcatggtgttctttctgagacaaaaacgcgagaggatcgccagatgttagcaagctttacctcattcatagtctgtgtcatgaggaagtatgtgcatgttgatgtacaatttgagtatgagtgacagctactaggttgggtgggcatcttgtcattgttcagatgaagctgtgccatcaggtaacctcttgcttattgtggcttcaaaatattttattcagcatggtcttattacagattctcagttctctttgtgttactagctttttataaatggtttcttttgggtctaatgtatgtcctgtaagagtgttactttgtatgcaaaacccttggcaccatagttattaaggcggtaaggcgacataatgcgatcgc

SEQ ID NO: 440 - DNA, 1460 bp, Zea mays
cttcttcagtctcccgtcttcttctggtgccaacacatcctcattctcagggtcgccctctcgattctccctcaagtccagtccagccggatcagtccccttcccctcctccacaaggcgccgcctcccgcagatccgaattggaatctgggccttcgtctccgcaccacaaatccgggaagggaagggaagtgatgggggagtgcgaggacggcaaggagtacaggtgctgggaggagctgctgccggacgcgctggggctcatcttccgcaacctgccgctccaggaggtgctcaccgtcctgccgcgggtgtgcaagtcctgggggcgggtggtcgccggcccctactgctggcaggagatcgacatcgaggagtggagccagcagcagagcaagcccgagcagatcggccgcatggtggagctgctcgtcggccgcagcggcggctcgtgccgccggatcagcgtctccgggctgccctgcgatccgctcttctcgttcatcgcagacaatgcgcgagctcttgggaccttggagatccccaggagtgagatcagcgactccgtagtggaagccgtggcgccgcggctatcgaacgtgacgttcctagacatcagcagctgcacgaagatcggagcccgcgcgctggaggcgttcggcaggcactgcaggtccctggtggggctccggcgggtgatgcacccgatcgacctggcggacaaggtgtgccagcacgacgaggcgcacgccatcgcgcgcagcatgccgaggctgcggcacctggagatggggtacatgctggtggcgacggaggcggtgctggagatcctggggcagtgccgcgagctcaagttcctggacctgcgcggctgctgggccgtggacgaccggttcctgcgggagcgccacccggggctgcgcgtcctgggcccgcgcgtcgtcgacgactgctacgagaacagctactgggaggagtgctccgactactactcggacgaggacgaggactacgacgacgacgtcgtctcgtgggggttgttcgtggacgacgacgacgactactactacgccgtcggcagcgacgacgacgaggctatctgggacgacgcgcagggcctggagaacctcgaggtgaggttctacggcggcggtggcttcggcgagagcttcgccggcttcgactggccgccgtcgccgtgacgtggcccgcgagagccgctgctgcgcttgcgttgcgcggaccgtttgcggctcttgcttatataccgcgtgcgtgcctgagtcgttgtttgttgttcgtcccaagctttgtttgcagatgtgtgctttcaatctttaagctctagcttgcagatatgtgaagtggactgctagtagtagtacactctagctgtaaaactccggtgtttacctgaagcaaaccagcatgcactggtgagatttcaccggcgccaaaaa

SEQ ID NO: 441 - DNA, 1330 bp, Zea mays
tcgcattccacccgcccccttttcgcgtgaacgcgccggcgccgcggatcctgccgtcacgaatggaggcgtggccggacgatttccgctgccccatcacgctggaggtcatgacggacccggtcatcctcccctccggccacaccttcgagcgccgcagcatccagagctggctcgacggggggcacctcacctgccccgtcaccaacctcccgctgccgccctccccgccgctcatccccaaccacgcgctgcgccgcctcatagccgccgtctcgccttccgcggcggcgtctctcgtccctgcggagggaggggcgcacgcgaggcaagaagcggtgtcggcggcggcggcggcggcggtgccagcccggcccgcgtcgcccgtgccggcgctgctgaggctggccaagtccggcgccgcagggcggaaggaggtgctggagtccggcagcgcggcggtgctgctgcggcacgcggaggccggggacgaggcggcggccagggcgctgctgcacctcagcctggacggcgacgacacgcgcgtgggcctcgtggcggacggcgccgtggacgcgctgtccgccgcggtgtcccgcggcggcgcggcggcggcgtccgcggccacggcgctgaccagcctcgccaccgtggacgtgaacaagtgcaccatcggggcgcacccctcggccatcccggcgctggcggggctcctccgccgcggcgggccgcgggagcgccgcgaggccgccacggcgctctacgagctctgcaagctgccggagaaccggcgccgcgcggtgcgcgagggcgcggcgcccgcgctcgccgacttcgccgccgccggctccgcgcgcgccgtcgaggtgctcggcctccttgcccggtgccgggaggggcggcaggagctgtgcagggtccccggcgtcgtgtccgtgctcacgggcgccgccgggagcggcaacgcgcgcgcaatcgagcaggccctgctcgtcctcaactggatttgctccgagagcaacgagttggcggtggaagcaatcaagctgcaggctttcgacctctgcgaggctctggtgaacgacgacaactgcaagatcgccaagaacgcggtcgacttggcccggacgctcgagaaagcgtagaattggattgggctgtctcccccaaaacatgagatgagattcgccatgggttttgattcaacacctgctcgattggtcgggtgttggcctcattgtacagaggtagcaacagcaaaggtgaaccttttatctttcttctcttactccgtttcatttccaagttgtagctgcgccgaaaggaggac

SEQ ID NO: 442 - DNA, 3310 bp, Zea mays
gcctcgtgccgttgctctcctctctttacccgtcgccgccctcgccctcgccaccacccgcacccgccgcgcggcccccattcgcctcgatttcgccggcggcgatgtacggcaacgacaactggatcaacagctatctcgacgccatcctcgatgccggcaagggcgtcgcggccgcggccgcgggcgccgccaggggccggggcggaggctggggcggggaccggccctcgctgctcctccgcgagcgcggccacttctcccccgcgcgctactttgtcgaggaggtcatcaccggctacgacgagaccgacctctacaagacctggctccgggcgaacgcgatgcggagcccgcaggagaagaacacgcggctggagaacatgacctggaggatctggaacctcgccaggaagaagaaggagtttgagaaagaggaagccattcgcttgtccaaacaccgtttagagactaagaagccacggaatgatgctactgcagaaatgtctgaagatctttttgaaggagtgaagggagaagacgctggtgatccatctgttgcctacggtgacagcacaactgggaacacacctaggaccagtttatttgacaagctatacatagtgttgatcagtctgcatggcctgatacgtggagagaacatggagcttggccgtgattcagatactggtggccaggtcaaatatgtcgtggagcttgctaaagcattaagttcatgtcctggagtttaccgggttgatctattgacaagacaaatcttagccccaaattttgatcgtggctatggtgaactagatgagctgctggcttcgacaagtttcaagaactttagatgcgaacgaggagagaacagtggtgcacatatcatcagaataccatttggccccaaagacaagcatctagctaaagaaaatatctggcctttcattcaggaatttgttgatggtgcactaggtcatattgtgcgcatgtcaaaaactataggcgaagaaactggcagtgtgtgtccagtgtggcctactgtgattcatggccattatgccagtgcaggagttgctgctgctctattatctggagcacttaatgttcccatgttgtttaccgggcattttcttggtaaagataagctggaagagcttctcaagcaaggtaggcagacaagagaacaaataaatgtgacatacaaaataatgcgccgaattgaggcagaggagttatctcttgatgcatctgaaataattatcgcaagcacacggcaagaaatagaagaacaatggaacttgtatgatggttttgaagtcatgcttgcgaggaagctccgtgcgttagtcaagcgtggtgctaactgttatggtcgttatatgcctcgtatggttataattcctccaggagttgaattcggccaattgattcatgattttgatatgtatggagatgaagataaccaatctccagccttggatccatctatttggtttgagataatgcggttcttcacaaatcctaggaaacctatgattttggctattgctcgtccatattctgaaaagaatattgcaacacttgtgaaggcatttggtgaatgccatccgttgagggaacttgctaaccttacactgataatgggcaaccgtgaggctatttccaaaatgaacaaaatcagtgcagctgttttgacatcggtgcttacattgattgatgaatatgatttatatggtcaagtggcatacccaaagcttcacaagcactctgaagttcctgatatttatcgtttagcagcaagaacaaagggcgcttttgtaaatgttgcttattttgaacaatttggtgtcaccttgatagaggctgccatgcacgggttgcctgttattgcaacaaaaaatggggctcctgttgaaatttatcaggttctggaaaatggtctccttgttgatccccatgatcagcatgcaattgcagatgccctctataagatgctttctgaaaagcagttttggtcaagatgtcgagaaaatggattgaaaaatatacaccaattttcttggcctgaacattgcaagaattacttgtcaaggatatcaagtcttggtccaagacatcctgcttttgcatgcaaagaagaccacaaggtgcctgtgaagtgcaggaagcatatatctatcattgctgtagactctgttaacaaggaagatttaattcaaattatcagaaactctgttgaggctacacgcactggaactatgtcaggttctacaggttttgtgctgtcaacttcactgacaatagcagagctacagtctgtaatagtacgcacaggcatgctcccgactgactttgatgcctttatatgcaatagtgggagcgatatatattatccattacagtctagtgatgtgccaagcaattcccgtgttacatttgcgttggaccataactaccgatcacatatcgagtatcgttggggaggagaaggtttaaggaagtacttagttaagtgggcttcttcagtagtagaaagaagggggagaactgaaaagcaagtcatctttgaagattcagaacactcttcaacatattgtcttgcatttagagtggttaatccaaatcatttgcctcctttgaaggagctgcaaaagttgatgagaatccagtcactgcgttgtcatgctctgtataaccatggcgccaccaggctatctgtaattccaatgcatgcatcgcgatctcaggctctaaggtatttgtctattcgctggggcatagagttgccaaatgctgtggtcattgttggtgaaactggtgattctgattacgaggaactgtttggaggtctccacaagacagtcatccttaagggtggattcaacactcctgcgaataggatccatacggtcagaaggtaccctttacaggatgttgttgctcttgatagctcaaatatcattggaattgagggattcagcactggtgacatcaggtctgctatgcaacaacagcttggtatacccacacaatgacaccaactgcaatctattttgttattaatagaaagaaagaaacagataacagaaatatacgatacaaatacttagtttccattctattggaaatgtccgattttgcctgccagtcatttaatgtatgtgtgtggtggtccctgcacgggttatgaatgacattcccttggatcccgcactggagattttttggattgaagagcttgttaatggatacatccagctgtacagacggaacaaatttgttcaaatgttgatagtgaaaacatttt

SEQ ID NO: 443 - DNA, 3121 bp, Oryza sativa
ggcacgaggcaaagcaaagcagcgaatccggcttcactagtcttcttcccccccgccgccgcatcgatcccccttcccctcgtcttccttccctttcccccaatcagattgcttccagaagcctccttccccgcgaagcaaccaaccccttccggatcccgactccatccaaacccccatcccctcccctctcccctacgctcgaaaccctagggagatccatccacatgccgccccgatgaggtcgctccgccgcgtcctcctccagctcgtgctcctcgccggcgtcgccttccgcggggtccgcttcgacgacgccgccgacgccgccgccgccgcccaggggtcgtcagacctcttcgagctcccttcgccgtccccgactctcgcgctccccggcggcggggatgagggggcctcgacggagatcatcgccgcgccgtggccggggcgccacggcctgttcacgccgccgcggagcacgtcccagccggcgagagcggtggtccagccggccgccgacttcggctcccaactccagttttacgacaatggtacaattcaactagtggaccttctatcaaaattgcctcggtggcagttctccaccggaccccctctttcgaagcatatcactacttcgaaacctgatttgaactatgtcatataccttgatgggtcagaaacatcggaccttatagaagttcataatggcagtggtgtgagacttccctggaaactggaggagtttattgctgagactccatatatacgggattcttttgttacgattggatcaaaggtttcaactacttttgtggtcaatgctgatagcggtgagatcatttacaagcatagcttgccagtggccttgaacgaggtaggtggccccctggttgaggaaattccatccaagttagatgctgctagaagtggtacaagtgctaatatcatagtggttgtgagaactgattattctatcagtgcatcggatcttggggaacatttgttcaactggacaagaacttccttcactgcaaattactatgcgaggtatggccaccaagacatgcttgcccaatcgtcctgtctgcgaggaaatattccatgcattaggactgagggtccaccaattaaactttatttacctgattcaagttcagataatgcaattgtcttgagacctgtgaacgaagtttctgctgtggatgctctggaaccacttctacctccaaagaagttaccacaacctgctggcgagtctaatgtggccttggatagtgctcaaaaccagactgctgacattgccctaggtcattttgtgcctgctgacactgaattgaccaacagtgtcactaaattttcttacagatggctattccccacgtttctcatgttgttgatcatggcttgtctagtgaaattggccgatgcaagcaaatattgcaggcaatttgtgattcgatttttgaagccatttatgcgtgatgagaaattgatggacccaagaggcaaatcagagggaacatcaaaaagaaggaaggcgcggaagaaagatggacttatcaatagcactcagatcttttcagcatctgataaagaggggaatggaactggtggatcaactgaggcacaaagtaataaagcacatgattcaacaaatgtggaactccctaatggcctcaatgggcgtcagattggtaagctttgtgtttacagtaaagaaattggtaaagggagcaatggtacagttgtctttgaaggctcctatggtggtcgggaagttgctgtgaaacgtctgctgcgctctcacaatgatatagcctcgaaagagattgagaatctgattgcatctgatcaggatcctaatattgttcgaatgtatggttttgagcaggacaatgattttgtttatatctcccttgagaggtgtcgctgcagcttggctgatctaatccaactgcactcggtaccaccattttcaaatactaagggaacagacattgaactttggaggcaggatggacttccttcggcacaacttctaaagctgatgagagatgttgttgctggtattgtgcatttgcatagtttgggaattatacatcgtgatttgaagcctcagaatgttttgataagcaaggaaggacctctcagagcaaaactttcagatatgggtatcagtaagcgtttgcaggaggatatgacttctgttagtcatcatggcactggatttggaagctctggttggcaagcacctgaacagcttcgtcatggtcgtcagactcgagccatagatttatttagtttgggctgccttatattctattgcattactaaaggcaagcatccgtttggtgagtactatgaacgggacatgaaaatcataaacaatcaatttgatctcttcatagtggatcacataccagaagcagtgcatcttatttctcaactgttagatccagatccagagaagagaccaacggccgtgtatgtgatgcatcatcctttcttttggagccctgagttgtgcctttcatttctacgagataccagtgacagaattgagaaaaccagtgaaactgatctcatagatgctttggaaggcataaatgttgaagcatttggtaaaaattggggagagaaattagatgctgccctgcttgcagacatgggacgttatagaaaatatagttttgagtccactcgtgaccttctaagattgatcagaaacaaatcaggacattacagagaattttcagatgatctcaaggagctacttgggtcgctgccggagggatttgttcagtatttctcaagccgattcccaaagctgctaattaaagtctacgaggtcatgtccgagcattgcaaggacgaagaagctttcagcaaatatttccttggaagctcggcgtagctgtaacctgcaggaggggtgaaggccctgccctgcctagtgtgtacactaacactcttctagcaaaaatgtatgtacatgtgatttgtaccatatatcatagggtaaagaaagttcagcctgtacattgtattccacagaattgtgtattacttatagtaaatcaaattttttacctgactaaaaaaaaaaaaaaaaaaa

SEQ ID NO: 444 - DNA, 3121 bp, Oryza sativa
ggcacgaggcaaagcaaagcagcgaatccggcttcactagtcttcttcccccccgccgccgcatcgatcccccttcccctcgtcttccttccctttcccccaatcagattgcttccagaagcctccttccccgcgaagcaaccaaccccttccggatcccgactccatccaaacccccatcccctcccctctcccctacgctcgaaaccctagggagatccatccacatgccgccccgatgaggtcgctccgccgcgtcctcctccagctcgtgctcctcgccggcgtcgccttccgcggggtccgcttcgacgacgccgccgacgccgccgccgccgcccaggggtcgtcagacctcttcgagctcccttcgccgtccccgactctcgcgctccccggcggcggggatgagggggcctcgacggagatcatcgccgcgccgtggccggggcgccacggcctgttcacgccgccgcggagcacgtcccagccggcgagagcggtggtccagccggccgccgacttcggctcccaactccagttttacgacaatggtacaattcaactagtggaccttctatcaaaattgcctcggtggcagttctccaccggaccccctctttcgaagcatatcactacttcgaaacctgatttgaactatgtcatataccttgatgggtcagaaacatcggaccttatagaagttcataatggcagtggtgtgagacttccctggaaactggaggagtttattgctgagactccatatatacgggattcttttgttacgattggatcaaaggtttcaactacttttgtggtcaatgctgatagcggtgagatcatttacaagcatagcttgccagtggccttgaacgaggtaggtggccccctggttgaggaaattccatccaagttagatgctgctagaagtggtacaagtgctaatatcatagtggttgtgagaactgattattctatcagtgcatcggatcttggggaacatttgttcaactggacaagaacttccttcactgcaaattactatgcgaggtatggccaccaagacatgcttgcccaatcgtcctgtctgcgaggaaatattccatgcattaggactgagggtccaccaattaaactttatttacctgattcaagttcagataatgcaattgtcttgagacctgtgaacgaagtttctgctgtggatgctctggaaccacttctacctccaaagaagttaccacaacctgctggcgagtctaatgtggccttggatagtgctcaaaaccagactgctgacattgccctaggtcattttgtgcctgctgacactgaattgaccaacagtgtcactaaattttcttacagatggctattccccacgtttctcatgttgttgatcatggcttgtctagtgaaattggccgatgcaagcaaatattgcaggcaatttgtgattcgatttttgaagccatttatgtaggatgagaaattgatggacccaagaggcaaatcagagggaacatcaaaaagaaggaaggcgcggaagaaagatggacttatcaatagcactcagatcttttcagcatctgataaagaggggaatggaactggtggatcaactgaggcacaaagtaataaagcacatgattcaacaaatgtggaactccctaatggcctcaatgggcgtcagattggtaagctttgtgtttacagtaaagaaattggtaaagggagcaatggtacagttgtctttgaaggctcctatggtggtcgggaagttgctgtgaaacgtctgctgcgctctcacaatgatatagcctcgaaagagattgagaatctgattgcatctgatcaggatcctaatattgttcgaatgtatggttttgagcaggacaatgattttgtttatatctcccttgagaggtgtcgctgcagcttggctgatctaatccaactgcactcggtaccaccattttcaaatactaagggaacagacattgaactttggaggcaggatggacttccttcggcacaacttctaaagctgatgagagatgttgttgctggtattgtgcatttgcatagtttgggaattatacatcgtgatttgaagcctcagaatgttttgataagcaaggaaggacctctcagagcaaaactttcagatatgggtatcagtaagcgtttgcaggaggatatgacttctgttagtcatcatggcactggatttggaagctctggttggcaagcacctgaacagcttcgtcatggtcgtcagactcgagccatagatttatttagtttgggctgccttatattctattgcattactaaaggcaagcatccgtttggtgagtactatgaacgggacatgaaaatcataaacaatcaatttgatctcttcatagtggatcacataccagaagcagtgcatcttatttctcaactgttagatccagatccagagaagagaccaacggccgtgtatgtgatgcatcatcctttcttttggagccctgagttgtgcctttcatttctacgagataccagtgacagaattgagaaaaccagtgaaactgatctcatagatgctttggaaggcataaatgttgaagcatttggtaaaaattggggagagaaattagatgctgccctgcttgcagacatgggacgttatagaaaatatagttttgagtccactcgtgaccttctaagattgatcagaaacaaatcaggacattacagagaattttcagatgatctcaaggagctacttgggtcgctgccggagggatttgttcagtatttctcaagccgattcccaaagctgctaattaaagtctacgaggtcatgtccgagcattgcaaggacgaagaagctttcagcaaatatttccttggaagctcggcgtagctgtaacctgcaggaggggtgaaggccctgccctgcctagtgtgtacactaacactcttctagcaaaaatgtatgtacatgtgatttgtaccatatatcatagggtaaagaaagttcagcctgtacattgtattccacagaattgtgtattacttatagtaaatcaaattttttacctgactaaaaaaaaaaaaaaaaaaa

SEQ ID NO: 445 - DNA, 3121 bp, Oryza sativa
ggcacgaggcaaagcaaagcagcgaatccggcttcactagtcttcttcccccccgccgccgcatcgatcccccttcccctcgtcttccttccctttcccccaatcagattgcttccagaagcctccttccccgcgaagcaaccaaccccttccggatcccgactccatccaaacccccatcccctcccctctcccctacgctcgaaaccctagggagatccatccacatgccgccccgatgaggtcgctccgccgcgtcctcctccagctcgtgctcctcgccggcgtcgccttccgcggggtccgcttcgacgacgccgccgacgccgccgccgccgcccaggggtcgtcagacctcttcgagctcccttcgccgtccccgactctcgcgctccccggcggcggggatgagggggcctcgacggagatcatcgccgcgccgtggccggggcgccacggcctgttcacgccgccgcggagcacgtcccagccggcgagagcggtggtccagccggccgccgacttcggctcccaactccagttttacgacaatggtacaattcaactagtggaccttctatcaaaattgcctcggtggcagttctccaccggaccccctctttcgaagcatatcactacttcgaaacctgatttgaactatgtcatataccttgatgggtcagaaacatcggaccttatagaagttcataatggcagtggtgtgagacttccctggaaactggaggagtttattgctgagactccatatatacgggattcttttgttacgattggatcaaaggtttcaactacttttgtggtcaatgctgatagcggtgagatcatttacaagcatagcttgccagtggccttgaacgaggtaggtggccccctggttgaggaaattccatccaagttagatgctgctagaagtggtacaagtgctaatatcatagtggttgtgagaactgattattctatcagtgcatcggatcttggggaacatttgttcaactggacaagaacttccttcactgcaaattactatgcgaggtatggccaccaagacatgcttgcccaatcgtcctgtctgcgaggaaatattccatgcattaggactgagggtccaccaattaaactttatttacctgattcaagttcagataatgcaattgtcttgagacctgtgaacgaagtttctgctgtggatgctctggaaccacttctacctccaaagaagttaccacaacctgctggcgagtctaatgtggccttggatagtgctcaaaaccagactgctgacattgccctaggtcattttgtgcctgctgacactgaattgaccaacagtgtcactaaattttcttacagatggctattccccacgtttctcatgttgttgatcatggcttgtctagtgaaattggccgatgcaagcaaatattgcaggcaatttgtgattcgatttttgaagccatttatggccgatgagaaattgatggacccaagaggcaaatcagagggaacatcaaaaagaaggaaggcgcggaagaaagatggacttatcaatagcactcagatcttttcagcatctgataaagaggggaatggaactggtggatcaactgaggcacaaagtaataaagcacatgattcaacaaatgtggaactccctaatggcctcaatgggcgtcagattggtaagctttgtgtttacagtaaagaaattggtaaagggagcaatggtacagttgtctttgaaggctcctatggtggtcgggaagttgctgtgaaacgtctgctgcgctctcacaatgatatagcctcgaaagagattgagaatctgattgcatctgatcaggatcctaatattgttcgaatgtatggttttgagcaggacaatgattttgtttatatctcccttgagaggtgtcgctgcagcttggctgatctaatccaactgcactcggtaccaccattttcaaatactaagggaacagacattgaactttggaggcaggatggacttccttcggcacaacttctaaagctgatgagagatgttgttgctggtattgtgcatttgcatagtttgggaattatacatcgtgatttgaagcctcagaatgttttgataagcaaggaaggacctctcagagcaaaactttcagatatgggtatcagtaagcgtttgcaggaggatatgacttctgttagtcatcatggcactggatttggaagctctggttggcaagcacctgaacagcttcgtcatggtcgtcagactcgagccatagatttatttagtttgggctgccttatattctattgcattactaaaggcaagcatccgtttggtgagtactatgaacgggacatgaaaatcataaacaatcaatttgatctcttcatagtggatcacataccagaagcagtgcatcttatttctcaactgttagatccagatccagagaagagaccaacggccgtgtatgtgatgcatcatcctttcttttggagccctgagttgtgcctttcatttctacgagataccagtgacagaattgagaaaaccagtgaaactgatctcatagatgctttggaaggcataaatgttgaagcatttggtaaaaattggggagagaaattagatgctgccctgcttgcagacatgggacgttatagaaaatatagttttgagtccactcgtgaccttctaagattgatcagaaacaaatcaggacattacagagaattttcagatgatctcaaggagctacttgggtcgctgccggagggatttgttcagtatttctcaagccgattcccaaagctgctaattaaagtctacgaggtcatgtccgagcattgcaaggacgaagaagctttcagcaaatatttccttggaagctcggcgtagctgtaacctgcaggaggggtgaaggccctgccctgcctagtgtgtacactaacactcttctagcaaaaatgtatgtacatgtgatttgtaccatatatcatagggtaaagaaagttcagcctgtacattgtattccacagaattgtgtattacttatagtaaatcaaattttttacctgactaaaaaaaaaaaaaaaaaaa

SEQ ID NO: 446 - DNA, 3501 bp, Saccharomyces cerevisiae
tcacttttctccatatcacccttcatacacattaaaaaaacagcatatctgaggaattaatattttagcactttgaaaaatgcgtctacttcgaagaaacatgttagtattgacactgctcgtttgtgtgttttcatccatcatttcatgctcaatcccattgtcgtctcgcacctcaaggcggcagatagtggaagatgaagttgcctccactaaaaagctcaatttcaactatggtgtggataaaaatataaactcgcccattcctgctccaagaaccactgaaggtttaccaaatatgaaactcagctcatatccaactcctaacttattgaatactgctgataatcgacgtgctaacaaaaaaggacgtagggctgccaattctataagtgtaccctatttggagaatcgttccttgaacgaactgagtttatcagatatactaatcgcagccgacgttgagggtggacttcatgctgtagatagaagaaatggtcatatcatatggtcaatcgaaccagaaaattttcaacctctgatagaaatacaagaaccttcgaggttagaaacatatgaaacgttgattatagaacctttcggtgatgggaacatttactactttaacgcccatcaagggttacaaaaactgcctttatccatacgacaacttgtatcaacttccccgctgcacttgaaaacaaatattgtggttaatgactctggaaaaattgttgaagatgaaaaggtctacactggatcgatgagaactataatgtatactataaacatgttgaatggtgaaattatatcagcgttcggacctggttcaaaaaacgggtatttcgggagccagagtgtggattgctcacctgaggagaagataaaacttcaggaatgtgaaaatatgattgtaataggcaaaactatttttgagctgggaattcactcttatgatggagcaagctacaatgtcacttactctacatggcagcaaaatgttttagatgttcccctagcgcttcagaatacattttcaaaggacggcatgtgcatagcgcctttccgtgataaatcattgctagcaagcgatttagattttagaattgctagatgggtttctccgacattccccggaattattgttgggcttttcgatgtgtttaatgatctccgcaccaatgaaaatatactggtaccgcatccctttaatcctggtgatcatgaaagtatatcgagtaacaaagtttacttggatcagacttcgaacctctcctggtttgcattatctagtcagaattttccatctttagtcgaatcagctcccatatcaagatacgcttccagtgaccgttggagggtgtcttcaatttttgaagatgagactttattcaagaacgcaatcatgggtgttcatcagatatataataatgaatatgatcacctttatgaaaactatgaaaaaacgaatagtttggacactacgcacaaatatccacctctgatgattgattcgtccgttgatacaaccgatttacatcagaataacgagatgaattcactaaaggaatacatgtcaccagaagaccttgaggcatatagaaaaaagatacacgagcaaatatcgagagaattagatgaaaagaaccaaaattctttgctactgaagtttggaagtctagtatatcgaattatagagactggagtatttctgttgttatttctcattttttgtgcaatactacaaagattcaaaattttgccgccactatatgtattattatccaaaattggatttatgcctgaaaaggaaatccccatagttgagtcgaaatcgctaaattgtccctcttcatcggaaaatgtaaccaagccattcgatatgaaatcagggaagcaagttgtttttgaaggtgctgtgaacgatggaagtctaaaatctgaaaaagataacgatgatgctgatgaagatgatgaaaaatcactagatttaaccacagaaaagaagaagaggaaaagaggttcgagaggaggcaaaaagggccgaaaatcacgcattgcaaatataccaaactttgagcaatctttaaaaaatttggtagtatccgaaaaaattttaggttacggttcatcaggaacagtagtttttcagggaagttttcaaggaagacctgttgcggtaaagagaatgttaattgatttttgtgacatagctttaatggaaataaaacttttgactgaaagcgatgatcaccctaacgtcatacgatactactgttcagaaacaacagacagatttttgtatattgctttagagctctgcaatttgaaccttcaagatttggtggagtctaagaatgtatcagatgaaaacctgaaattacagaaagagtataatccaatttcgttattgagacaaatagcgtccggggtagcacatttacattctttaaagattatccatcgagatttaaagcctcaaaatattctcgtttctacttcgagtaggtttactgccgatcagcaaacaggagcagaaaatcttcgaattttgatatcagactttggtctttgcaaaaaactagactctggtcagtcttcatttagaacaaatttgaataacccttctggcacaagtggttggagggccccagagctgcttgaagaatcaaacaatttgcagtgccaagtcgaaacggaacactcttctagtaggcatacagtagtttcatctgattctttttatgatccgttcaccaagaggaggctaacaagatctattgatattttttctatgggatgtgtattctattatatcctatccaaagggaagcatccatttggagataaatattcacgtgaaagcaatatcataagaggaatattcagtcttgatgaaatgaaatgtctacatgatagatccttaattgcagaagctacagatctgatctcccaaatgattgatcacgatccgttaaaaagacctactgctatgaaagttctaaggcatccgttgttttggccaaagtcgaaaaaattggagttccttttaaaagttagtgataggcttgaaattgaaaacagagaccctccaagtgccctgttaatgaaatttgacgccggttctgactttgtaatacccagtggagattggactgtcaagtttgataaaacattcatggacaaccttgaaaggtacagaaaataccattcatcaaagttaatggatctattaagagcacttaggaataaatatcatcattttatggatttacctgaagatatagcagaactaatggggccggtacccgatggattttacgattacttcaccaagcgttttccaaacctattaataggtgtttatatgattgtcaaggaaaatttaagtgacgatcaaattttacgtgaatttttgtattcataacatgttcatgcccctctgcttcttcttggttgattattgcattaatgttactttgatcattagtagtaaccatc

SEQ ID NO: 447 - DNA, 3501 bp, Saccharomyces cerevisiae
tcacttttctccatatcacccttcatacacattaaaaaaacagcatatctgaggaattaatattttagcactttgaaaaatgcgtctacttcgaagaaacatgttagtattgacactgctcgtttgtgtgttttcatccatcatttcatgctcaatcccattgtcgtctcgcacctcaaggcggcagatagtggaagatgaagttgcctccactaaaaagctcaatttcaactatggtgtggataaaaatataaactcgcccattcctgctccaagaaccactgaaggtttaccaaatatgaaactcagctcatatccaactcctaacttattgaatactgctgataatcgacgtgctaacaaaaaaggacgtagggctgccaattctataagtgtaccctatttggagaatcgttccttgaacgaactgagtttatcagatatactaatcgcagccgacgttgagggtggacttcatgctgtagatagaagaaatggtcatatcatatggtcaatcgaaccagaaaattttcaacctctgatagaaatacaagaaccttcgaggttagaaacatatgaaacgttgattatagaacctttcggtgatgggaacatttactactttaacgcccatcaagggttacaaaaactgcctttatccatacgacaacttgtatcaacttccccgctgcacttgaaaacaaatattgtggttaatgactctggaaaaattgttgaagatgaaaaggtctacactggatcgatgagaactataatgtatactataaacatgttgaatggtgaaattatatcagcgttcggacctggttcaaaaaacgggtatttcgggagccagagtgtggattgctcacctgaggagaagataaaacttcaggaatgtgaaaatatgattgtaataggcaaaactatttttgagctgggaattcactcttatgatggagcaagctacaatgtcacttactctacatggcagcaaaatgttttagatgttcccctagcgcttcagaatacattttcaaaggacggcatgtgcatagcgcctttccgtgataaatcattgctagcaagcgatttagattttagaattgctagatgggtttctccgacattccccggaattattgttgggcttttcgatgtgtttaatgatctccgcaccaatgaaaatatactggtaccgcatccctttaatcctggtgatcatgaaagtatatcgagtaacaaagtttacttggatcagacttcgaacctctcctggtttgcattatctagtcagaattttccatctttagtcgaatcagctcccatatcaagatacgcttccagtgaccgttggagggtgtcttcaatttttgaagatgagactttattcaagaacgcaatcatgggtgttcatcagatatataataatgaatatgatcacctttatgaaaactatgaaaaaacgaatagtttggacactacgcacaaatatccacctctgatgattgattcgtccgttgatacaaccgatttacatcagaataacgagatgaattcactaaaggaatacatgtcaccagaagaccttgaggcatatagaaaaaagatacacgagcaaatatcgagagaattagatgaaaagaaccaaaattctttgctactgaagtttggaagtctagtatatcgaattatagagactggagtatttctgttgttatttctcattttttgtgcaatactacaaagattcaaaattttgccgccactatatgtattattatccaaaattggattttagcctgaaaaggaaatccccatagttgagtcgaaatcgctaaattgtccctcttcatcggaaaatgtaaccaagccattcgatatgaaatcagggaagcaagttgtttttgaaggtgctgtgaacgatggaagtctaaaatctgaaaaagataacgatgatgctgatgaagatgatgaaaaatcactagatttaaccacagaaaagaagaagaggaaaagaggttcgagaggaggcaaaaagggccgaaaatcacgcattgcaaatataccaaactttgagcaatctttaaaaaatttggtagtatccgaaaaaattttaggttacggttcatcaggaacagtagtttttcagggaagttttcaaggaagacctgttgcggtaaagagaatgttaattgatttttgtgacatagctttaatggaaataaaacttttgactgaaagcgatgatcaccctaacgtcatacgatactactgttcagaaacaacagacagatttttgtatattgctttagagctctgcaatttgaaccttcaagatttggtggagtctaagaatgtatcagatgaaaacctgaaattacagaaagagtataatccaatttcgttattgagacaaatagcgtccggggtagcacatttacattctttaaagattatccatcgagatttaaagcctcaaaatattctcgtttctacttcgagtaggtttactgccgatcagcaaacaggagcagaaaatcttcgaattttgatatcagactttggtctttgcaaaaaactagactctggtcagtcttcatttagaacaaatttgaataacccttctggcacaagtggttggagggccccagagctgcttgaagaatcaaacaatttgcagtgccaagtcgaaacggaacactcttctagtaggcatacagtagtttcatctgattctttttatgatccgttcaccaagaggaggctaacaagatctattgatattttttctatgggatgtgtattctattatatcctatccaaagggaagcatccatttggagataaatattcacgtgaaagcaatatcataagaggaatattcagtcttgatgaaatgaaatgtctacatgatagatccttaattgcagaagctacagatctgatctcccaaatgattgatcacgatccgttaaaaagacctactgctatgaaagttctaaggcatccgttgttttggccaaagtcgaaaaaattggagttccttttaaaagttagtgataggcttgaaattgaaaacagagaccctccaagtgccctgttaatgaaatttgacgccggttctgactttgtaatacccagtggagattggactgtcaagtttgataaaacattcatggacaaccttgaaaggtacagaaaataccattcatcaaagttaatggatctattaagagcacttaggaataaatatcatcattttatggatttacctgaagatatagcagaactaatggggccggtacccgatggattttacgattacttcaccaagcgttttccaaacctattaataggtgtttatatgattgtcaaggaaaatttaagtgacgatcaaattttacgtgaatttttgtattcataacatgttcatgcccctctgcttcttcttggttgattattgcattaatgttactttgatcattagtagtaaccatc

SEQ ID NO: 448 - DNA, 3501 bp, Saccharomyces cerevisiae
tcacttttctccatatcacccttcatacacattaaaaaaacagcatatctgaggaattaatattttagcactttgaaaaatgcgtctacttcgaagaaacatgttagtattgacactgctcgtttgtgtgttttcatccatcatttcatgctcaatcccattgtcgtctcgcacctcaaggcggcagatagtggaagatgaagttgcctccactaaaaagctcaatttcaactatggtgtggataaaaatataaactcgcccattcctgctccaagaaccactgaaggtttaccaaatatgaaactcagctcatatccaactcctaacttattgaatactgctgataatcgacgtgctaacaaaaaaggacgtagggctgccaattctataagtgtaccctatttggagaatcgttccttgaacgaactgagtttatcagatatactaatcgcagccgacgttgagggtggacttcatgctgtagatagaagaaatggtcatatcatatggtcaatcgaaccagaaaattttcaacctctgatagaaatacaagaaccttcgaggttagaaacatatgaaacgttgattatagaacctttcggtgatgggaacatttactactttaacgcccatcaagggttacaaaaactgcctttatccatacgacaacttgtatcaacttccccgctgcacttgaaaacaaatattgtggttaatgactctggaaaaattgttgaagatgaaaaggtctacactggatcgatgagaactataatgtatactataaacatgttgaatggtgaaattatatcagcgttcggacctggttcaaaaaacgggtatttcgggagccagagtgtggattgctcacctgaggagaagataaaacttcaggaatgtgaaaatatgattgtaataggcaaaactatttttgagctgggaattcactcttatgatggagcaagctacaatgtcacttactctacatggcagcaaaatgttttagatgttcccctagcgcttcagaatacattttcaaaggacggcatgtgcatagcgcctttccgtgataaatcattgctagcaagcgatttagattttagaattgctagatgggtttctccgacattccccggaattattgttgggcttttcgatgtgtttaatgatctccgcaccaatgaaaatatactggtaccgcatccctttaatcctggtgatcatgaaagtatatcgagtaacaaagtttacttggatcagacttcgaacctctcctggtttgcattatctagtcagaattttccatctttagtcgaatcagctcccatatcaagatacgcttccagtgaccgttggagggtgtcttcaatttttgaagatgagactttattcaagaacgcaatcatgggtgttcatcagatatataataatgaatatgatcacctttatgaaaactatgaaaaaacgaatagtttggacactacgcacaaatatccacctctgatgattgattcgtccgttgatacaaccgatttacatcagaataacgagatgaattcactaaaggaatacatgtcaccagaagaccttgaggcatatagaaaaaagatacacgagcaaatatcgagagaattagatgaaaagaaccaaaattctttgctactgaagtttggaagtctagtatatcgaattatagagactggagtatttctgttgttatttctcattttttgtgcaatactacaaagattcaaaattttgccgccactatatgtattattatccaaaattggatttatggccgaaaaggaaatccccatagttgagtcgaaatcgctaaattgtccctcttcatcggaaaatgtaaccaagccattcgatatgaaatcagggaagcaagttgtttttgaaggtgctgtgaacgatggaagtctaaaatctgaaaaagataacgatgatgctgatgaagatgatgaaaaatcactagatttaaccacagaaaagaagaagaggaaaagaggttcgagaggaggcaaaaagggccgaaaatcacgcattgcaaatataccaaactttgagcaatctttaaaaaatttggtagtatccgaaaaaattttaggttacggttcatcaggaacagtagtttttcagggaagttttcaaggaagacctgttgcggtaaagagaatgttaattgatttttgtgacatagctttaatggaaataaaacttttgactgaaagcgatgatcaccctaacgtcatacgatactactgttcagaaacaacagacagatttttgtatattgctttagagctctgcaatttgaaccttcaagatttggtggagtctaagaatgtatcagatgaaaacctgaaattacagaaagagtataatccaatttcgttattgagacaaatagcgtccggggtagcacatttacattctttaaagattatccatcgagatttaaagcctcaaaatattctcgtttctacttcgagtaggtttactgccgatcagcaaacaggagcagaaaatcttcgaattttgatatcagactttggtctttgcaaaaaactagactctggtcagtcttcatttagaacaaatttgaataacccttctggcacaagtggttggagggccccagagctgcttgaagaatcaaacaatttgcagtgccaagtcgaaacggaacactcttctagtaggcatacagtagtttcatctgattctttttatgatccgttcaccaagaggaggctaacaagatctattgatattttttctatgggatgtgtattctattatatcctatccaaagggaagcatccatttggagataaatattcacgtgaaagcaatatcataagaggaatattcagtcttgatgaaatgaaatgtctacatgatagatccttaattgcagaagctacagatctgatctcccaaatgattgatcacgatccgttaaaaagacctactgctatgaaagttctaaggcatccgttgttttggccaaagtcgaaaaaattggagttccttttaaaagttagtgataggcttgaaattgaaaacagagaccctccaagtgccctgttaatgaaatttgacgccggttctgactttgtaatacccagtggagattggactgtcaagtttgataaaacattcatggacaaccttgaaaggtacagaaaataccattcatcaaagttaatggatctattaagagcacttaggaataaatatcatcattttatggatttacctgaagatatagcagaactaatggggccggtacccgatggattttacgattacttcaccaagcgttttccaaacctattaataggtgtttatatgattgtcaaggaaaatttaagtgacgatcaaattttacgtgaatttttgtattcataacatgttcatgcccctctgcttcttcttggttgattattgcattaatgttactttgatcattagtagtaaccatc

SEQ ID NO: 449 - DNA, 1419 bp, Zea mays
ccacgcgtccggcacaaagaagaaaaatggaagtaccaacactctgggtggtggtgaacaagaatctggagtggcttcaatgtcaaatgaggaatatttgcacactgatacccatggtttgcagatatcagaaactgttgttgaacctcaagtaggtagatctgagggagacttgttgcctacaagttctacagatgatctacatatatcaggggggagaacaaagcaatctgatgcaggtgaattacgcaaaggaaatagcatagatgatagcactccaacttatctagatatcacgataggacatttacctgaacgcaaaactgcatccaggatcacaacagagggttctggtgagtttattactgggaaaggaatgttagctggcacatcttctgtgaccatcagtgcaatggaagctggtcgcagtgaagatggagctgattcgatatatgatccttcaggtgctataactccttatcatgattctcaaacgcaaacagtaatgccacatgagaatacctcaactggtatccttggaccaccagcgttacctgtgggagtttctacaaggtttgaagaaaagaatatcatgcaagaggccccagaaattattaaaacaggagggaaggatacagaattgaaaaggagaaattttcaaagaaataaacaagtattgaaggatacatttgatgaatgggaggaagcataccagcgggatgctgagcagagaaaagctgatgagttattcatgagagaagctttacttgaggcccagagagctgcagatatttgggaggtacccgttggtgcagtgttagtacagaatggcgaaattattgctcgtggttgtaatcttgtcgaagatcatagggattcaactgcgcatgctgaaattgtttgtataagagaagcttctaacaaactcaagacatggcgcctagcggacacaacgctttatgtgacattggaaccttgtgccatgtgtgctggtgctattcttcaagctagaatcgatactgtggtatggggtgccccaaacaagcttctgggagccgatggcagctgggttaggctgttccctggggatggacaaacaagcactcttgattcaacaaaccagagccaggccgcagggcctgtccaccctttccatccgaagatagccatcaggcgtggtgtgctgtcggccgagtgctcagagataatgcagcagttcttccagctgaggaggaagaagaaaccacagtcaccaccgcaggcccaccgccatgggcaccatcatcctgtcaagttcttcagcaagatgcaccacatgttcggcacgatattctgtttataacttcgcctctctgttttattttagcttcctaaatttcgtattatggaagtgtgaaaaatgcaaaaaaaaaaaaaaag

SEQ ID NO: 450 - DNA, 1254 bp, Zea mays
gagcaagcccagtccccaatcccaccctgccacccaaccttgcttcttctccgatagctatttctctggtttctccccaatcttcccgggtttccctgattaaagatggctgagtcctttgttctcaataccggctcgaggatcccatcggttgggcttggcgtatggcaaatacaacctgacgctgccaacgacgccatctacgctgctgtcaaggctgggtatcggcatattgactgtgcagcagcatacaacaatgagaaggaggtgggcctggctttgaagaaattatttgaagatggtgtggttaagcgtgatgatttgtttatcacctctaagctatgggctgctaatcatgcacctgaagatgtggaagagggaatcgacaccacacttcaagatttgcagcttgactacttggacttgtacctcatccatggtccaatccgcatcaaaaaaggaactagcacgatgacccctgaaaactttctccctacagatatccctgctacatgggcagcgatggagaagttatacgactctggcaaagctcgtgcaatcggcgtgagtaacttctcttgtaagaagctgcatgatttgcttgccgttgcacgagtgcctccagcagtcaaccaggttgagtgtcatccggtttggcagcaagacaagctccggaagctatgccaatccaatggtgttcatctttctgcattctcgcctttaggctcacctggatctccttggatcaatgggccaagtgtcctcaagaaccccattgtggtctctgttgcagacaagttgcagaaaacgcctgcccaggtcgctctacgctggggaatccaaatgggccatagtgtactcccgaaaagcgccaatgagtccaggattaaggagaacattgacatatttggctggtctattcctgaagatttgatggccaagttctctgaaatcaaacaggtcaggctgctgacagctgagtttgtagttcaccctcaggctggctacaatacattggaggacttttgggatggtgaaatataaaagcatacaaatttgttcagaataaaagagccaggcgaggaaacaaccacaaaaaaggggagatcgaatgcataggccccaatacgatgaatttgggggtttacgtgattgttgaacacaagcattgtgtgactaatctgtgttttgatgtggtaaatgtaattgggttagtcacaataagagataagtgcctttgccacaaaaaaaaaa

SEQ ID NO: 451 - DNA, 1205 bp, Glycine max
attcggctcgagggaggaagagagaaaaaccatggcaataacactcaacaatggcttcaagatgcctatcattggattgggcgtgtggcgcatggaaggaaacgaaatcagggacctaattctcaattccatcaaaattggttatcgccattttgattgtgctgctgactacaaaaacgaagcagaagttggagatgcgcttaaggaggcttttgatagtggccttgtgaagagagaggatctcttcattaccaccaagctttggaattctgatcaaggccacgttcttgaggcgtgtaaagacagtctcaagaagcttcagttaacgtatctagatttatatcttgttcactttcctgttgccgtaaggcatactggggttggtaatacttctagtcctttgggtgatgatggggtcctggacatagataccaccatatccctggaaacgacctggcatgcaatggaagatcttgtttcatcgggcttggttcgcagcatagggatcagcaactatgatatctttctgaccagagattgtttagcatattccaagataaagcctgctgtaaatcagattgaaactcatccatacttccagcgtgattctctagtcaaattttgtcagaagcatgggatttgtgtcactgcacacactccactaggaggtgctgcagcaaatgctgaatggtttggaacagtttcatgtttggatgaccaagttctcaaaggtctggctgaaaaatacaaaaagactgccgcccagatcagccttcgctggggaattcaaaggaacactgtggtcattcctaaatcgtcaaaactggagaggttgaaagagaactttcaggttttcgattttgagttgtctaaagaggacatggagctcattggaagtatagatagaaaatatcgaaccaatcaaccagctgtgttttggggcatagatttgtatgcgtgagaatgcccttcctaagtctgtatcatggctgtttgaccttgtgttaagattcagatttggtataagctgatctttcaggctccttagtagctcagtttatttgataatgtaaactttctttgttgatggttgaaaaatcatcttctcatcccatatccaatctcgtggactaaataagagagacttctgaatgttgttgcttaaaaaaaaaaaaaaaaaaaaaaaaaaaaaaaaaaaaaaaaag

SEQ ID NO: 452 - DNA, 651 bp, Saccharomyces cerevisiae
catttatacacgtagacaaaaagacggtatggttgataataggcgtacgtttacggcaccccaaagcttacttgaaacaaatcttacttttccgaatgatgaaccgtcacttactacaatcacagttacgcgagaaagatgtgttgatccaagcttgatagattcatttttgaggtttctaaggcatggaagtgatgatataataagacaaaaattaaacaactataggaaaggctctattaatggaaaaaataagtgtaaggaatttttgaagcaagaactatatccgaactggcaaatacggaataatataatttcattttgcgaaaaagaggcagcagagatgaagaacgagaccgatcagcagtgcggtaataataaaaagactactgcggaaccacttatagacgcaagaattgatccttacgctgcaagagaaagagcggagaaacaggaagctcaatataaggattggacgaaggtgacagagtgggtggcaaataatagaaaaatagaacaaattttaacttctacaacagagggcattttaaggcaaaactgcgagcaaaataatgactacttgaaggagtttacgcaattctgcaaggacaacagttgaacgccctattcttctagtccgctgaaagatta

SEQ ID NO: 453 - DNA, 428 bp, Saccharomyces cerevisiae
gtgaactgcaacgttatataaactaaagtgccagaataaaaataaagaaaggcaaagggagactatccgtcttcgaaacaagtcaaaagagcgaaaactaatgagccaacaacaaggttactaccaacaaggacccccacagcaaggttattatcaacaaggtccaccacaacaaggttattatcaacaaggtccaccgcaacagggttatcctcagcagcaaccagtctatgtccaacaaggtcaaccaaaggaggaaagctgcttggacagttgtttaaaatgtttgtgttgttgtttcttattagaattggtatgcgataactgattcgtttgttcaagaagtggtcaatataaaaaacgaaatcacatagcctttcatctatgctgcgaaagactgtataattacttttaagcaaaaatgtata

SEQ ID NO: 454 - DNA, 614 bp, Saccharomyces cerevisiae
attaaattagataattgcttctcatacaatgtgatttcttacaccgcatgtgataggatactagtacgacgaataacttcaaattttatttcaacaacagatgaacgatggtcaattcttgttccaacgtaacgatcccatcatattatatacatttttgcttaaaagtaattatacagtctttcgcagcatagatgaaaggctatgtgatttcgttttttatattgaccacttcttgaacaaacgaatcagttatcgcataccaattctaataagaaacaacaacacaaacattttaaacaactgtccaagcagctttcctcctttggttgaccttgttggacatagactggttgctgctgaggataaccctgttgcggtggaccttgttgataataaccttgttgtggtggaccttgttgataataaccttgctgtgggggtccttgttggtagtaaccttgttgttggctcattagttttcgctcttttgacttgtttcgaagacggatagtctccctttgcctttctttatttttattctggcactttagtttatataacgttgcagttcaccatcggcctcgagcaaaaaaaaacagtagaaggcaaag

SEQ ID NO: 455 - DNA, 584 bp, Saccharomyces cerevisiae
aaggatgaaaaagaaaaagaaatgcaggaaaaatgaggcaaagtaagccaaaacttatagcactcataagacggcaaagttcccccaagctccacccaggatgtcaagcactaatggaaacgcaccagcgacaccttcctcggatcaaaatcctctccccacgaggttcgaagtggagctcgaatttatccagtcactggcaaacatccaatacgtaacgtacttactcactcaacagcagatctggaagtctcctaacttcaaaaactacttgaaatacctggagtactggtgcaaccccccttattcgcaatgcattgtgtatccaaactgtctcttcattttaaagctgttgaacgggttcatggagtcggcgatcgttaatgaagatggcctgctggaagggctagacgagctgcccaagatcattcaattacaaggcccgcaatggatgaatgaaatggtagaaagatgggccaactgaacacacctaattataactacattcgcacgcattcatatatctattttatacactcatgaatatatatacacacacacacatatatatatcacatatatac

SEQ ID NO: 456 - DNA, 953 bp, Saccharomyces cerevisiae
gctaacatagcaaaattagatgaatgatgagtcctaatgggatctacactttgctcgagaagcggctggtggctgcggtaaaaactagaggactcacactatgcagcatattaaacatatgaggacagctgtccgtttggctagatacgctcttgaccacgatgagacaccggtagcttgcatctttgtacatacgccaactggccaggtgatggcttatggcatgaacgatacgaacaagtcattaactggagtagcacatgctgagttcatggggatcgatcagatcaaggcgatgttgggctcccgaggagttgttgacgtgttcaaagacattactctatatgttactgtagaaccgtgtataatgtgtgcatctgctctcaagcaattagacattggaaaggtggtgttcggttgtggcaacgagagatttggaggcaacggtactgtcttgtcagtaaatcatgatacgtgtacattagtgcccaagaacaatagtgcggcagggtacgagagtataccggggatcttgaggaaagaagcaataatgctgctgagatacttttatgtaagacaaaatgaaagggcgccaaagccacggtccaagagtgacagagtgttggataaaaacacgtttccgcctatggaatggtcaaagtatcttaatgaagaagcattcattgagacttttggtgatgattacaggacttgttttgcgaataaagttgacttgtccagtaatagcgtcgattgggatttgattgactcccaccaagataatataatccaagaactggaagaacaatgcaaaatgtttaagtttaatgtacataagaaatctaaggtttgacgaaaaaaatcagaacatcataaaataatagcaacatttacatatttttatatagatatttttctttttttaaatttctctgttaaatgtgatcagataa

SEQ ID NO: 457 - DNA, 821 bp, Saccharomyces cerevisiae
gtttctggtttaaagctattcgttcattgcaacgctcctttctgctatcctttcgcaaagtggcaagtactgaaaaccgagaagaataaataatattgcgatgagtttatactttacgacattatttttattgctcactgttgaggtggtaatgctcttcatcttcgttttgcctttgccattccggatccgtaggggtatttttagcacctataaccaattgacagcgaagcagcaaataaaaactataatctttataacgggttgtcttgttggcctgttgtttattgattcatggaaaaggtctcaaattcgtgtttcattataccacaacgacaacagtggctcaatcgggtcatctgctgtaactccaatacaggcactagcatcaagagcgtacaatcaaagaaatatgtatatttccgggttcatattgtacttttctatctgtatcccaactgtcatgtctattgtcaagagactggtgaaataccaaggcttaatcaacgaacaagaaaagcaaaaattgaacaaaccttcctcaaacagcaagaaagactcaaatgaagctgattccaccaaacttcaagaggaactaaggaaaaagcaaatttctctggagggcctacaaaagcaagtcaaaaacctggagaaatattttgatgagaagaatcaacctggaaatgtagcagctgctgaagcttccaagaaaggaaactaaatagatatatttatgtataaatgtatatacgtgttacctctggtgctcatacttctctggtcgcgacgcaatacgaaaatgctactgaaataaaaagcaa

SEQ ID NO: 458 - DNA, 557 bp, Saccharomyces cerevisiae
ttttttttccgcgcgcaagcacgttacccggaccccgtcttagcacacgcacacgcacacgcagcgctcacagaccagcgaaacagacctgagagccacgatgcagcacacgcttacccggaccgcctctctgccagaacgctcgagcagcgcccacagcgccgctactgcgttacccgcacttcgccgcccgccagacagctgcgagactctcgtcccgctactgtgtatcttttggttcgtcttcgttagtatgagcccgctcccgccggctcgtgccaacaaatcagacaacaaaggcttaatctcagcagatcgtaacaacaaggctactctactgcttacaataccccgttgtacatccaagtcgtatacaaatgatttatccccactcaaaatgacattgctatccgccggcaagcacccaaggcctttccgccaagagcaccgttgctagcctgctatggttcagcgacgccacaaggacgccttattcgtatccatctatattgtgtggagcaaagaaatcaccgcgttctagcatggattctgactta

SEQ ID NO: 459 - DNA, 926 bp, Saccharomyces cerevisiae
gtgtcctctattgtttatctcaacagaacgcacacattcttgaaacttgctcacataacataagctggagtgacatagcatttatatatatacaagggaaatggtcaaagctgttatttttaccgatttcgacggtaccgttactttggaagattctaacgattatctgaccgatactttaggtttcggtaaggaaaaaagattaaaggtcttcgaaggcgtgttagatgatactaagtcttttaggcaaggtttcatggaaatgctggaatccatccacacccctttccctgagtgtatcaagatcttagaaaagaaaattcgattggatcctggtttcaaggatacattcgaatgggctcaagaaaatgatgtccctgtcatcgttgtttccagcggaatgaaaccaattatcaaggttttattgaccagattagttggacaagagtctattcacaaaattgacattgtttccaatgaagtggaaatcgatgcacatgatcaatggaaaatcatctataaggatgaaagtcccttcggacatgacaaatccagaagtatcgatgcttataaaaagaaatttgaatctaccttgaaagcaggtgaacaaagacccgtttacttttactgtggtgacggtgtttctgatctaagtgctgcaaaagaatgtgatttgctatttgccaaaagaggtaaagatttggtcacttattgtaaaaaacaaaacgtcccattccatgaattcgataccttcaaagacatcttggctagcatgaaacaagttctggctggtgaaaagacagtcgctgaattgatggaaaattagtgcaagactcttacgaaatattaaagtttaataccgtgtaactgcctcttacatatgtatgcatatatacgtacgtactatatttttcttgtatatcttt

SEQ ID NO: 460 - DNA, 1679 bp, Saccharomyces cerevisiae
gagcttaaaggtaaaggaaaaagatggtaggatgataggtaggatgaagcggtatgaaagtggaagaagcacaatatagcacgtcgaaacagtgctaatcatgagcgatgacttgttttctaaggctttggagaatcccgaccaggacttgaacgtggaattgcccaaggatgatgttgatttaggtcttttaggtgatggtgggaacgagaggaagaccgatgaaccggtagcagacgcagaaagatcaacaggcctaggatccggctcttctgaatccgaatcagattccggttctgattctgattctgattctggctcttcaggtagtgaggatgattctgcagatcaggacgttgaaggagaggacgaaggtggtgacgcgattgaaaatgaagacgaagacgaagacccttcaccttccggtcctatactatcgaagaacgaaatactagaggaaactgttcctgaactaccggaagattatgaaatttcagaaaaaacgatcatcactcctattggtgttttgaagtctgcatttgaaaataatataatcattcacgccacgatgtcgggcgaaaagcgtgttttaaaagagggttccattttctgtctcgaggatagaactttgatcgggatgttgacggaggtgtttggacccttgcaaaacccattttatagaattaagttgcccgattcaaaaaaaaacttattcgatgaattaaaagtgcgtttgggtgagaaagcctttatagtcacccctgatgcccactggatagatactttcgagttaaagcgcaacaaaggtactgatgcgtctaatgggtacgatgaagaattacctgaagaggaacaagaattttccgacgacgaaaaagaggcccttttcaagaaaatgaagaaacagcaacggcaacgaaagaaaagggacaaccgcaaactagccaacgatagtgacaatgtcaaggtaaagagagctcggcagcccaaggccaacagtttacctaaactggtaccgccgttgggcatgagcagtaatgctccgatgcaacatgggtacaaatcaagaaacgcacgtgaaaatatcaagcgtgaatccagtgctacctctaatcggaatggctcctccccagtgccaatcacacagcaccaccaacaacagttttctgcaaataattatcccttccctcaacaaccaaacggtatgccttatccaccatactcacctttccctcagccgactaacttccagtatccacctccaccatttgggcaggcgacaccggcccaattctccaacactgttccatatggtagcttacctcccgcatacaacaatatgtcgccgccaacacagcagtcgttcatgccaatgacccaaagtcaaccgccacttccatatggcgtacctcccatgaatcaaatgcaaaacccaatgtacatccaaccgccacctcaagcacctcctcagggaaatggtaatttccaacaagtaatggaattacatcaaatacttttgcagcaacagcaacagcaacaccagtatcagcatcagcatcagcaagatccaagaacctagagtcacgattgaaatatttaataataaatgctatgtatcatagataaactagaaagaggcaagaaaaatttaacaagtttcttaattgaatattatttta

SEQ ID NO: 461 - DNA, 1139 bp, Saccharomyces cerevisiae
acggatatattgatagtcggatactacgtggatatggatacacatgtaaacggttgtgttaccctaaagaaacggaggtcagttaacaacacttttacagatgtcatttcaccaacagttctttaccttgaataatggaaataaaatccccgcaatcgccatcattgggacaggtactagatggtataaaaacgaagaaacggatgctaccttttcgaacagtttggtcgaacagattgtttatgctctgaagttacctggcattattcacattgatgctgctgagatctacagaacatatccagaagttgggaaggcacttagcctcaccgaaaaaccaagaaatgcaatattcttgacagacaagtactcacctcaaatcaagatgtcagattccccagcggatggactagatttagctttgaagaagatgggcactgactatgtcgatctataccttttgcatagcccatttgtttccaaagaggtcaacgggttaagtttggaggaagcctggaaggacatggagcaattgtacaaatcaggtaaagctaaaaatatcggtgtttccaactttgctgtggaagacttgcaaagaattctgaaagttgcggaagtcaagccccaagttaatcaaattgagttcagtcccttcttgcagaatcaaacaccagggatctacaaattttgccaagaacatgatatattggtagaagcatactcgccactaggtcccttacaaaagaaaacagcacaagatgactctcaaccgtttttcgaatacgtgaaagagttatccgagaaatatatcaaatctgaagcccaaattatcctacgttgggtgaccaaacgtggcgtgttgcctgtaaccacctcttccaaacctcaaagaatttctgacgcgcaaaatttattctctttcgacttgacggctgaggaagtcgataagataacggagttgggcttggaacatgaaccgctaagattgtattggaataaattgtacggtaaatacaactacgctgctcaaaaagtataaataccggataatttatgtacgagtcatatttgttttgtataactttattaatcgactttttttgtcaggtttatcaccccgttacccatcccgccacttt

SEQ ID NO: 462 - DNA, 512 bp, Saccharomyces cerevisiae
atttaagttagaaatcggcacgaaaaaaatttgacagattacgagagtccagccaaaatatgagtatattactatttccccttggtgaaagaaatgaaagatgttattttttaccggcttagtaatactgagctacttacttgggggaaagaaagattggctacttattatgtatgaagcctcagattaccttgaattcctcaaccgtttgagcagtatgctcttcaaattcgaactttttgaacatctttcctccacattcctgattttttcacattcaaaacgcgctgtgaagctgttagaaatttacagatcgaggcatatttctatatataatgtatttttattaagacacccaaagtacttccaatctgtagatattgcactttatctgaccagaagccagacttgaacagttacatattgtgctttgcagtcgttaaatttcccgaactgttttcgtatttttttttcttttcctcttttccactggatcagatcaaaagccgact

SEQ ID NO: 463 - DNA, 2717 bp, Saccharomyces cerevisiae
atattcaattgcaaggtgacgtacttcagataaacactttattgtaccatcttaagcggctatataaagtgtcatatacacccttcaccaaatacgcaacatgtctgaatatctagctcagacgccctgcaaatttactatatggtcaagcgagattgatcttatcagaacaaacctgttggtgaacgctcaccctttaagcacggttgggcgactacttcaatatatccattatcaaatatacaagcaattaagagctatctatcaaccagaggaacagtgcacgaactcggaaatacctcacacacccttaaatagtatcaacacttacttcctaagttacgaaggcagagagttatctgcaacgtgtttattaaaggacatcacgtcatctagccacccagattcgaaccatttcataagactacaactggaaaagcgtacttctccttccggttcagcatttgacttggaatatgatatggagggcgaatttaactcgatgaatattcaatttgagataaatacactatcttctcaacgtatattcaattccatggaaccaaatttgcctattggcactacattggctagattagagaaactggcattggaacgtataaaggattttgaaaaatcagcagggaatctctgtggtattaaagaggaccattcagtgtctgatttgcagggatttataataaaggggaaacagacacccatgtttttaaattatggaagtgattctgattactataaagacttgaacctggtagatttgataggcattgattttgccccggcacacaattcttttttcacatttttgttcaagatgaatcacgaacagaattcacatatcgccaacgatgaagagagatttgtgttggaattcatatccgatgccacattatctataactcaaatgaatgttaagcccgataccacggtaaaacaagtgaaagatttcatatgttctgtttacactcactcattaaacttgaggagaaatgatatcaagttgatttataagggacagttgcttcatgaaaataattttgcaggcaactcttcaaagatcagcgagtacattaaagagccacatgaagtgaaggtccatgtacaaatcaaccaagagtatacagaatctgggcctggattttggaatgaagtgttcaacaatccgaatattttccaattcatgcctccagatacaaggtcacagtcacctgttagtttcgctccgacgcaaggacgatctcctgctgcaatacgtggcgaagaacggggtataccatacgtaaccgaatctggaaatgacatcgtgcccacagatgagctttataggaaatgcattatcaacggggatgaagtagtattcattcctgttagcgaactaaatccacaatcgagctatttgtccgtgatcaaaggcgattacggtgaaattaaaatccccatatctagtaatgactacagaattaatggcgataatattttgctatcaccatctgcgatagagcagttagaatctgctttgaacttcaaaatcgagagaccacgggattcgacactcttgcatccgtctggtgagcatgttcgagctgcagataatacctcttcggcaaatgataataatacagttgagaatgacgagtcagcgtggaatagaagggtagtgcgtcccttgagaaacagcttcccgctgctattggtattgataagaacattttacttaattggctataattcattggttcccttttttattattttggagtttggaagcttccttccctggaaatatatcattttactaagcttgcttttcatttttaggactgtttggaatacccaagaggtgtggaatttatggcgagactatctccacttgaatgaaattgacgaagtcaagtttagccagatcaaggagttcatcaattccaattcattgaccttaaatttctacaagaaatgtaaggacactcaatccgctattgatttactgatgatacctaatctacatgagcaaaggctatcggtctattctaagtatgatattgagtacgacaccaacacccctgacgttggacaattgaatttgctatttatcaaggtgctatcgggtgagattcctaaggacgcgctagatgagttgttcaaagagtttttcgaattgtatgaaacgacaagaaacatgaacacactatatcctcaagactctttgaacgaattgctgctgatgatttggaaggagtcccaaaagaaagacatcaatacgctacccaagtacagaagatggttccaaaccttgtgctcgcaaatagcggagcataacgtccttgatgtcgtactcagatacataattccagacccggtaaacgatagggtgataaccgctgtgataaagaacttcgtgctcttttgggttacactactcccctatgtgaaggagaagctggatgatattgttgcacagagagcaagggaccgtgagcaaccggctccatctgcccaacagcaggaaaacgaagatgaggccctcataatccctgacgaggaagaacccaccgccacaggtgcgcaacctcatctctacattcctgatgaagactaattgcaatgcgatgtggccacgttatataatgcgtttaaggtgtacgaaaacccatgctgttctggcccgtcgggttttctgacaaattgtcctttaggga

SEQ ID NO: 464 - DNA, 860 bp, Saccharomyces cerevisiae
agtaaaatataatcaaccataaataggagaatacaggcggtgcttacagcttgatattttgttaccaagtcaagatctataataataactcaatacatatatgttaaagttaacaacaacatccgttactttccacgtactaagatatttccaacttggcttatctgtaactaacttgttgttagctagttttgccataatcacaaactataaagtggatcgaatccttagattgagcttagctgtttcaatcatatcttcagtttattttgggattgtgagatttttgcctgttctgttaatattcgtgatggaaattgttcagaccgtcctgtggtttaccgctttcgtaactctagcttcaaaatttggttctatgtcctgctcaagtatgccacggggtataaactttgattattcaggttcttgtaagattgctaaaatagatattttaccagaagccgttttattcatactatttctcgctaccacatatgcttcttatatcacagtcctatctcaagctaaggaaaatgggtcaagcacaagatctgttttgaaggcttgtgtgaaggcattacgtgataccgtggaccgcttggagaccagtctggaagagagtgagcctcttttagatcttgaagttcaggaagatgcgaggactgaaaccgaaagcattgaggattcaactgatagtgaggataatgctaacatcgaacaagagaaagtgattgatggttcaattgagcattcttcatgatgaaccaaatgtcttgtagtgcatgctgtttctgactttgcttaatggatttttttagttcgacgatgttccgtatattttagaggcacacactttcact

SEQ ID NO: 465 - DNA, 533 bp, Saccharomyces cerevisiae
tataaaaagggactttagcataaaataaagaacttcgtgcagtacttatacgagcattcgcataattatacaaatagacaaaacctcagaaggaaaaaaaatggtatctcaagaaactatcaagcacgtcaaggaccttattgcagaaaacgagatcttcgtcgcatccaaaacgtactgtccatactgccatgcagccctaaacacgctttttgaaaagttaaaggttcccaggtccaaagttctggttttgcaattgaatgacatgaaggaaggcgcagacattcaggctgcgttatatgagattaatggccaaagaaccgtgccaaacatctatattaatggtaaacatattggaggcaacgacgacttgcaggaattgagggagactggtgaattggaggaattgttagaacctattcttgcaaattaagggcagacaaagttttttccatgcacacaggtttataatgagcttatatatatgtatatgtatatgtatacaagcatgtgtttgtatttacaggaaaaaa

SEQ ID NO: 466 - DNA, 1623 bp, Saccharomyces cerevisiae; identical to SEQ ID NO: 323

SEQ ID NO: 467 - DNA, 1523 bp, Glycine max
caacatgcgactttgtttttttaacgatgaaaacgaagtgtattgagtaatactccgttccctggttcctccatcgcgaaattagggttcgctcacttgtcttcaatttcccagattcacctagcaccatccataaatccccctattaacgtgtctttcggaccgatttttctacgtgacgcatcgcaattcttcagcggtttcgtttagggaacccgcgaaaccgaatcagatagtgcggcacggaaactaggaattaaagcaatggcagaagatctggtgctggatactgcaatcagagactgggtgttgatccctctctctgtggttatggttctcattggtgtgctccgttactttgtttctaagcttatgcactcttcacaaacccctgatgccaaaattgttaaagaagggcaagtgattgttagagctcggaatttacgtgctggggcgaatttcattccatccaaggcatttcgcgctcgcaaaatttatttctgtaacgaggaaaatggtctgttgtttgttccaaagggccagggccagaatccgcaagcacagatgttctctgatccgaacatggccatggatatgatgaagaaaaacctttcaatgatcattcctcagactcttacttttgcttgggtgaactttttcttttctggatttgtagcagccaagataccctttccattgacacagaggtttaggtcaatgctacagaatggaatagaccttagcaccgtagatgttagctatgtcagcagtcgctcttggtacttcctcaatctgtttggattaagaggattgtttagtctcatattgggtgaagaaaatgctgtagatgatacacaacgtatgatgcaaatgggtggatttggatttgatccttcaaagggtctgagtgctgagaaagacaatcttgacataacccagcatgactgggccttaccaaattttgagcagcgtgctgaagctgtgttgaggaaagttgccagttaaccatgttatggagtaggaagcttcattgctagcattagcaggatacacttactttctattgttgcggtaggaggtgtacctttttgcagaaaagatatcaaagatcttgttgagactgtagtcttgagactgaacattttgcaactatcagaaaacattgttcggttttgttgaagctagaactgaaactattcattcttgcttatttttctgaatgaccattgccataaaaagcatgaaggcttcccaggaaacgttgagtcctgtaatgtgtttcaaggcctattcaactattctatctgtatcccacatcccactcctagaattgtcccctaatatgttaaattaagaaatattacattcgcatctcttattctgcttttgttgcagaattagaatgcaggtgaggtgcacttgattataatcagatgctaaaaaattgtgatgtgatgtaatgcatgctcaaattaccaaaagccgaaagaatgttttaaaatttgaattgagtgattaaaaaa

SEQ ID NO: 468 - DNA, 814 bp, Zea mays
attcggcacgaggcaccgagctgccctgctacacggtcccctgccaagatccatcttcccggttacgccgcctgatcgaagtgaacaagcaaggaagagccatggcgagcgagcacgcggcggggggcgaggctaagcatgaccagaagcagagcctgatggacaaggcgaaggggttcgttgtggagaagatcgcgcacatccccaagcccgaggcgacgctggacggcgtgacgttcaagggcctgagccgggagtgcatcacgctgcacagcagcgtgaacgtgtccaacccctacgaccaccgcctccccatctgcgaggtgacctacacgctccggtgcgccggcaaggaggtggcgtccggcaccatgccggaccccggctggatcgccgccagcggctccaccgcgctggagatccccgccaaggtgccctacgacttcctcgtctccctcgtcagggacgtcggccgggactgggacatcgactacgagctccaggtcggactcaccgtcgacctccccatcgtcggcaacttcaccatcccgctctccacctccggcgagttcaagctccccaccctcaaggacttgttctgatctagtagtagctcgcttgccttctgttctgtgcgggcgcgcaccagcgatctgtacgacgagcttttgcaaataaacgacgcagctcctctgttctatatatctcagtgaatgcctaagctaaggggatggatggtttaataaataaagagctggatttcattcaaaaaaaaaaaaaaaaaaaaaactcgagcatcatcagaggccgcatc

SEQ ID NO: 469 - DNA, 765 bp, Zea mays
gaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgagaagaagcaccaccacctcttcggctgaccgtagtaccggccggcgcgcgaccgagctagctagctccggcgcacacaaccacacacctgtttaattctgtactgcatgcgtgtgtaatttgatggttcacaataatgagtccctctccggaccttggtagctgcttgcttgtggtgagtgagagtgtgagactgagggagaagaggtggtgggcgtggggctacgtcgagagaggcgtgttcctgtaatcctgtactcgcttcgttttctctgcatgcgtctataattgtgttcaataataagtgagagcggtgtgatgtgtgggctc

SEQ ID NO: 470 - DNA, 836 bp, Oryza sativa
attgtcacttccatctcattctcctaattgtcatcactagcttctagctagcttaattaattaattagccatggcggaggagaagcaccaccaccacctgttccaccacaagaaggacgacgagccggccaccggagtagactcctacggcgagggcgtctacacgtcggagacggtgaccaccgaggtggtcgccggcggccaggacgagtacgagaggtacaagaaggaggagaagcagcacaagcacaagcagcacctcggcgaggccggcgccctcgccgccggcgccttcgccctgtatgagaagcacgaggcgaagaaggacccggagaacgcgcacaggcacaagatcacggaggagatcgcggccacggcggcggtcggcgccggcggctacgccttccacgagcaccacgagaagaagaaggaccacaagagcgccgaggagtccaccggcgagaagaagcaccacctcttcggctgatcgacctcatcacaacgtcgccggcggcggcgacgacctcgccgtacgtcgccggccgccgtgtcgtcgatttgtgtgtgtaataatttgtcttcttctgcatgcgtggtgttgctgtttttcacaagagtctccggcctcgaccagtgagaggctgacaggtggggccgtgagttcagcttgtgttgcttgattttctctgcagccttgccctctgtgtgtccaaataagtggtgtgcatggctctctccgtgtcatgtatcaatgtatttttatctgtactttgtacaagtgaagcaatatctatcgaaccttgactttctccaaaaaaaaaaaaaaaaaaaaaaaa

SEQ ID NO: 471 - DNA, 801 bp, Oryza sativa
cgatccgtcacgacgtgcgcgcgcgcgagcgagaggatgagcgcggcggaggagagaggagatcggcaggagcgggacgatggggaaggtggagaggaggagcggcgggagcgaggcggggtgggcgggctggtggacagggccaaggggttcgtggcggagaagatcgcgaaaatccccaagcccgacgcgacgctggaccgcgtctccttcaagggcgtcagccgcgagtgcatcacgctccacagccacctcgacgtcaacaacccctactcgcaccgcatccccatctgcgagctcacctacaccttcaagagcggcgacaagtgcgtgcattatttacataattgttagccggcgcatccagttagttcgtgttcaaattatccgaagcaaattaaaaaagagtcagctggctggttctcgcgcgatttgcgtcaatttttgcagggtgatagcgtccggcacgatgcctgacccagggtggatcgcggcgagcgggacgacaaatctggagctgccggtgaaggtgccgtacgacttcatcgtgtcgctgatcaaggacgtgagcggggactgggacatcgactacgtgctggaggtcgggatcaccatcgacctccccgtcgtcggcagcttcaccatcccgctcgccaccgagggtgagatgaagctccccaccttccgggacctcctcttctgaaaacctttctgattcatcggggcatagcccaagtggtttgttaatttaacttgcgtgtaataaggaatgtacgtacggtgaaaatcttgttgcagcat

SEQ ID NO: 472 - DNA, 795 bp, Zea mays
gcgcacggctcacgttgtccgcctcacgtaaaggtcggtgccttcgtctcctatctctcctcgcgcagttccacttcccatttcctccttcgtccgcatcagggacacactgcctccgcatgcggcaagatcctccctcattccccaaacatgagaggagcagaggaggagagatctggcgccgccactgatgcgggaggagaggaggagaaacgggagaggagcgtcggcctgatggccggcctcatggacaaggccaagggcttcgtggtggagaaggtgacgcaaatccccaagcccgaggctgcgctggatcacgtctccttccagagcatcagccgcgagggcgtcgagctgcatagccacgtcgacatcagcaacccctactcgcaccgcatccccatctgcgagatcacctacacgttcaagagcgccggcaaggtgatagcgtcgggcacgatgcccgaccccgggtggatcgcggcgagcggcagcaccaagctagacctgcccgtgaaggtgccgtacgacttcatcgtgtcgctgatgaaggatctcggaggggactgggacatcgactacatgctggaggtggggctcactgtcgacctccccgccattggcgcctttactatcccgctcaccaccgagggcgagatcaagctccccaccttccgggacctattgttctaagcaattcagatgtttggtgtatgaatcgatttgttttcataccataatcagtgctgatgtggatttgcaaaaaaaaaaaaaaaaaaaaaaaaaaaaaaaaaa

SEQ ID NO: 473 - DNA, 748 bp, Zea mays
gaacagctgtcgatccaattgtcacttgctctccctccaacaagctaattaaggccggtcatccctcttctagctcgtttcattatccatggcggaggagaagcaccaccaccaccacctgttccaccacaagaaggacgaggagcaggaggagcagctcgccggcggcgggtacggcgagtccgccgagtacacggaggccacggtgacggaggtcgtgtccacgggcgagaacgagtacgacgagtacaagaaggaggagaagcagcacaagcacaagcagcacctcggcgaggccggcgccatcgccgccggcgccttcgcactctacgagaagcacgaggcaaagaaggacccggagcacgcgcaccgccacaagatcgaggaggaggtcgcggcggcggcggccgtcggctccggcggcttcgccttccacgagcaccacgagaagaagaaggaccacaaggacgccgaggaggccggcggcgagaagaagcaccacttcttcggctgattgatcctcccgtatcgtcgtccctccccgtgtgctacgcgtgcgtgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttacttaaaaaaaaaa

SEQ ID NO: 474 - DNA, 2092 bp, Zea mays
cgtcagcccctctctctcccggcgtggggtggccatagcttcgctgcctccacttgtcttctttgtttcaccatcagttcaattcagtttctcgccggtcgccgctggcttgctagttgctactgcgcgcacttcagctgcccgctgttgtaccgcggactctacctcatcattcgccttgctgcctccgccgcctaggtcgcgcaggttcggacgccatgaccgcgacgccggcggtgatcgggctgagcgcccgcggcaaccgcctcctggccacctcattcggttccgctgagctcgctcccccggacgcgtacccgtcgcggcagttcgccgccgcagcgcccaagctcaccgtcgtggcgcaccgcgcctccgcctccgcctcctccccggccgacatcgggggcgccggccacgcgcgcgcgcacgccatccgggcgctcaggaaccactccgcgccggcgctggccccgcctcctccggctgacccggctccggagctggactccaagttcgagttcgagttcgagtcctcgctggaggccatcgtgctgctgcagcgctccatgctcgagaagcagtgggagctgcccttcgaggacgacatctcctccacggaggacgaggacgaggacgagaggtccacggtggtggtggcgcggtcgggcgtctcggcgcggcagcggcggatgagcgggcggcggcggggcgctgtcgttggccggaagagcgtcaccgtcagcccggagctgatgcagagccggaaccgcatctacctccggggcaccgtcagcaaggacctcctcacgcacaagcaggtcgtccagctctccaggaagatcaaggacggcatctggcttcagcaccaaagatccaagctgaaggagaaactgggcaacgagccgtcatacaagcagctggcgcaatcgctgcggataccagctcctgagctgcgagcgaggatgcgcgagtcgtttcttgcgagggagatgctggcgatgagcaacacccgtctggtgatatccattgcccagaagtacgacaacctcggcgtcgagctgccagaccttattcagggtggtctgatagggctgctccgtgggatcgagaagtttgatgcctcaagggggtttaggatctccacctacgtgtattggtggatccgtcagggggtttcaagagcattggccgacaactcgagatcgttcaggctccctacttatttgcacgagaggttggtagccattcgcggcgcaaagtacgcgttagaagaccaaggaattgctccgacagtagagaacatagcggagtcgctcaacatatccgagaagaaagtgcacaacgctacagaggctgtgcacaaggttatttcactggatcaacaggcgttcccctccttaaacggcctacctggggatacactccatagttacatagaggatcaaaacgttgcaaatgatccgtggcacggatttgaggaaaggtacctcaaggaggaagttaacagtcttataaattcaactctcaacgagcgcgagagggacattattcgattatatcatggcataggaaagcagtgccatacatgggaggatatcagcagacaattcgggttgtcgagggagcgcgtgaggcaggtagggctcgttgcgatggagaagctgaagcatgctgcaaggagggaacatttggatgcgttgcttgaggaatactgagtgagatgttcttcgcttgagtcggttaattccaccgttgcagtggttgtatatactcggaaacataggggggcaggcacatcatccttgaaaggcttcactgccactcactcactctgcagataactatacatgtacatctgtgacgatcagtaggcatgcatagttaaagcatctgtggctgcaaaatcgtcaaggcgatccaacaaaaggagaaccttttttttggtcttggaagctttacaaagtgtgatgtggtatgtatatgcaaatgtaatgtatcagtaattcagtagagcaataacgtttatgtcctggatttgtattcttgtccagttacatagaaggaaaaaatgcttacaactgcaaaaaaa

SEQ ID NO: 475 - DNA, 2053 bp, Zea mays
ctcgaggccggccgggagcccagcttgcctgccacctggtcttgaccctctcctggataggaggagcagcagccagagggacatcaaactgtgctgcctgcgtgtgtgtcttctttcttgcctctcccttcttcaacctttgctagcttgccagggagggagtccatgaattccagcagaagcctcctctcttcgcccctctttgctagctcgtctccaaacttcaggagcagtgcttccgtctcctcctccccatccccatcccgcaccacagcagttccaatgatacatgacaccagcagcagcagagcatccacggcgtgccactactcgccgtcgcttgtggcagaggagcagcttcacggctccaaagacaccttgaccttgaagggcgagaaggctttgctcgagttgcttctaggcatggctctggaccagcacgttgacggcaggaagctcattacccaacaggaggctgaggatagtgatttcgagagctatttgagagaagcaacaagccgagtgctttaccagccaacattcatgtacggagcttctgaatttattagcagtgaagaggatgatgatgattctatttcggagagctcttcagcatcattggccaaaccagctggaactttggatcttggcaagctgacagaggaaccacagttggatgtaccacagcctcaccgccgcagtgtggatccaaaccattcgtatgatcaagtgtttattagatccactcggttactggagaggagatccaagaaacgcaacggcggccacagggctttggataatggtgtggcgtgcagtggtgtgaactcaaagagaaaagacaagtttggcagagttcttgatccagacgagccttttaggttgtttctacgggatcgagagacgacagagttcttgacagcgaaagaggagaaacagatgttcagtcaaatacaggatcttatgaagctggaggaggctcagcgtaacctgcaagctcagtgtggtcgtgaaccaacagttgaagagtgggctcaagccgtaggaatgagctgcagggagctgcaatcctgtgtgcgcaccggaagacggtgccgagagaagatggcccgctccaacttccgccttgtgatacatgttgctaggaaatatgaaggatgtggccttgacattcaggacctggttcaggatggatgctgtgggttgatgaaaacctttgagaagttcaacccgagcaagggatgcagattcccgacctacgcgtactggtggatacgccagtcgatcaaaaagtccatcttcaagaattcaagactaatccggttgccggagagtgtgtatgcacttttgaggaaggtgggcaaagcgaggatggaatgcataatggacggggagcagccgacgaacgaggtggtggcaaggcgtgctggcatcacgattgaaaagctggcgaaactgagagcgaaaaccaggaaagtacggtccatgcaggatcgagtctggtcagacgacggtgtgacataccaggagatcaccgaggaccccaacattgaaggtcctgaggtgagcgtggacaggctgatgatgcggcagcaggtgcgcagcttcctggcggggatcctgagcccccgggagaaggagatcatcgagcaccggttcggcatccacgacggccagcccaagaccctgcatgtcatcggcgacatgtacggcctgtccaaggagaggatccgccaggtgcagaacaaggccctggacaagctcagaaacagcatctcagcacagggcttccacgtctactttgatttgctaacttaagactcttcaacacgcaaacattacatgtacaatgacattccattctgccaatgggtatattatgtatagatagaccaagaattcatgtttttttcctttcccttttgccatttgacattcattcatccttgtactcaacaatggatactcatacatggttgtttgaggagcaaagcttactttaaatgtatggatgtacgtttaagtgcaaaaaaaaaaaaaaaaaagcgccctc

SEQ ID NO: 476 - DNA, 1875 bp, Zea mays
ccccaccgtcgcctcgctcgacctccacctctctttcctcccggcagcaatggaggcggcacccaggtgaggcgagcaagcagccagccctggctccccgatggcgtgcctggcgccgcagttcaagtgggcgccgtcggccgccgcccacatgccttcctcgtcctcgtcctcgtcctactccaggtgctccgcgctccgcgtccactgcgccgtcacctccgccgctgtcgtcgaggaccgcaccaacggcagcgcggcgcagctgaggctcgcttacgcggctccggcgattcagagaaactttgaggcaactctggcatcagaagcacttctaaatgaagaggcggtagtagcagcggcagccgcagaggctgttgctcttgccagagcagctgccgaagctgcccaagaagttgttcagatagtacaaagaaacaaccatcagccggtaattagaccaaaaaagtgtgtggacaactacttggcaaatgaaatccttcgcacagagatgcgatcgagcagtcctgacatgtatgctaataatcctttgatggagtatctggactcttatggtatcatggatgctgaagatgaattagatgcttatgcacagtatactgagaacatagctgtgaaatctgctcgtcaatctgagagaaaagctaggagaactagagcagcaataaaagctagcacaaccctccatgcttcacaaaaggttgcattatcctcaaagaagaagcggtccaagggttcctcgtctagtatgaatcctttaggttcgttgtggaagatgaccggtaggagacttcttacagccaaggaagaggttgaattctcagaaggtattcaggatcttttgaagcttgaggcgatccaagctgagcttatagagtacaatggcggtcagccaaccttctcgcagtgggcaacagcagctggagttgatgagaaaactttgcgcaagcgcttgaattatggtatttattgcaagaacagaatggtaacatctaatgtgagacttgtaatctctattgccagagagtttgaaggccctggaatggacttttatgatcttattcaggaaggaatgcagggccttataaggggagctgaaaaatttgattcatcaaaaggttttaggttctctacgtattctcactggtggatcaaacaagcaatgcgtaaatctgtctcagagcaatcccaaatatttcgcttgcctgctcacatggttgaagcaagctaccgtgtaaaggagtgtacaaaacgacttcgccgtaagcttagaagacgacccaccaatgaagaaattgcagtggacactggtattccaattaaacgagttgaggcagcagtaaacctcccaaaatatagtgtgtcccttgatagcaaaattggttccaccgacatgacatatcaggaggtcacagctgatcccagtgctgagacagctgaagagatgctcaacagaatgtccatgaagaaggacgtacacatggcactagatactctcaccactcgcgagaagcaagttgttgttctgaggtttgggctcgaggatggtcggataagaaccctgcaggagatcggtaacatcatgggtgtgagcagggagagaatccggcagatcgagtctggcgcgttccggaaactaaggagcaagaagaaggtgaaggctttgaaggattatctggtgccagtaggcaattggtgaaccgtttgtttgcagaatttgttttccttttggttcctctttttttttttgaggattctgtacttgtaccattttacgtgggtcctcatgtaaaacacgctatcagaatacttgcatcacaagaggaaagagtagtttagttccgtgggaaaaaa

SEQ ID NO: 477 - DNA, 2709 bp, Zea mays
ggagctggccgcgtcgtatcgactcctgccgccgaaaggccgagcccgagcccgtgtcccggtgcccgttcccgcaaccctaatcccctaccaccgtcggctctcgccggcgaagaagagggagccgcgcggcgtcgccagggagcacgcgccccctcccttcccggctccctccgcgccgtggggaggcgcgtccacccggatccgccctcaccgcgaggcagaggggaggagagggagccaggtccggcgcacccgctgtcgtccgcgccgaagagcgttaagagtctccccacaggcttggctgagggaaacttgtgctctgcgcatcttggacactacttcaccatttaccaagtcttgagttattgctccggtgccagacaaaaaaccaaactctctggccgaacacagtgatggcgcaagcctgtaagaagaggagaggagtttatataagcagtgaatcaggagactctgatacagattctgatgttgagggaagcaaacactctcaaaagtctggggtgacatcaatttctacatgcgagcaccagtcatcttataacctcaaggctgcaagtatgaaaagtagcaggatgataaggctgtgtggaaatatcgtaaggaagctcatcgatcacaaatgtggctggcttttcaaagaacctgttgatccagatctatatgggattccagactactttgatgttatccgcagtccaatggatttgggcactattaagaataaactcacaaaaaagaaatatgtaagcattgaggagtttgcagcagatgtgaggctaacattttcaaatgctatgaagtataatcctccaggcaatgatgtgcatatttttgctaaagaattgaatgaaatgtttgattcagaatgggaatcagtagaaaggaaatttagaggccgaaaccttggtcaagaccagcagacaatgaaggccataaaagttcgagctatgatggattcaaagtctacagttgctagagggccggttgcatgctcaaaccctaaaactttggttactagaggtccagtagcttgctcaaattcgattgcaaagaagacactgacagatgcattatcctccaaagtaaaaatcaaattttccgtgcgcagctctgcgcatacctcttccaaagatatactcgttcaagcagctggtagcaaagaggggtccttaaatcactctgtccctactggcaacaaagaggcatcttcaaattgtactattcctatcgctaaggaggctaaaatatcaagggcacgagaaattgagcgctgctctggttcaattggaaaacaatcatggtcttgcaatgacacttctacttcacctctcgcttcctctgtgcaaggtgaggaaagttaccttcatgatgaacctttgtcaccaagcagggctcttcgtgcagcaatgctcaggagtcgttttgctgggactatagtgaaggctcaacagaaggcacttctagatcatgggaagaatatagaccctgtgaaattgcaattggaaaaggagaggctggaaaagaggcagcaagaagagaaagcaaggatcgaggcccaggtgaaggctgctgaagcagctgcacaacaaaagtttgaggaagaaatgaggatgaagagaaagcaggaaagggaggcagcacgcctggcactacgcatgatgaagaagactgttgatattgacaacagtgacttcctaaaggagctggagaacttcagcaaaacatggcaggcaaatccacctggcaaattaatcgtggattttatcagtggggacttgccaccggggttagggagtccgctggagaggctcggcctcttcatgaaggaagatttcgaggatgaggtagaacaggaaatggaggacagagtgtcaccctcaatggatgttgacatcaggaaagatttccaggaagacttaggacatgaaatgcaggacagtgcatcacccgtgactgtcattggcacaaagaatgacgtacagggagtggcaggacatgaaatggaggacagcggatcaccagccacagtcattgacacgaagaaagaagagacagaacatgagatggtggacagcgtatcacctttgatggatgttgacacggaggaaggggagatcagctgctgacggtagctacacctctcttcacccgcataatttattgaggcagacatccttgcttggttgttagattaggcaatttcataagcagagtgatgcagaaacattagttttatctgctttcatcgtagaaccatgtggtgtggagaacatgtctcagacgaaatgacgagtggttttggatttgctgcggattttaattttcgtggtcttgtcagtctggcaagagtatgatgactctgtatgttgaatttgacctcccccgctggatgacatgtataaaaggatgagaaaaaaaggatagtttggagctagtgtatgttgttggagtttatggtggagccagatttggtgagcgtgtcgtggacgtaaatgtaggtatagctatatacttgaaatattgataagagtgtttggttcaaaggatcaattcattccagttaaacatcatgagcttgttaatgggtgtttggttcgagagttcgttaatgggtgtttggtttgaggaataagctagtctactattttttttatttggttgttgaatgtaattttttgacctgtc

SEQ ID NO: 478 - DNA, 1508 bp, Zea mays
ctccctcccccgtccgccctgcactctccagctcaacaaggaagaagagggggccttcaccacaccactcgattcctctttagagcacgacttacgaagtgtgcccaggccgtcgccgccgaccagcaaaagggctggaaagcccccctcttttgtgctgtgcgtgcaactcggctcctgccctgccatcttgctttccaagacccctgcgcccccagtcccataattagttaggattaggatcaccaccatttccaaatccttgcagagctgccgaagcgcggatcacagatgaagaggcaatccaagaggcccaccgccagccgcgaatccccagaaacaggggagaagcagaagctggcgttcgcggaggaagaggccccgccggcgcggaaggtggagcccgacgacgaggccgagatggacgaggacgaggacgagctgggcccgggcctgggcggcgggcgcgcggcgcggtcgccgtgcgggctcggggagaagaagcggcgcctggcgctggagcaggtgcgcgcgctggagcgctgcttcgagacggacaacaagctggacccggaccgcaaggcccgcatcgcgcgcgacctcgcgctgcagccgcgccaggtcgccgtctggttccagaaccgccgcgcccgctggaagaccaagacgctcgagcgcgacttcgcggcgctgcgcgcgcgccacgacgccctccgcgccgactgcgacgcgctccgccgcgacaaggacgccctcgccgccgagataagggagctgaggcagaagctgctgcccaagccggaagccacggtgaagctggaggcgacgacgggcaatgacacggcggaggagcgccgccaggcgacggccggcgcgccgcccgcgggggcctgcaaggacggctcctcggacagcgactccagcgtggtcttcagcgacgtcgaggcgtcgccctactccggcggcgcggcgttcgagccgccggccttggccgggctcggcgcgccgttcctggacacgtcggtggcgccgacgggctgctcgtctccccccgttttcgtcgagaccaagtggcagcagcacgggccgacacagtacccgttcccattcgactcgtacaaggcctgcgccggctatggcttcacggaggaatggctcgccagctcggacctcatcggcagcgacggcggcgcggcggggttcttctccgaggatcacgcctccagcctcaacttcaactggtgcccgagtggcatccagggctgggagtgaagaggggtttttgatctgcacggctagtgtaaaaaaaccgatgttacggtggcatttgtacatgcatggaactggagtctagtgacctggcctggcgagtgtggtgtggccaaagctagaggacatccagcgcaaaaggcgggaacaggagcagtagtagcctgtaacaataacggaataacttgagccaggctagtaaaaaaagaggatgtaaatgtaaaaagaggtgtcgcacc

SEQ ID NO: 479 - DNA, 1434 bp, Zea mays
cacgccgggacgggaggcacaggtgcggtctgcgtcgagagttggtccactggcaggccggaatgaagaagtgcgcgtcggagctggagctggaggcgttcatccgggagagcggcgaggacgcccgcgccgccgccggaggtagcagtccggggtgcggtggatcaagcgatcccggagggagcggcgtcttctcacccggcttcggtttcgccgactcggacaccatggatggaggcagttggtggtacgggaacgtccgcacgccgaacccagtcatgtcgcaggcggcgtccatatccgctagccccgggctaaccacctcagccaatcatgctcttgaaagcgagtcagactccgacagcgaatcactgtatgaggtagagggagttccatacgagcgaggtaacagatccattgagacgaagcgaataagaaggatggtgtccaatagggagtctgcgcggcggtctaggaggaggaaacaggcacagttgtctgaccttgagtcacaggttgaacgactcaaaggtgaaaacgcaacactgttccagcaactttcagatgccaaccaacagttcagtactgcagtcacagacaacagaatcctcaaatccgatgtagaagcgttaagaattaaggtaaagatggcagaggatatggtagcgagaagtgctgtatcgtgtggcctaggcgaccttggcctggcaccatacgtgaactcaaggaagatgtgccaagctttgaatgtgctcacagggttggatttactagggagtgatgcgttcaggggtccaaccgcaggtacacgagtacagaactcaccagtacagagcactgcaagcctagagagtctggataaccgaaagtccaacgaggtgaccagttgcgcggcggacatttggccttgagcttcaagccattgatctgattcaaagcttgctccaccctcaaaaaaaggaccagagtttgtcaactcaaatagctggtggcttgagcagagcttctggcacgagttctcttgaaccatatttccacataagctttataggatgcatcactcttttgatgtcacttagtttcaagtataaaatgaagctgtctttgtacaaagctgcaaatgagaagtaaatgaaacgtcctggacaaacttgtgaagtaggaatgatacataggctctatttccaggtcagatgagacagttatgtttacaacaaaaagcaatacatgttgtttagaaaccgctattaattcacaggaatgttcaatccagtacaagtcatctagtagatttgcacccctaccttctagtagattcaaccatgttttcactactacttgctgggactacaactgtacatcatgatggtaaaatgcataactagtgaggttcttgactcgaaaaaaaaaaaaaaaaaaaaaaaaaaaaaaaaa

SEQ ID NO: 480 - DNA, 1583 bp, Zea mays
atttctatgttattttactatactattgaaaaaatgagtaaattgtatgttgtgataatctgaacttttacatgacagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctacaaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacagcattatctccaccacctggtgtgatggttccagttcataatgcagtaccatctgacttatcagttaaggatgagagggaattgaagcgcgaaaagaggaagcagtcaaatagggagtctgctagacgatcaaggctgagaaaacaggctgagacagaggagttggctacacaagtggagtctcttgcagcagagaacacgtcccttagatctgaaatcggccagctaacagagagctcagagaagctcagactagagaattcagctctaatggtgaagctgaaggacaccgcagaaccgtctccgattaaagcatccgcatccccgtcctctccccgtgcctccgcggagaacttcctttccatgatcgacagcgccaacgcgccgagcgtcagcaggcacacggagcacggcggtcccaggctccggcagctcctggactccagtccggcgacagacgtcgccgccgtaagctgatgatgaagccggtccggcaaatacgccacagcacatgcatgtgtcctggggattccgcaggctcatgctgctcgagtgctcgtcagcgttacggactcggactctgtactccagtttaggcactgattccagtgaagtaaccgagggtaccggtaattttatctgctctcgcgccagagtgccgggctgccttgcctgcgaccactcctgtcctgtgtacccagagttgtaacgtagtagggtgttgtgctgcatgccgaccttttgaaactttcgagaccgtcatttggaccatttttttcgtcgcagtaacacaatacagatcggagtttgtacaaaaaaaaaaaaaaaaaaa

SEQ ID NO: 481 - DNA, 1870 bp, Zea mays
tctctctctctgtcgccaggagggcgccgccgccaccaacgcaacgcgcgccgccgcagatctccgccaccgacgcgccggccatggagtacgagcgcattgagaagccgttccccgtccagggcggcgggttctcgcccaagcggctgcgcgcgatgctgctgggggtggacaagcgccgcaaggggcaggacggcgccgccgaggaggacgaggacggcggcggcggcggcgactacggcgccctgcccaaggcccacgccagatccggcgccggcgacggtggtggcgccacgtgcgaagaatacaaggacgtggacgtggtgagcaccacctcagagttctcgtcctcgctggagacagcgggtgggcaccggccccgggacgcccaccccgtcgccacgggttctaggaccagggtgccgcccgaggaggactcgtgcgactcggagagcgtggcatccaacttcgagttccacaaggagcggcgggcagcggcggcggcgtcggtcgtccctccattctcaaagcccgccccgtcaaagtgggacgacgcacagaagtggatcgccagcccgacggcgaactgccctggcaggggtggcgcggctcctgcgccgaagaagacagagaaacctggctccggcatcgggaggctgccgctgccggcgaccaaggtcgtggtagaggccaccgaggagatagataccaagaggatggatccgagccaggagaagcgtgagattgggtggcagaaagcggcgaggtgggcgccgcccgacccctgtccggaggtggagccctgcccaacaaagaccacactactcgctgtagaaactacagtggctgctgcttcagcagcagctgttaatttcaaccgccatgatgcatccaccacgcttcagagcgcagcaacatgcatacctcctccaacaacggtccggtcagtgtcgatgagggacatgggcacagagatgacgcccatcgcaagccaagagccgtcccggaccgggacgccggtgagggcgacgagcccaaactgctcccagccaacgactccacggaggacgctcggtggccccagcgcagtcggctccttcatcagccacggaggagaatgcagcagctcggagctgagcgagcaggagctgcagaccaaaaccaggagggagatcatgctccttggcacgcagctaggcaagaccagcatcgcggcatgggcgagcaagaaggaggaggagaaggacgcctcgctctcgctgaaaccggtgcccatggaccagtcgacgcagaacataaccgcgatccgtgcggctgcgtgggaggaggcggagaaggccaagtatttagcgagattcaagcgagaagagatcaagatccaggcttgggaggaccatcagaaagcccagatagaagctgagatgaggaaaatcgaggtcgaggtggagcggatgcgtgcccgcgcgcaagacaagctgatgaccaagctcgcgtcggcgaggcacagcgcagacgagaagcgtgccacggcggagctgaaacggaaccgcgcagccgcgaggaccgctgagcaggcagagcacatcaggaggaccggccgggtgccgccgtcgtttggctgctggaactggtgctcatgaagtgcccatggaagatgagtcgcccgttgagaatgagtcgcttgtaagctgttgtaactatatatatatatatatacacacgtatgtaaggtgtgagatccatgcgtcctgtgctgtggtggttactgtgtaagtgtcacagatgtaccgaattcaaggccgagcttggattcctagtgcacatatgtgataaacttcacaccaagagacctccatgctagttgtgactg

SEQ ID NO: 482 - DNA, 854 bp, Zea mays
cactcaacagcaacagctaagcctctcccacaagacagcaacatggctgaggaggaggccaagaaggtggaggtggaggtcaccaaggagcccgaggcggcggcgaaggaggacgtagccgatgacaaggccgtcatccccgcgtccgacccgccgccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaagaaagtatccgctattctttcatgggaaaacacaaagaaagcaaacatagaagctgaactgaagaagattgaggaacaactggaaaagaagaaggctgaatatgcagagaagatgaagaacaaggttgcaatgatacacaaggaagccgaagagaagcgagcgatggtggaggcaaaacgcggtgaggaggtcctgaaggccgaggagatggctgccaagtaccgggccaccggccacgctcctaagaagctcatcggttgcttcggagcctaagaaaccttccaagtcagaccgagcagaaagtgaaaaacgtcagccagtgattgcttggtcctctcgctctatcaagtgtgtagtgtgtcttcgaaagtttgtaaagcctactgctgctgctgtatatactgatatcgcttccaaggcaggcgtttggtggtgtacatgttgaatgcttgacgagaaacattcttgtgtgtagttaagaggtc

SEQ ID NO: 483 - DNA, 1035 bp, Zea mays
ggagaaggaccctctctgtcctcgcggggggcggcaggaggagcagatgttcccgcctggcctgatccaccaccgccctgacgccaccgctcccggcgatgggccaccgcgctccggccccggtgggccgagccttgtactgacggcggaccccaagcccaggctacggtggacggccgacctccacgagcgtttcgtcgacgccgtggcccagctcggcggacccgagaaagcaacaccaaaaactatcttaaggacgatgggtgtcaagggtcttactcttttccacttgaagagtcatcttcagaaatataggttaggtaaacaatctggtaaagaggggtcagagcaatctaaagatgcttcctatcttctagatgctcaaagtggaatgagtgtgtcccctagagttgctgcccaggatatgaaagaaagccaagaagttaaagaagctctgagagcgcagatggaagtgcaacgaaggctgcatgaacaagtggaggtccaaaagcgcgtgcagatcagaatggaagcacttgagaagtacatcgacagtatcctagagagcgcatgcaagatggttactgaacaatttgcttcgagtggcttcagtatctccaaccctgatctcccggagatatcccctggaggggtcatgtgtggctccacggacacgttgggctcgtcggtgttgaaccagctttctgtgagctccatcgactcgcacagtccaggaggcaaaccttctccatcaggcatggaaggtccgacactgctccagaaatcgcctgagctcaagcggaggtcctcttgaactgtgacatcgaattctgaggttggtgatgatggctgtctctgtggagtgtctgaatatggtggtgacaagggaaatggtggcccagtcttgtggtagctgactctctctccaggtagcaggacgtgctgtgtttgttgatcaatccaagtatcaaacggacctactatgttcatgtgaacttcctcaagtgctagttaaaaagttttcatgcttctgtc

SEQ ID NO: 484 - DNA, 1560 bp, Zea mays
tcagtgtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgtgtttgcgttcttaggtttcaagattggcttttgttgcgttcttggcgagacgaagggactagggcgcggacaaagaatcagcatgcatccgagcgcggtcagtttcgactccggcgacgggcggcggcgcggtggcgcgcagatgctgctcttcggcggcggaggcagcgccaacagcaacggcttcttccgaggtgttccgatggcggtcctggccatggacgacgcgacgcgcgtgggcaagcggcccttcttcacgacacacgaggagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccaggtggccgtgtggttccagaaccgccgcgcgcgttggaagacaaagcagctcgagaccgactatgaccgcctcaaggctgcctacaacgcgctcgccgctgaccaccagggcctcctggccgacaacgatagcctccgggcacaggtgatctgcctaacagagaagctgcaaggcaaggagacatccctgtcggcaaccatcgctgcccaagaggtcgaccagccaaacgaacacaccacaggcactgagaaattgctggcgcagcagctcaaggacgacctgcacagcagctgcggttgcactggacatggtgccctgtcttcggaggaagaggatggtggcgtggtcagcgatgagggctgcaactttgatctccccgacgccatgtttgctgttggggtcaccaaccatggtgctgaggaggcgcagctggccaactggacatcttggttctggaactgatcggttgatggatggatgcatcaagtgcaaagagcaaatcctctcctggtttcgactcttttctgcaacatataattactgtgttgattatgtgccgtcagatgttttcaagtaatgaaacagaactgatgttgtaagtttatgtttctgaagatttgtatgttcatatatataataatatgctttgaacatgagactccaaaagttgaaataagtggatgtggagacctgttgtgcactagcagccagcatgcgtttttatgctgctttagacatgaaaatgtatatccaacacaggcctgtgaataagatgatgaaagtatatccaatcgctgcacttcatttggttgtgtgccaaaaaaaaaaaaaaaaaaaaaa

SEQ ID NO: 485 - DNA, 1627 bp, Zea mays
tccaaaagaaactcctgataaatataaaaaggaggggaaaaagaaaaacacttgcagcggcatccaccaccggagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttgttgcgttattggggagacgaagggactaaggcgcagtgagcggacaagaatcagcatggatccgagcgcggtcagtttcgactctggcggcacgcggcggggcggcggcgcgcagatgctgctcttcggcggcggaggcagcgccaacagcaacggcttcttccgaggtgttccgatggcggtcctgggcatggacgacgcgacgcgcgtgggcaagcgggccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcctcctggccgacaacgataacctccgggcacaggtgatctccctgacggagaagctgcaaggcaaggagacatacccgtcggcaaccactgctgcccaagaggtcgaccagccagacgaacacaccgctgtgtcaggcacggaagaactgctggcgcagcagctcaaggacaacctccacagcagcggcgactgcactggccatggcaccctctcttcggaagaagacgacggtggcgtggtcagtgacgagggctgcagcttcgctctcccggatgccatgttcgctgccgggttcacccaccatggcgccgaggaggtgcagctggccaactggacatccatgttctggaactgatcagcggatggatgcatccaagtgcaaagatcggatcctctcctcgtctcgacccttttctgcagcatataattaccgtgttaattatgtgccgtccgatgtttttaagtgctcatgttttaagtttgtgtttttttgaagattttgtatgttcatatatataataatgtgcttcgaacatgacactcgaaaagttgaataattggacatgtcgacctgctgtgcactagcagctggcatgttttgtttagggctggtttgggaagttcatttttcaaagaattcatatttttcaaagggaaatgaactaattttacttaggaa

SEQ ID NO: 486 - DNA, 1269 bp, Zea mays
gtgtttcctcagtggactagtgtgaagctgtgcttagcgtagcggaagggaggaaggacaaggcaaggcaactgatggcggcgggcggcggaggcggctcggcggcgccgttcgtgtggaagacgtacacgatggtggaggaccccgggacggcaggggtgatcggctggggcagcggcaacaacagtttcgtcgtcgccgaccccttcgtcttctcgcagacgctgctccccgcgcacttcaagcacaacaacttctccagcttcgtccgccagctcaacacctatggcttccgcaaggttcatccggaccggtgggagttcgcccacgcgtcgttcctgcgcggccagacgcacctcctgcgcaacatcgtccgccgcggcagcagcgccgccggtgccggaggcggaaagaggaaggacgccagccccacggagctggcctccggggacgacatgaccatggtggccacggaggtggtgcgcctcaagcaagagcagcgcgccatcgacgaccgcgtcgcctccatgtggcgccgcgtgcaggagacggagcgcaggcccaagcagatgctcgcgttcctcctcaaggtcgtcggcgaccgcgacaggctgcaccgcctcgtcggcgacgcccccgtgccagataacgggttcgcctccggcggtgccgccgagccgcccgctgcggaggtcggcgagaagcgggccaggctgctgctcgacggtgacagcatggtggcgctcggtcccgaggccgtcgacttcgccgggttctacagcggcggcggtgcgttcggcgatgttgccgtggatgctgccgctgggtcccgcggaggcgggttctcgtttgcgttcggcgtggacgcggggtactgaatgacgagcaggcgccgccattgtcagcagcttggcccgcttatgctgctgtcgagcttcctgccaatgccattgcgctgagcggcggcagccgtcacatggaagcatggcaggggatggatgataatgatgttaagttctatccctggctccctgctacatggataggatgtgtgtctgatgctgcttttcgtggatctatatgggcggggagcgactactgcgtcgagatctaaaaataaggggatatactgtcatggagtgtgaccttcgaagttcccaatatgagtaggtttgatgttgtacatgaccagtgcagcagcactaatatttcaatctcctgcggatacgcagctggaaaattggcatcgctattatttagcccttttct

SEQ ID NO: 487 - DNA, 2264 bp, Zea mays
cgcgagcggcagccctttgccttgtttggatactctagtattccccctaattcacatgtgttgagatatattggggtgtaaattagtttaatttatactctaataaacctcaacacacgtggattgcggtgaatactagagtatccaaataaggcctaaggggtattaaccccctcccccccaaaaaaagtcctgggaatctatttactgatttcacttatataggtgtagtgttaggaaacattttagcgtcggaaaacaagattttgaagcaattaagtgattttgtattttgtgctctttgaggttgtggaaaacaagactcgaagtggttgaagtgattctgaccagacctactgcattatgttttgagcatatctggtcgtgtagtgggtttatggcagtagggattcagtgctatcgttttcactcattagcgcatttgattgtaaacaaatacatccttgaaagtgtttatgatacattctccggtgaacctcatcttcaggtgaggcaaagagaggggagattaactctcccagcaaatttataatcctgacatggtttcttgaacttttttattgtagctagatggaacaagatactggatgaagtaccaagaatcagattgttttgttctagaagactctactgaccaccttcacatgctatagtatattgctggcctatcattatccctgttattgcagatataaatatacaaaagctgaaatttacagagaacctcatccaagcgaacataatgccttatgactgacctgctgatgaccatttctggtctattgcaacctgcagggcttcagaaaggttgatcctgacaggtgggagtttgcaaatgaaggtttcctcagaggtcaaaggcacctgctgaagatgataaagagaaggaagccaccatcagctgtggcaccattgcgacagcaacgtgcccctgcttcttgcctggaggttggtgagtttggatttgaggaggagattgataggctgaagcgtgacaagaacattttaatcacagaagtagtaaaactaaggcaggagcagcaaagtactaaagatcatgtgagagccatggaggaaaggctacgagtggctgaacagaagcaggtacagatgatggggttcttggcaagagcaatgcggaacccagagttcttccagcagttggcccagcagcaagacaagaggaaggagctcgaggataccatctcaaagaaaagaaggcggcccattgacaacacaccattctacagtgatggggaaagcgaacagcttgattcacagttgaaaatgttcgagtcaggtgttctcaatgggctcaatgaacctgagctggagaatttagcagtgaacattcaggagcttgggaagggaagcatagatgatgggaacttgactcaagttagtgaccagtcagagctgaacgacgacttctgggcagagcttttggtcgaagattttggagacaaggcaggacagccagagttggagggaagaactgaagacgtgaatgaccttgctcaacaactggggtatctgagttcttctagcccaaaatagagccagttcctaatggttgcccccacaatcactggtgctttccctaccctactgttgcagaccatcctgatcaaaccggtacttttcaaattcaattcaatgacacaaacctgttaaaatctggtaacattttcattccatttcttttatattgctggattagccaggaatgatgatggatctggcagacaaggtttgacgacccatccttctaaccatatccattatgtttgcgcagttgcatcttcagatttgccctcatcttttcttcttcttcttctgaaacattctaaattgctccttatccagttgactggtggtggagaggtgttcatactgaaggcgtgctgtggagaggtcactgccttgacgttgaaggcttagcgctgtactctgctgtgggagttacgtgtggggtgttggctaaatgtctcttccggcgtcttctggcaaaatgatctcgtggacggtgactggcaaagatgcctaggggccaacgtatacgtacacagctgttatcagatcttgttcaaagtcattgcgcggttttgacggtgctatgtatcgatcagggttctggccttctggggttgggttgtagaattgactggctgatctagtgttctccatgtatgactggtgtaaccttaaaacaccctcagcttgttgttgaactgtgacaagcc

SEQ ID NO: 488 - DNA, 1287 bp, Zea mays
ccggcactcgcctcccttttccctttccgcgccccatcaccattgccacaaatagcaaccaaggcagtaagcctagccaagccaaccgacggcggcgagagtatatatacacacacacctgacgcctctgctgctgctgggatcaacgcggcagcttagtgacgacgacgactcttctgtctctgcgttgattaatggacagtaacagatccatggcgacgagcggcgtggctccgttcgtggccaagacgtaccgcatggtggatgacccggcgaccgacggcgtggtcgcgtggggcagggacaacaacagcttcgtcgtggccgaccccttcgccttctcgcagacgctcctgcccgcgcacttcaagcactccaacttctccagcttcgtgcgccagctcaacacctacggcttccggaaggtcgatccggaccggtgggagttcgcgcacgtgtccttccttcgcggccagacgcatctcctgggccagatcgtccgccggagcagcggcggcaagcgcaaggacgacggcaacggcgccggcgccggctccgccgacgacgaggacgcggtggccatggaggtggtccggctgaggcgggagcagcgggccatcgaggagcaggtggccgcgatgtggcgccgcgtgcaggagacggagcgccggcccaagcagatgctcgcgttcctcgtcaaggtcgcgggcgacccgcaggtgctgcgccgcctcgtctccggcgccgggggcgacgccgtgttcgccgccgcggagccggaggacggcgcgagcatcaagagggcgcggctgcttctcgatgccggaagcggcggcgacggcgccgtcgacttcagcgggctctatagcacaaccgccggaagcgaagacgacggcgtcgggttcggcagcgattacctgcagccgccaccgccgtacgtgttccccgtcaacagcggcggctactgactgatggcggtctggtagtccagcatctatccgagcgatgtggcgtgcttcgtcgtcgttagttgcccctcccgagtgacgtgttggactgaagtggcaacggcgccgacggacggtgagcaaccaacccaagataattagctaggaggtggtacaaagtgtaaagcctttggtttaggcaggtctgcggtgatctttaatttgcttgttgcaatgttttccttccctaccttgtcaagtgaatgctacggatcagcggcggcaaaagccgttagctgcagctagtttgccgctgctcttcatacagctgcacgccgtt

SEQ ID NO: 489 - DNA, 1623 bp, Zea mays
attcggctcgaggcggcgacacgccagggcggagagcacacaccgaagcgggccgcggcggcggcgcaggcgcaggcgcttacatgggagtagaggcgggcgggtgcgggcggagggcggtcgtgaccgggttctacgtctggggctgggagttcctcaccgccctcctgctcttctcggccgccgccgccgccgcagactcttactagctagctagccaccttcttcctcctcctccttgtaggtagtagtagtagtaggctacacaacaacgaccacatatatatatacatactaggtactactagcaggcgagcgagattcgtgcagtaattaaggccgcagccagttaataataattagtcgtcggcgagcgagagagatggtggaggaaggcgccaccgcggcggcgtcgaggagcgggccggcgccgttcctgagcaagacgcaccagatggtggaggagccgggcacggacgaggtgatctcgtgggcggagcagggccgctccttcgtggtgtggaagcccgtggagctggcgcgcgacctcctcccgctccacttcaagcactgcaacttctcatccttcgtccgccagctcaacacctacggtttccggaaggtggtgccggaccggtgggagttcgcgaacgagaatttccggcgaggcgagcaaggcctcctgtccggcatccgtcgccgcaagtcaacgacgccgcagccatccaagtacggcggcggcagcgtcgtgaacaccgcgttccctccgccgttgccctttccgcctcccgcgtcggtcaccacgtctggcggtggcggtggtgctggcgctggcaacgagcgcagctcctcgtcggcatcgtcgccgccacggaccgacgacctgaccagcgagaacgagcagctcaagaaggacaaccgcacgctgtccaccgagctggcgcaggcgcgtcggcactgcgaggagctcctgggcttcctctcgcgcttcctcgacgtccggcagctcgaccttgggctgctcatgcaggaagacgtgcgagcgggtgccggtgacgacgccgcgccgcgccgcgcaatggtcagccagctggagcgcggcggcgaggaggggaagagcgtgaagctgttcggcgtactcctcaaggacgccgcaaggaagagggccaggtgcgaggaggcggcggccagcgagcggcccattaagatgatcagaatcggcgagccgtggatcggcgtcccgtcgtcgggcccggggcggtgcggcggcgggaattaagtaaggtatggttggaactgatgcgccacggccggccgtgtgacagctttattacagcgagcgcatgttcgagtcgtggatgctttttgtgcgtgtttgtatttgtcatccaaggtgaggttgatggcaaggataattccagtgctgtggtaaaactgtgaaggcagaacacagggcacaggagataaccgtaacgcatgttaaaagttaattatgggatgctttggaggtagcaagattgaaagtagggaactagggatgaccggatgagtagacggtctagaaagacaagcccatatgtttggaatggaatattatcgtttttataaaaaaaaaaaaaaacg

SEQ ID NO: 490 - DNA, 1127 bp, Zea mays
tttccttcccccgctttctccttccttcctcctcctcccggctcccctcacccagccaccggccatgtcggtggagacggagcggagctccaccgagtcctccggggcttccgggctcgacttcgaggacaccgcgctcacgctcaccctccgcctcccgggctccgcgccttccgccgccgccgccgccgcggcttccctgtccctctcctcctcgtcgtcctccgccttccccgaccccgaccgcaagcgcgcctcctccgacgccgaccccggccgctcctccccgctcgccgcgtcctccgacgctgcaccggcacccaaggctcgtgtggtgggctggccgccggtgaggtcgtaccgcaagaacgcgctcgccgacgccgcgggctccggcaaggccgccaagttcgtcaaggtggccgtcgacggcgcgccctacctgcggaaggtggacctgcaggcgtacgccggctacgaccagctgctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgttcgtggaaacctgccagcgccttcgtctgatgaaaggttcagaggccgtgaacttggcaccaagagccgcccgatgaggcacactccgttgggcgttggcacgcacgcacgcactggcgtcttgaaggaaagcgggaactctgctggtcttgatgaggatcttcacgtgagataggaacgtgtgtacagttgtcgccttatggtattgagttgaggaaacttggaagttccattacttgtctgtagtctctactttatatagatgcgaagaagcttgagatacacattgcctacaatgtcttttgatgaataagaccagacagcaccgaaaccgaactcgtcctccacacggttgctttgccatctcggtggttttgtggtggtggtcgtgcttcctataggtgtgaggctgatggcgtggctgccatttatacaatctttaatcgtgttctgttgagcttaaaaaaaaaaaaaaaa

SEQ ID NO: 491 - DNA, 1831 bp, Zea mays
acctggcaacctccctagacctggagcgcacgagagagagatagaagagagacggaccgacgaccgacggcgatctcgatcggtaggcagccgttgcttcttcttgcttggcgggcggggcggccaccatagccctctgtagctcttgccggctttccttgtgctccttggaatctcgccctgcatatcttgtactacagtagctagctcctctgctactgtagagctacaggcaagagggaagcaggcagcgaccgagctctagctgccggctgtgcgactgcgagctagagagagagagagagggtgcgggcgacggacggaacggaacagaggagcctagtacttgttgtccgctgtctttcgtccgtgcgactggaccttattccctcacacctgcagctttgaggctcggccgtcacgtagtagtacgtgtacgtttcagggagggagccttctgacctcttgttcccttgccgccttttggtcacctcgggcaccgcgaggcgcagcacctgtgcttccttccgtcgtcttcctgcctcctcttctgttcaccgctctggcgctctcctatactcttctctctctctcgctgaggcaggcgggggcagcctttcctccccggtcgccatcctcgtttatatacacacaccctctcttgccgaaccactgctcgcttctctgcctgcttctgcttgagtcgtgccagtgacccgtgaccgtgaccgcgagcttcagggacgcgggcggcggcgatcatggcgtggcgcggcccgctcggagccggagaggaggccctggacagcggcctcgagctcagcctcggcctcccggcctacttcgcccggccttcaggtttggacgccgccagggaggagcccgccgaggcctctgcctacgctatccaggccgccagtgggagcaatgtctccaaggcaagggtcaggccagcgggcgcggcgccggtggtggggtggccgccggtgcggtcgttccggaggaacctggccgcctcctcctccaggccgtcgtcggggaaacacacccgccaggagggcagcgccaaggacggcctgttcgtgaagatcaacatggacggcgtgccgatcgggcgcaaggtggacctcacggcgtacggcggctacgccgacctctccgccgccgtcggcaagctcttccgcggcctgcttgccgctcagagggaccgagcggccacggcgggtggcgaggaggaggaggagggggagggccccgtgatcggcggcgactacacgctggtgtacgaggacgacgagggcgacagggtccttgccggcgacgtcccctgggagatgttcgtggccaccgccaagaggctgcgcgtgctcaagagctccgacgtgccggcctcgtcggtgacgctgggagctgggggcccggagaggtctgcagccgactgctgctgctgaaacgtgctctgcttcgtcagctgcttgtaaaaagtcccgagtggaggagacgaggagtggccctatccctggcctcttttttgtgtgttgctcttgctgcctttctgctagtggtactagtattgggtgccagtaaaaagtaggagaacaaagtcatgacggtattaaggatgtaatgtgcaagattagcagtggtagtagtcgtaaggtgtttaatgaatctacggtctctgttttggggcatattcgaccgtttaaagctgtatgcacgcgtcgaatttcggtgtggtttctgcatgccggccttaatgtttttcagcttttgtttgcacacgaacgctttagagcaagtttaataaaagatggctctaactaaaaaa

SEQ ID NO: 492 - DNA, 1078 bp, Zea mays
gcttggttccatcgggccggagaggagaagctagctaactagcagcagctctgttggtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgaagttctgtagcggaccgagcatcacgagaacacttgagaggtacgaaaaaaacagttatgcaggcccagatactgctgtacagaacaaagagaacgagttagtcagaacagccgcaatgagtaccttaaactgaaagcaaaggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcttcaccacagcaagccccatcacatgttggcaatggattattctttcatcccctggaagctgcagcagagccaaccctgcagatcgggttcgctcccgagcatatgaataatttcatgccggcatggctaccctgaagatggatctttgaggcaaagggaataaataaagatgcgatgcatgtcagaatcatattgtactgcaagagtgacaattgtgtgttccactcacatatatgacctagttttgtgtgtctatatgtcgaaaccatatgtctgtgattttattatatgtaatgtaagcacagatgaaacatgcagggctagttgcttttgcttgtctatgtatctgtatctggctgtgcgcc

SEQ ID NO: 493 - DNA, 1228 bp, Zea mays
ccacgcgtccgcggacgcgtgggcggacgcgtgggcggacgcgtgggccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctgg

SEQ ID NO: 494 - DNA, 1026 bp, Zea mays
ccacgcgtccgggattggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagccctagaaaagaccaaacgaatgtttctgggtgaaaatttagaagaatgctccattgaagaactgcataatctggaggttaaactggcgaagagccttcacgtcatcagagggaagaagacacaactgctggagcagcagatatccaagctgaaggagaaggagaggaccctgctccaagacaacaaagagttgcgggataagcgcaacctccagtctccaccggaggcgccaccggacctgaaccgctgtgtccctccttggccgcgtagcctgccggcaccgagcaatgacatggacgtggagacggagctgtacataggattacccggcagggagcgctcctccaaccgggactctgattgaaccacggattttcagttcgatcggctaaaaggaataagctccctgaaattaaagcatcgaagggcacacgtcaatggttttatttgcaacttttgtatgcaaacttgtacttgaaaagtaaaaaaaataaaaataaatctgtagtatgtggatgcaagaaacggctggttagctagctgcaagccttctggggcctgaaaatgaaatccacccatggatacacccaaccaagcttgatgcgctacttttcttaaaaaaaaaaaaaaaaaaaaaaaaaaaaaaaaaaaaaaag

SEQ ID NO: 495 - DNA, 1290 bp, Zea mays
gtggcaccaccgcctcccctcctctccttattaccaccacctagctagcagcggcagcggcagcgccggcctgttgtgctgctcgctcagacagctctgctagctgcatcctcctaattctccaggtctctctctcctctcccaactcccaagtcccatccggatccgagacgctggaggcggagcgcccccccgggacggcggcggcgacgatggggcgcggcaagatcgagatcaagcggatcgagaacgccaccaaccgccaggtgacctactccaagcgccggacggggatcatgaagaaggcgcgcgagctcaccgtgctctgcgacgcccaggtcgccatcatcatgttctcctccaccggcaagtaccacgagttctgcagccccggaaccgacatcaagaccatctttgaccggtaccagcaggccatcgggaccagcctatggatcgagcagtatgagaatatgcagcgcacgctgagccatctcaaggacatcaatcgtggtctgcgcacagagattaggcaaaggatgggcgaggatctggacagtctggacttcgacgagctgcgcggcctcgagcaaaacgtcgacgcggctctcaaggaggttcgccataggaagtaccatgtgatcagcacgcagactgatacctacaagaaaaaggtgaagcactcgcacgaggcgtacaagaacctgcagcaggagctaggcatgcgggaggacccggcgttcgggtacgtggacaacacgggcgccggcgtcgcctgggacggcgcggcggcgctgggcggcgccccgccggacatgtacgccttccgcgtggtgcccagccagcccaacctgcacggcatggcctacggcttccacgacctccgcctgggctagcgcatccatcaccatgctgggtggtgctgctcgatcatcctactgcatggcaatgcaagctctggttggttggttcgctcatgcatcgtccgtcaacaaagcaagtaagcaatgcaatgcaaccgaggtactgtaatagccaataaaatctactgcatactgcaaacccaattactggtagcttagctaccgcgtgtgtacgaatcaaccgattaattaccgcgccctagcttgcatgtcgtcgtctgtgcttttggcgttcgtagacatgtatgtattgtatgcatgggtcctgttcatctgcatccatatgcatgttgtttatgattgtaattgttgtgtgaaatggctgtactttgctatgatcacgtgaaattatatctacattcgtgagact

SEQ ID NO: 496 - DNA, 1236 bp, Zea mays
gaggcacctgatctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactaccaataaagtcaggccccgtcaaatgctttacatggtgattgaagtctggagcttctcagcaccaccatatattgtgttcagttcctgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgt

SEQ ID NO: 497 - DNA, 1069 bp, Zea mays
caccacaccgcaccggcaccaccaccaaccgagcggctccaggctcctgctcaggaaggggagaagaggcgagccttccttgggaagtcgcaggaggagagaaggggaacaaagatggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgtcgtcttctccagcgccggcaagctttacgactactgctccccgaagacatcgctatcaaaaatcctggagaagtaccagaccaactctggaaagatactgtggggtgagaagcacaagagccttagtgcagagattgaccgtataaagaaagagaacgacaccatgcagatcgagctcaggcacctgaaaggtgaagatctaaactcgctgcaacccaaagacctgatcatgatcgaggaggcacttgataatggactgacgaacctgaatgagaaactgatggagcactgggaaaggcgtgtgacaaacactaagatgatggaagacgagaacaaattgctggccttcaaactccaccagcaagatatcgcgctgagcggcagcatgagagagcttgagctgggttaccatcctgaccgggacctggcggcccagatgccaatcaccttccgcgtgcagcccagccatcccaacttgcaggagaacaattagactgctggatgccctcgttccactcgccgaggatttcacccagccaccaccgctggcttgtatgccctcgtgcgctggcaactgtatctttatctttccggtatgtttggatgaacgtataatgtgtgtcagtgtcggtcgcatgacgtgccgatgtcgtgcatctctctctctctctgccagagcagcggaactctgcaccgtgagtaacttaattggtaccgtatgatctgccggacagtgaatagtttatgtgagtgggtcaaaccataatgtgtagtatttgtgtcgaactgtcaatggcacgtatttggattttcactac

SEQ ID NO: 498 - DNA, 1181 bp, Zea mays
ccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctgg

SEQ ID NO: 499 - DNA, 1545 bp, Zea mays
gcgcgacctctcggcgaaaccctaacctaccttagaccccgccgccgccgccgccgccgcccaagggagagagagacttgcacatcaaagggcgtccgatggggaagaagaagaagcgcgtcgataaggtcttctgctactactgcgaccgcgagttcgacgacgagaagatcctcgtccagcaccagaaggccaagcacttcaagtgccacgtatgccacaagaagctctccaccgcctctggcatggccatacacgtcctccaggtccacaaggagtccgtgaccaaggttcctaatgcaaagcctgatagggagtcaacggagatagagatatttggaatgcagggaattcctgcgcatgtattggctgctcattatggagaagaggaagacccttcaacaaaggtacccaaagtagaagtgcctcaggtaaggcctgttattatgcctaattcgctaggcatggcatttcctccgcgaccagcttatggtgtggcacctccaatctataatcctgcactcaatcctttgatggcccggcctccaatttggcctgctgcaccagcgcaagcttggtatccgcaacaagcagcatatccacaacaatcagctgtttcagttcctcccatagttgctgggctcccaccacaacagccactattcccaattcagaatgtgcctactcctatgacatcagcagctgctaatgtacttcaaacatcgtttcctatggcccctccaggagtaccttcacctgttgcccctcatgtttcccagcctttgtttcctgttaacacttcagctgtcaatggagctgtaaattccccatttttagcatctgttgcacctggaaccattccagcaagctcttcagcagcagtcggtgttgcaggaattggatatggaaccaataaccaaggcactagagatccagcagttggatcttcacctgcagtatccaataataaggcgtctggtgcccaaccagctacgaatgaggtatatctggtgtgggatgatgaagcaatgtcaatggaggaaagaaggttgtcgctgccaaagtatcaggtgcatgatgaaactagccagatgaactctgttgacgcagcaattgatcgaagaatatcagaaagtcggctggcaggacgcatggccctatgaagaagctgggctttgctcggtagattatcccccttgcatttcaccgaaggactctgcctgcgcttgtatctcgctgtgcagcagtctgccctcttcatttagttagcgaatggagttgctgcagttaagaggaatgtgttgtttctgacttgtttgagtgtcgagcctttgttcttctatgtttccagcatcgacaagaaaatgaattagtagcacttaggagttattttggtccaactgtcgcctcattgggaatatattgatgaacacctcaatccctgcccgattgtaacctggtcatgtgctattgccaattgaagcctaatgctgtgcattggcttgaaagcaacttaaaaatgttacggattataaaaaaaaaaaa

SEQ ID NO: 500 - DNA, 1024 bp, Zea mays
cctccccctaatcgcgaacgagcgtctttctcctccgtccgcgcccgtttgctcatcggttttgcctgccggtgggggaccgcctgcacgagcagcggctagccagacgtacgggcttcgtttgaggctggagtcctgattggcaggtgcaagcacagagctcgatcgccatgtctttcaccggcacgcaggacaagtgcaaagcctgcgacaagacggtccacatcatcgacctcctcaccgccgacggcgtctcgtaccacaagacatgcttcaagtgcagccactgcaagggcgtcctctcgattagcagctactcttccatggacggcgtcctgtactgcaagacgcactttgaacagctcttcaaggagacagggaccttctcaaagaactttcaaggtggagcatcttcaaacaagaacgaccaggcaaaggctccaagcaagctatcatctgcattctctggaactcaagataaatgcgcggcctgccagaaaacagtgtatccattggagaagatgactctggaaggcgaatcctaccacaagagctgcttcaaatgctcgcacgggggctgcatcctcaccacgtcctcctacgccgcgctcaacggggtcctctactgcaagatccatttctcgcagctgttcaaggagaagggcagctacaaccacctcatcgagacggcgcagaccaagaagaacgaggccgcggaggccggaccggagccaccggcggacgcaggcgcggctgagccggaagcacccgcgcaatcggcgtagaacgtacaaagattagcagcaacgcaaagagaaatagagccgtacgtgtctatctcctctatatatacgaaccctgcatcagtaagtagtcgtcacaagtatatgttcttattttgtaaccttggcagcttggttcagtctgggattgtaacaagtgcatgttgaattgcttgttatgtattatgaggctttggattcatgacgatgaaatgagtatatgggtgtaaacatttggcttc

SEQ ID NO: 501 - DNA, 1261 bp, Zea mays
gatcgggcgtaccccggtgcccgttcaccgccgttcacgccgcgtgtgcgctctggctctgccgctctctctctctctcctgcgcgtggcgcagctgccgtcctataccaggcgcccaggtctagcctcgtcggtgccttcgccaggtctttctcgggcccttcgccaacgacgagcgcccgctaggttagaaggtatgcattcgtgttcataatattgtatttgactaaaaagactgggcctacgcatgggggctccaaaacagaggtggacttctgaggaagaggctgctcttagagctggagtagccagacatggagttggaaattggcgcatgatattgaatgatccagaacttagctccacattgcgctaccgctcgaatgttgacctaaaggacaaatggcgcaacatgaatgtaattgtcacttcatcgagtactcgtgacagggggagaacttccacgaggagaacccgagctgctcctaagaataatgaccaattgttggcaatgagcacaatcacttctgaggttgatgatgagattgttgatgtaaagcccatagtatcaatgtctgttgaaggatggaatacttcaaattcaaagaaatctcactcaaggctagacaatattataatggaggctataaagaacttgaatgagcctacagggtcccacagaactactattgctaattacatagaggagcaatattggccacctagtgattttgatcacttattgtctgcaaaactgaagtatttagctaccagtgggaaattgttgaaggtgaatcggaagtacaggatagcacctagtttgctggaagacgtgcaaagagaacccttgaaattagggagtgatgctagtagaacccttacaagatcccaagtcgatgctgaattggtccgtatggcaactatgactgttgaggcggcggcggcagctgctgctcatgcagttgcagaggcagaggctatcatggcagaagctgaagcagctgctagggaagcagaagctgcggaagcagaggcccgagctgcacaggcctttgctgaagcagcagttttgacactgaagaacagaaatgctgcgaaattggtatagctcgagtccatgaatcttagatatgccctcttgtccttccacacgtagaatccagttccgtagctctgtatgcaactaattggttactaaaagaacctgaaatcagaagttttcacaaacacaccgacttattcaccgaagattatgatttcc

SEQ ID NO: 502 - DNA, 1161 bp, Zea mays
attcggctcgagggcaggcagcaggccttcatcgcagagaggacagcagcacctgagattgacggcggggcagcgcgcgggcccttcccttcggagcactcagcgtgagagatggggaggcagccgtgctgcgacaaggttggcgtgaagaagggcccgtggacggcggaggaggaccagaagctcgtcggcttcctcctcacccacggtcactgctgctggcgcgtcgtccccaagctcgcagggttgctgaggtgcgggaagagctgcaggctgcggtggaccaactacctgaggccggacctcaagaggggcctgctctccgacgacgaggagaggctcgtcatcgacctgcacgcgcagctcgggaacaggtggtccaagatcgcggcgcagctaccgggcaggacggacaacgagatcaagaaccactggaacacacacatccgcaagaagctcgtccggatggggatcgaccccgtcacccacctgccgttgcaggaaccgccggctcctgctcctgctcccgccgagcagcaggagcagagccacaggcagcaagaagaactgcaactgcaagagctgcagaacggccgcgagcttatcatgcaggagggcgcgggggaagacgatatcacgccgatgatccagccgcacgagatcatgccgacggcggcagcggcaagcaactgcggctctgtttcctctgcccacgccggctccgcgtccgtggtctcgccgtcctgctcctcctcggcggtgtccggcgtggagtggccggagcccatgtacctgctcggcatggatggcatcatggacgccgactggggcagcctcttccccgacactggcgctggcggcggcggcggcggcttcgacttgggcgtcgatccgttcgaccagtacccgggcggtggcttcgaccaagaagacgaccacagaatatgacatcggcctagcaatgcacatagattcgccgcttctccttccatctcgctcagcacatcagcgccgtagcctccatgttttcttaatagctctccagggtccagtgctgataaacaagaactgacaaattcgggtgcggaaaaaaaaaaaaaaaaaaaaaaaaaaaaaaaaaaaaaaaaaaaaaaaaaaaaaaaaaaaaaaaaaaaaaggggg

SEQ ID NO: 503 - DNA, 1383 bp, Zea mays
cttccggtcttctcttctccactaccacccgcccgcccgccttctcctccaccactgccccgtcgtggaataggggcaagttcaggcatctcgcttctgtcctggtcgaggggatcggagaagaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaggtggagcgccggcccttcacggcggaggaggacgcggccatcgtccgcgcccacgcgcgcctcggcaaccgctgggccgccatcgcgcgcctcctccccggccgcaccgacaacgccgtcaagaaccactggaactgctccctcaagcgcaagctcgccgccgcgtccgccccggcgggttcctccgacgtcgacgcgcgcccgaccaagcgcgtcagcctctcgcccgacagcccgtcggggtcggggtcagggtccgggtccgggtccgggtccgaccgtagcgacctgagccacggcgccggccaggtttaccgccccgtggcgcggtccggtgggttcgagccggcggactgcgcgatgagccgtccgctggaggaagaggaggaggaaaaggaggacccgctcacctccctcagcctctcgcttcccggcacggaccagcggttccaccacgaccgcgcccacagccagttccaggagctcccggcgtcgccgccctcgccctccccgcctccgccgccggcgggtccgacctcggcgtacccgttcagccccgtgttcatggaggcgatgcaggagctgatccgcacggaggtgcagcggtacatggcgagcgtgggcgtgcgcgccgggtgcggcgccgccggcggggccgacctctgcatgccgcagctcgtcgacggcgtcatgcgcgccgccgccgagcgggtcggccggatgcagtagctcctgggcgtgcatgagccatcaaatactctcccaaaccgtcaatcgatcttctaggacgaacgcgcagcagctgttcttatcagtagcaaacttccaagttattattttcctttttttaaaactttattctctcgaaccgctgtgaaaccgaaacagcagtgaaaagagtcagcaactgaaaaaaaaaaatatgtgggaactgaaaggtggagaaaaatgtagtaaaggcttgctgaaagccgtgtaaagcgctgcctgcctcctctctctctctctctctctacaggaatgaatcggatcggaacggaatgaaacgagaagagggggacgacgcacattctggtttc

SEQ ID NO: 504 - DNA, 1286 bp, Zea mays
ccagcgtccgaattaacaaatcacactgctttaatggggcgatcgccatgctgtgagaagattggactgaagaaaggcccgtggacaccggaggaggatcagaagctgcttgcctacattcaggagcacggacatgggagttggcgagcattgcctgtgaaggcgggcttgcagaggtgtgggaagagctgcagactgaggtggacaaactacctgagaccggacatcaagaggggcaagttcagcttgcaagaagagcagaccatcatccagcttcatgctcttttaggcaacaggtggtcggccattgcaacccatctaccaaatcgcacggacaatgagatcaagaactactggaacacacacctcaagaaaaggctggccaagatggggatcgatcctgtcacccacaaatctatcagtggcactcgcattggcaccacaaacgacaaatcaaccaaggccgccgcaagcctcagccacatggcacaatgggagagcgcccgcctcgaggctgaggcacggctggctcgagaatcgaagatacggacagcaacgccaacaccaactgctctccatgcgcagccaacgatactacctgcctctgctgcttctccatgccttgacgtgcttcatgcatggcagggtgcaaagatagacctggagtctccaacctccacgctgacgtttacagggagtaatagtggaacgctgccaacccccaggaccaatagactagacgtatcagaaagcaactgtgcagtgtggcatcagaggagtgatgacttggaggatgaagaaaacgattggcagatcttcagcaagcaccaattgctggaactcgacagcaaggagagggaagaggacttcattggttgtgaggagccgtggttctcagagatggctggggttggagctggcttcactggcatgctgcttggtgtatccaatgagcatgatgcatcagaatgctggggtgagtccaataatggccaaactgagcgcagcaaccaagcatcagatgaggaggacaagaattattggaatggtgtccttgacatggtaaactcagagctgacacccaagtcgcctccatttgtctagactctagaatacagtcccctccgttttatttcaagtactcctgagcaaaatctattggatcatctcaagtcaaaagagaaacagaacaagcactacaaataaatgctgcatgtgctacaacaatatgttttttttgtccatgcatgtgaaagtgaaataattaactattgtgtggatggagt

SEQ ID NO: 505 - DNA, 1744 bp, Zea mays
ctagatctttcaagctatccttgcttcctagctccctttggcgtgctgtaccggacgacaggggtaggtaggtaggtaggtgtagctagctcggcgagcgagggagcaatccggccaacagcacacgcgtcgatcgccatgccgagaagcggcggcggcggcaatggcggtggcattagtagtagtagtagggtgatgcccaacctcccggccgggttccgcttccaccccacggacgaggagctcatggtgcactacctcatgaggcaggccgcctccatgccgtgccccgtccccatcatcgccgaggtcaacatctaccagtgcaacccctgggatctccctgccaaggcattgttcggcgacaaggagtggtttttcttcagcccccgggaccgcaagtaccccaacggcgcccgccccaaccgcgccgccgggtccgggtactggaaggccaccggcaccgacaaggccatcctgtcgtcgtccacgcccacgagccacggcggcgccaacatcgtcgtcggcgtcaagaaggcgctcgtcttctacggcggcaggccgcccaagggcaccaagacggactggatcatgcacgagtaccgcctctcgggcgcggcggacgacgactgcaagggcagcaccaggcgcagagtgtcttcctcctcgtcgtcctccatgaggctggacgactgggtgctgtgcaggatccacaagaagagcaacgatttccagttgtcgtcgtcgtcggagcatgagcacgagcaggaggagccggcggcgggcggctcagcgacgactgtggaggaactagacgctctcgtcgtcgtcgacaacagcagcagcagcgacaccaccaccaccaccatcaccaccaacgacaacaactctactgaaacagctgcgactcatcacgatcctcagacgatgatgatgctgagcaagtcgtgctcgctcaccgacctcctcgacagcatcgactacgcggcgctctcctcgcagatgctcctcctcgacgcgccccacccccacgctgatgacccgccgccacacatggtctactacccaccggcggcgtcggcgacgcaccagcaagcaataatagctaataacaccaacagtaatgacgactactatgacgacgacaacttgttgccgactgctgctgctactgcggtagacgcggcggcggcggcggtgctactcagctcgtcgcctgcagacaccaacggtgtgaacaagaggaagcgagtgacggccgtggactactacggcgccgctgaaccgccgaccttcttccaccaccacctcgatgatggcggcaacagcttcttcagtacgaccaagaagctcaagccgccgccgccaagtgattcgaggcatggcggccatttcggcaccgccacagcgagcagctaccgcgacagccagcagctcgtggacagcgcgagcagcagcggcgtcttcttccatcagtatgggtacggctacagcagcagcaacccgttcttgaacttgaaccagcagcagcagctgctactcaacagccacatcgggatgcagtagagctcgagagatcgagagagagagagagagagagatgatatatcattggaaggatcagcacgcgtacgtgcagattaattgcagcgagttctatcttgtttgctttcattattatatactccgtatgtgtcgttcatgtaaaattagtttaaattgtaaattagtgtgctgaaattcc

SEQ ID NO: 506 - DNA, 979 bp, Zea mays
aaacggacgaccgagaccgcctgggcggatccgagttcggacggcccatcagagcatcagacgaccaccttcctgcccccattcgttttcgcatcggcgtatctcccggcggccggcaaaggcgctctcgacctccctgcggtgccggtacgacagtcgacaggatggcaatggccacatcagcatcgtaccctccacctcctccattttaccgattgtacaaaaattttgagcaagatccctcatctgcaccagaacctccaccaccaattgacgaaccattcaaagccttgggtgttgattacacaggagatgttgtgattccaagcttggagagtcataatgtccgtcagctttatccaaagggtcccaatattgacttcaagaaggagcttaggaccctcaacagagagcttcaattgcatattttggagctggcagatatattagttgagagaccatctcaatatgctcgtagggtagaagatattacgctcatattcaagaacttacatcatcttctcaattccttacgacctcatcaggcaagggccacattgattcacatgcttgagagccaaattcggcaccgcaaggaagcaattgaagatataaagcagaggagggaggaagcgcaaaaggtgcttggggaatcactgcttatcttggatggaagtcaaactaactaggctgacgccgtcaaggtagttggttcaagaccgattcttctatgagttagtgtgttagtagaatagaagacaagatgtgtctggattgttgtggtatcatctgttgtggcttgtggtatttccagctttgataactgaattttcttacttctatggtctatgttagcaaagttggattactttcttacttccattggtactcaactgcatcatgggttactttcttgtggaagtgtatattgtgagattgatgcctcgtggccagcttaattgaaaggttgttatatgct

SEQ ID NO: 507 - DNA, 964 bp, Zea mays
agatagacaggagagagagagagaggggaagagagagagagagagagagagagatagatgtggtaactcaagaactgttcttatgcatgcagcagccataagcattgctactagggtttcatgcggggcgaagcagctggtctctgccgcctgaacgccgccggaatctgcgaggcctccccgagctgcgtgcgtcgtcggataaggcagccggcacggcaatgccggttccgcttgctccgtacccagctcctccggcgccattcacgccgcccaatggggcccagagccagctcgtctgcaccgggtgccggaacctcctcatgtacccagctggtgcgacgtcggtctgctgcgccgtctgcagcaccgtcaccgccgtgccggctccaggaactgagatggcgcagctagtgtgcggaggatgccacaccctcctcatgtacatacgcggcgcgacgagcgtgcagtgttcttgctgccacactgtgaacctggctatggaagcaaatcaagtcgcgcatgtgaactgcgggaactgccgcatgctgctcatgtaccagtacggggctcggtccgtgaagtgcgcggtctgcagttttgtgacatcggttggaacctcacctggtgcagagcagaagcccagcagctgagctgatagtgtccctgaaagtgctgtgagaccacctatgaaaaggatgctttgagtgcacatgtatagagttcttccctgaagcgattctttcactttcttttcttttgttttcttttgttttcttttcttttttggttcctcctcaccatctccaccccacccgtccacttctgcgttccttcgatggatctcgcgagcccgcggaataaatgagagttttggatatatagctagggcttaacctcgtcgacttgtctgtaaaatcgaatgagacatatatataaacctatgttgttttccttgtttctg

SEQ ID NO: 508 - DNA, 1023 bp, Zea mays
caaagattccgttctcccagtcgcctctcccagtcccagatctcgttcactcgcactcgcgcaaccccgcggccccgcgcctaatggcatcctgtggcgccggcgacgccgcgtcagcgcagccgagggccagtatctcgcacgtcatcttcgatatggacggccttctcctcgacacggagggcttctacacggaggtgcaggagaagatcctagcgaggtacgacaaggtgttcgactggtcgctcaaggccaagatgatgggcaagaaggcggccgagtctgcccgcatcttcgtcgacgagtgcggcctcaacggcctcctcacccccgagcagttcctcgaggagcgcgagagcatgctccaagcgctcttcccatcctgtaccaagctgccaggagtactacgtttggtgcatcatcttcatgccaacggagtaccaatggctgttgcgacaggatcccataaacgccattttgcactgaagacccagaatcaccaggaaatgttttccctgatgcatcacgttgtcatgggtgatgatccagaggtgaaggctggcaaaccatcccctgatatttttcttgctgctatgaggaggtttgagggcggcgtagaacctagcaagtgcttggtttttgaagacgctccttcgggtgtagctgcagcgaaaaatgccggaatgtctgtagtgatggtcccggatccaaggctggatgtttcgtatcacaaaggagctgaccaagttctcagttcattgctggacttcaaacctgccgaatggggcttgccggcatttaaagagtagacattccatacaagataacaagattataagagtctagtgaagaagaatgtgagatactccctaagatgcaaattaaagagtacaattctttaagatgctgctcaaggaaaattccataaaatgttggtcaaacatacaattgaacattcttgtcgcctcctaactatgtgtcaccaaattactctgaataagttcgttccgattccgatataat

SEQ ID NO: 509 - DNA, 1828 bp, Zea mays
ccacgcgtccgcccacgcgtccggctctggacacatcagtctgttaatcctgaatgggagcaaagacatgtccaagttcaaccaggaagttcctattatgcaggcactgcaagtgatccatccaacctgggtgtgcaagttgctgtgggagttccaggaaatactgctaatgttggtatatgtgatttgcggaatcatgagtgcccgcatgttcataattcatacccacatgccggtgttacatcaagatttgtcttcccaactactatgtacagccctagcatgtcagcagcagctgtcaacatatatattcctcagactcaaagctttggactgggcagtgtgctaccaccatctttacataatcaagtttccacaggaattattgatgagagtagcagcagtgtcaattttggtgatagtgctattggattcatgaaaaggaaaaatgcagtagttgctggaagccataattttcttcatggatttgctgggtcaagttcatctgtccatgtgcctcagaatcctgtgcatggggcatggaatccttcatctcaatcaaattgtttacccagttctgcagcttcaaacctaccagaataccacaatagtaatgggtggccatacttagaagaatcttctgcagatgcttcaaacagtttcagttctgtggctgcttgcccggagctggcacctcatggtaactatttatatccagcttgtcacataagccagtccaatacatgggttccacagcctgcaggttacggagtaccacagtggggatatagtaatgcagtggtcaatcctccagacatgtcaaatgggccactgcctcatttctgccagaatagtatgcaggcacctcaaatacaagtgccccatcaacagtccatcggtaacaatgtggtgcatggtttaaatccttctgccacaggtcttcctttacatccaagaatgctggctctcccattcaatgctgagcacacttttgggcatccaatgcacccacctctgataaaccaagctaacaatggggctttaagaattctgccatatcagaacgctacagtgatggatcattcaaggatttatgaagcaggacatgttatcgatgaacatagcgatatgcgtttagatgtggataacatgacttatgaggaacttgtagcattgcaagagcagataggcgatgtcaatactggtttgacagaaagctatatccaggaaaacttgaggtccagttttcatgttccaggagcagctagcatgtctgatcagttttctgagctttctttggagaatgatgcttgcataatatgccaggaggagtataaagctaaagaacttataggaacccttgaatgcggtcacaagtaccatgtgaattgcataaagcaatggttgatgatgaaaaacctgtgccccatatgcaagacgacagctttgtcatcagatagaaggaacggatgaccgtcgccaataatgttgttggttgtttaccgcgtggcaaattagcgtggattttgtatatagacatggttgcctttatttgcccgtcccctttgctgtggacataaactgagcttcgaaacactgtacagatattttgtaggatgttttagacgttaaatggcacaatggtgtgtaaagctcccatgactgccttggtagatgccctcttcctttacattgtacattgtatttatctttactcttcaaaaaaagaagcttgaaaaccgtaagttctgtacattctggaattgaaagaaccggaaattttcttcaaaaaaaaaaaaaaaaaaagggcggcagttctagatcgcga

SEQ ID NO: 510 - DNA, 1244 bp, Zea mays
gcgcgcggcgccagcctccggcgaccggcacccgcctttcttttatacctccgccgcggcgacccacgccaaccttcgacccccctaaccctaccaaagcccgaactctcgagatcacaggacgcggatccaaaccagaggcccctgcctgccctctactcccccaccacaccacagcctaccgccatgtcggcgaccgctacggacgaggccgcggtggaggcgcgcctccaggagctgcgggggaggctcgggaagaagcagcacttcgaggaggccgtaaacgagctcgccgccgccgtccgggaccgctacgccggcgcctcccccgccctccgcaaagcgatgtattcaacggtttgccgcgttgcaacagtgcttcaaaccagatatacagctccaggattctggcatgttggtctgaacctcttcgttggaatagagaagctggtaagtaatcctgctgaaaaggagcacctgaagacctgcatttcgagggcccgtgagcatcttgatgaaaaggaaaatgaggattctgtgccaagcaacagagaagcagacaccagatttctttttgaagggcaccttactgtgggacaggaacctccacctccagcatggcttgttgcccagaatttaacgagggaattgagcatactaactgaatcctctggtgatcaagatgggagcaacaacagaacagtgcctagagccgaggagattacacctgctataatgaacctcctagaaaccatatcaggcgacagggatctagaaactgctttggaagaatcactgcagggaatcattgagtatccacagagggcacccccggcttcaaaggaagttgtcgccaatcttcctgtcattgctgttaccgaggaagtcatgtctagattgggtagtgagacggagtgtgctgtctgccgcgaaaacttggttgtggatgacaagatgcaggagcttccctgcaagcatctcttccatcctctttgtctgaagccatggctggacgagaacaactcctgccctatctgccggcatgagctgaggacggacgaccatgtgtatgagagcaggaaggagcgtgaaagggaagaggaagaagatagaaggggtgcggcaaatgctgttaggggtggagaattcatttatatctgaactcaacagttccagaatgtaatccctttgatgaacttcgttattaccatgttgacatctatatatacctagttacttaaaaa

SEQ ID NO: 511 - DNA, 1485 bp, Zea mays; identical to SEQ ID NO: 397

SEQ ID NO: 512 - DNA, 2086 bp, Zea mays
ggcgcggcagcgggcaggcagtccatccccatgtgtttgtgactttgtgctcgtcctcatacccccaccccccagctcccgtctcctcgtgctctccactgctgcatgcgcctcttgtcctgtccccctccccaccttgttcctcccatcccgcgccgtctctgcacgaagcagagcgccggtccaccgacaaggacagctacaactacgacgcgcaggcagagccatcgctcatctggggctgccctcggttactcctcccctccgccgctgcccctgccttgtccacagctgttgttaattccttcatgagttggcgtcggcgccagcggggcggaggggaaggaggcggggcttcagcttccccggcgccggccgccgcctgaagatcccttcttctcctgtagtcctgtcgtcgggcgggcgaggtccaagcatcatggggctcttaggtatgatgggcgactcttttggttgctcggcgactggggagcgacttgtgtctgctgcaagagatggagacatccaggaggccagggctctcttagaactcaatccccgccttgctcggtactccacgttcgggatccggaattcgcctctccattactcggcagcaaagggccaccatgagattgtctccctcctaatcgagtccggtgttaatattaaccttagaaattgcagagggcagactgctctgatgcaagcttgtctatatggtcactggaaagttgtacagattctagttctttttaaagctaatattcacaggagagattgttttagcggcgcgaccgctattcattttgccgcgctaaaaggtcatactcgctgcattcggcttcttgtggctgattatgtgcctagcttgtcagagttttggaccattatgcgtggaaagtccacagatgaaatgaaaaagggtgcctttgatgccgcgtctctccagagactagttaatggaaagtctgatggtggtgtcaccccgcttcacttggcagcccttcatggacatgctgagagtgtacagttgctgctagaccttggagcctctgtctctgaggtgactgtcaatgatggttcaacaattgacctcattggttcggggagcacacccctccattacgcggcgtgtggtggaagtgctgtttgctgccaacttctcattgcagcaggagcaaacatgggagctcaaaatgttaacgggttgactcctttattggtggctcgttcgtggcacaagactagcatcgaaggtattctaagcaagcaaccagaaaaccgaatgcgtattcttccttcaccatacctttgcttaccactgatgagcattgtcaaaattgccagggaatgtggatggaggaaaacttccgcctcatccacttgtcaggatccatgtgtcatatgtttggaggtggaatgcactgtagctgcagaaggttgcggccatgagttctgcaccaaatgtgcactctacttgtgctccaccactagcagctcaacatccacccgtggagttcctggctccatatcatgccctctgtgtcgccatgccatcgtctccttcatgaggctcaccagcactaccccgataaaggagcttccatggacaagcgcgtcactagctctatgtgcagcgggctcaaacactggccgccctgaacatggcgggtccttgcatcgaaggcctgacctgcgtcgactgcgctccatctcagttcagctgggatgctcttcttttagatccattggctctgggaagctgtcgtccatgaagctgaactgcacaggagctgaagaggcggtgccttgcctcgtcagctgcctcaggcccgatgtgcagcgttcatcgtcgtacaggggaagaattaggagatattcagagttttgaaaggatggttttgtggcgtccttcctgcgagtttttagggtttgggaatttaaacctgtgtcgtcatgttcctcttcgtttgtttccctgttgtttaatatgcatgcagtcctcgttgtgaagatctatttgtgtacatggcccgtttgtcttcattacttttacttatatgtgaattatataccaaaaaaa

SEQ ID NO: 513 - DNA, 2325 bp, Zea mays
gccttccacttcgcctcctcttctctctctcccccgtctcctgtctccacctgttccatcgcattctcctcccaccaccaccacaccacgcctcgcttatccccccccgagacccgacccctgctcgacgacgtgctggcaaaacctcctcctagtcctctcgcagaaggaggctgtgttctttccttcatcggtgcggcaacagcgaaagcttctcggtcgatctctcccaccgctgctccgccgtttgggtggttccgcgccttggccgcgcgggttggatccgagctccgtgcagcagctccgccgcgatacgtatcgcataggattccactggattcagctgctgagcagggtactggaaggtggatttgatactagctctgaacagccagtagaatttctcaaatactgtccaggatcatggcttctctctgtgatttctgtgggaaacaaaggtcaatgatctactgcagatcagatgcggcatcattgtgcttatcatgcgaccgtaatgttcattcagctaatgcactgtctcgacgtcatacaaggacccttctttgtgatcgttgtggttcacagcctgcatcagtccgatgtcttgaggacaacgcatcactttgccaaaactgtgactggaatgggcatgatgcagaatcaggggcttctggacataaaaggcaagccataaactgctactcagggtgcccatcatctgcagagctttcgagaatctggtcatttattactgatatcccgactgtagcagctgagcccgactatgaggatggactaagcatgatgacaattgatggcagtgatgttactaatcgtcacgatacttcagatgataaaagattgttggaaatagctaacacaacactcatgagcgatccaccttcagccgacaagcttaaatctccgacaggctcttcttctggagatgggtttgatgttatgactctagccacagatcagcctgctggaccagtttcagcaacgcctaaggtacctaatgccagagatgatgataagttcaatgatggcatgtacgaagacttgtgtgtagatgatgctgaccttacattcgaggattatgaagagctatttggtacctctcacattcgaacagaggaactctttgatgacgctggaattgacggttacttcgaattgaaagagacaccacctttttatttcaacgagcagcccaaagctatgcagatagaatgtggcaacgtggtatcagctgattgtgcgatgtcaaacccaggggcaagggctgattccagcctttgtattcccgtcaggcaggtcagatctagtatatcccactccttatctggtctgactggtgagagcagcgctggagatcaccacgactgtggggtgtcaccgatgctcctcatgggtgagccaccctggcattctcctggtggtccagaaggctcagtcgctggaggcagcagagatagcgctctcacacggtacaaggagaagaagaagaggagaaagtttgacaagaagatcagatatgcttctcgcaaggctagggcggacgtgaggaagcgggtcaagggacggttcataaaggccggtgaagcgtacgactatgatccgctaagccagactagaagctactgagccttgggagtgtgactgttgttgtcgtccagtgtcagcctcgcaatctccagccgctcgtcggttgcaggctgcgctacaggcaagatcactggagagcacaacgatcgcattgcatcagagcctgcaactgaaaaacgttaagaagagataccaagtgttaggatgaatgaaaaaaaaatacaaaaaagaaagatgcagacttgccggactcatatccattattcagtttctctgcggatgagtggcttggatcgcactgtgccatctgcgcgtcgaacagatgcagtgatggatgggcgctcgtcgtcctccagctgtaccgctgtgcgctaggacctgcgtcggctatatacggctgttcggcagtgagctgccaggttgtacagtctgggtaacagcctaacagggtatgcttatacctctcggttttcgttctgtaatacgtacgtattatttgcgcttgccaggagactgttcttcggccgtgtgtatgtttgtagatggttgcaacattggtaaaaaaaaaagtagccgtcgtgaatgtaaatttgtattcttgttaggtcgcatatagcgttggcgatgagcaggagaatcacacgtatctggacactgaacgtctgaacccttgtaactatttttgcgccagaataaccttcttgtgccttgtcgttt

SEQ ID NO: 514 - DNA, 2155 bp, Zea mays
cctagctacctggccgtcccctctccgattacggtcggaagcctcagctgaaggatctggacgacgggacaggttctgtttggtcttcataaagtagagcactagctagaagacatattcacacgcatcagctatcaaattgcaagcttagaattgacctcaaagttgggacatgcttgtcttaccagaagcaactgatagcttggagttgtagtccgtccggactgtctgctggaccagtatggctgacactccaacttcccgcatggtgcacccctttggcgacgtcccaaggcagactcccaagcaattcctgtattctggtaacccgcagcacctctgccatccgtaccagtcagctccggacacccatgtcgtgccgcagcgccgttacaccgtgaggtctcagtctcactcgccaaataatgctggttctcaagaccatgagactcacaagcagtacacgctggagtcctcggcggcttccggttgttcaaggcatggttctccctccagccaaagcgtccatgccgggagtggcagccctgtgtctcacgacgacagccactccggctccacgaacggccatggatcacctgtgagcgcgtcgtgtgtcaccggcgaggaccctactgatctcaagcagaaactgaaggatcttgaggctgtaatgctggggacgtctgagactgaccccgagatagtcaacagtctcgagatctccgcggcaaaccaactctcgttggagcccgaggagtgggagcacatggtgagcatgcccagagggaacctgaaggagctgctgattgcctgcgctagggcagtggaacgtaacaacagctacgccattgatctgatgatcccagagctgaggaagatggtttcggtgtccggcgagccgcttgagaggctgggagcctacatggtggaaggtcttgttgccaggctcgcggcctccggcagctcaatctacaaggctttgaagtgtaaggagcccaggagctctgatctcctctcctacatgcacttcctgtatgaggcctgcccctacttcaagttcggctacatgtcagccaacggcgcgatcgcggaggccatcaagggagaggacaggatccatatcatcgacttccacatcgcgcaaggggctcagtgggtctctctcctccaagcccttgcagccaggcctggcgggccaccgttcgtgagggtcaccggcattgatgattcagtctcagcttacgctcgaggcggcggtctggagttggttggcaggaggttgacacatattgctggcctctacaaggtgccctttcagttcgacgcagtcgctatctcaggcagtgaggtggaggaggagcatctaggcgtcgtcccaggcgaagccgtcgccgtcaacttcacccttgagctgcaccacatccccgacgagaccgtgagcacggcgaaccaccgggaccggatcctgaggctggtgaagggcctgtcgcccaaggtgctcacgctggtggagcaggagtccaacaccaacacggcccccttcgcgcagcggttcgcagagacgctggactactacacggccatcttcgagtccatcgacctggcgctgccgagggacgacagggagcggatcaacatcgagcagcactgcctggcccgggagatcgtgaacctggtggcctgcgagggcgaggagcgggtggagcggcacgaggtgttcggcaagtggaaggcgcggctgatgatggccgggttcagcccgtccccgctcagcgcgctggtgaacgccaccatcaagacgctgctgcagagctactcgccggactacaagctcgccgagagggacggcgtgctctacctcggctggaagaacaggcccctgatcgtctcatcggcatggcactagtgttgacttcagagaatgttgacctgatggagaatgtttcttgtaaccttcgaagtacctcttagtggtttagatatgtttggctggtcactggaactatctataggaagcctatggtgatagatactgagttgtagtagaacacatatagcctaaatgcctaatgctgtgatggcagtcactaccagcctagcctagaacaggttgatgatgtgtagtagtaagtttgggtatatgtttcagttaatc

SEQ ID NO: 515 - DNA, 1555 bp, Zea mays
cgtctgcctccccctccacaccaggccacgccacacacaggatagcgagcgggagcgacggcggcggcggaggagctagggttttgatccggcctcgccggctaggctgcgccgccccgacgccgaagccatggacagggagcttctagagacgtttgacgcggccaagaaggcggccgacgcggcggcaggggacggcaactcgccggaggctggccgctgcctcgacgcgctgcggcggctgcgcgacattcgcgtcaacaccgacatcctcgtctcgacgcaggttggcaaacgccttcgaccccttactaagcatcctcactcaggcattcaagcagttgctgcagacctttttgggtactggaaaaaggttgtccttgaagagtcaggaaagaaaaatggcggctcagagaatgaaagatcaagtgactcttcaggaaaggttgagaaggcgaggcccgtgaagattgaaaagaactctgcatcagcaagcatgaagcttgagaaaagagatgtggatgttactggtcagaagcctaacaatgccaaagttgagaagactactagtaatggttccaaagctcaatctgtgaaggtggaaaggatatccaaagaagtcataaggactcctgacgcaaagaggccagcatccgtccccaatggccacccaaagcttacatctcttgtcaaatgcaatgatcctacccgagataaaatccgggaactacttgctgaagcctttgtaagggtttcgagagagactagtgatgatgacagagacgaagtgagaaacatcttggatgaagtcgaggcatgcgacccatacagggttgccgtgacagtagagtctgcactattcgagaggcttggaccttccactgggactcacagggcgaaatacaggtcaatcatgttcaacctgagggctgaaaacaataccgatttccggaggagggtcctcatcggtctagtggcgccggagaggcttccaggcataccccccgatgagatggctagcgacgcaaggaagcaagagaacatgcagatcaaggagaaggctctgttcgactgtgagcgtggagcggcaccaaaggcgacgacggaccagttcaagtgtgccagatgtgggcagcggaagacgacctactaccagctgcagactcggagtgctgatgaaccgatgacgacgttcgtcacatgcgtgaactgcaacaatcactggaagttctgctgagtgttcagccttgctaaagtgtttacttagttgtgctgagcacactatcctgctgtgatgtgtgtgctctgttagttgtgactggaagttcgacagggcaggctgaacaactcaccttttttccccttttttaccccccgtaaactaggagcagttatcctcttcggctcttcctctgtcaggcagcctcctgattcattcagattgtactagtcgaacgcgtgaatgttgttgacttgatcgcatcgtcaccagctgtgaatgttcttgggtggagttagaatagaatggtgccaagtcagacgatgctgatggatt

SEQ ID NO: 516 - DNA, 1216 bp, Zea mays
gtcgacccacgcgtccgcccacgcgtccgcccacgcgtccgcccacgcgtccggatttttttaggcggctgctggcctgcctgtctccactggaagctccggattacgtaggaaaggggcgggcggcatgaggatccagtgcgacgcgtgcgaggccgcggcggccacggtggtgtgctgcgccgacgaggcggcgctgtgcgcgcgctgcgacgtggagatccacgccgccaacaagctcgccagcaagcaccagcggctcccgctcggcgacgccgcggcgctccccgccagcctcccgcgctgcgacgtgtgccaggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgccggcgccgcccaagggcagctccaagcccgcggccgtcatcagcgcgccagctgccgggacgaccaccaaaacaaggacggtcaaggacgcgctgccgcaggaggtgccgtcctcgccgttcctgccaccgtccggttgggccgtcgaggacctcctcgagctgtcggactacgaatccagcgacaagaaagactcgtctcttgggctcaaggagctggagtggttcgaggacatcgacctgttccacgcccattcgccagctaaaactgccatggcggagttcttcgcctcgccgcagccagtgagtaacgccgggttctacaaggcgaacggggcgcgcctgttcaagaagtcacggatggaggtgcctgacgacgacgacgaggactacttcatcgttcctgatcttggctgagatgagagatctctgcatgattctccagtcatgtgatgtgtgtatgtatgcaaaatatgtatgtataccatcatggggtgcactgacgcttacattggacatatgtaattatccagtcatgtgatgtgtatgtacgcaaaatatgtatgtatgccatcatgggatgcactgacacttacgttggacacatatgtaattataaagatcaggctgctggccaggaacactcatcgttgaggtgggagggcttaagtgaataaaaagcactaatcgttggattaagaaaaaaaaaaaaaaaagggcggccgc

SEQ ID NO: 517 - DNA, 2033 bp, Zea mays
ccggcttgagcaataattgacttgacctcacttcccctgtggggaggcttttcttccgatcgatcatagtatccgctgcggtgtgactgcctgccccaccccattgcgcctgcgcctcgcttcatccggtgcgctgcccacctcactcccgtcgtcctcgttctcgtcgcggagcggtgtggaggcgcgcgctcctggaaggcacggggcaagagcggaggtgagtgagcccgagccccgtggattgctggttcggtggtcggaactcgtggagtagcaagagcggcggcggttacgacatctcacgccagcagtttgtcctcatctaccacccacctcccctgatcccctccccagtacccacttctctcatatcccctcccgcatcatctctttttttttctctcctcttagcgaggacgccgaattcgcgattggcttaggcggtgtgtgtggatcaaatcgagtctggaagatcatctgggtgttggagtcatccagaggcacaagctgaggaatggggcaaaaggactccaagccttcacatggatatggctactcttcttatgattacgggagtgcttcatcgggatacacctcgagaaacactgggaattcgtcctccagttatagcgtcaggtacgcgccttcttcggagaacagtgtacagccggagacacatgccaggttgcagaggaagtattctaagatcggtgatgactaccgttctttgagccaggtgactgaagctttggcacaggcaggccttgaatcttcaaatcttattgtaggcattgattttacaaagagcaatgaatggacaggtaaaatttccttcaatcgccgctgcctgcatgatattggaaacactccaaacccatatgagcaagctatatctattattggaaggacactttcagcatttgatgaagataatttaattccctgcttcggatttggtgacgcgtcaactcatgatcaggaggtatttagcttttacccagagaaccgcccatgcaatggatttgaagaggcgctagacagatacagagaaatcgttccaactcttcgattagcaggacctacatcttttgcgccgatgattgagacagcaattggaattgttgacagcactggtggtcaatatcatgttcttctgataatagcagatggacaggttacccgaagtgtcgatacacaatctggacagttgagtccacaggagcgggctactattgatgcaatagtaagagcaagccagttccccctgtcaattgttcttgtcggggttggtgatggaccatgggacatgatgcaccagtttgatgacaatatacctgctcggtcatttgacaatttccagtttgtgaatttcacggaaattatgtcgaagagcatagcagctgacagaaaggaggcagaatttgcattgtcagcgctgatggaaatccctacacagtacaaagcaacaattgatctccaactcttaggccgtcgccaaagaataaccccaagaattgctctgccaccaccaacaaggaccgcgtattcgcggtccagtagctttagccaacagtctggtgtttattcgcgatcaagtagctttgaccaacaaacaagtggcgcctctcagcaacgttctgagagcttgaaacagcagaagaaacctgcagccacgaagagacctgacacttatgcttcagaaagagctttagaggacagaattctgtgccccatctgcatgtataaatccaaggaccttgcatttggatgtggacatcagacttgctacgaatgcgggagaaatttggagcgctgccctctgtgccagcagaacataaccacgaggatcaggctctactgatttgatcaggctatggattagaaagtgttggaacaacagactcccgggcaagatgttcagaaccagctttgttggtaccgtgcttcattttgtaattggtgtcacttttctctgtagttatgccaaaggaaagcgcaccagaaaataatgtacatatttatcttccagt

SEQ ID NO: 518 - DNA, 1830 bp, Zea mays
cagtaattgacttgacctcacttcccctgtggggaggctttaattttcttccgatcgatcatagtatccgctgcggtgtgattgcctgcccccaccccattgcgcctgcgcctgcgcctcgcttcatccggtgcgctgcccgcctcactcccgtcgtcctcttcctcgtcctcgctctcgtcgcggagcggtgtggaggcgcgcgctccttgaaggcacggggcaagagcggaggaagatcatctgggtgttggagtcatccagaggcacaagctgaggaatggggcaaaaggactccaagccttcacatggatatggctactcttcttatgattacgggagtgcttcatcgggatacacctcgagaaacactgggaattcgtcctccagttatagcgtcaggtacgcgccttcttcggagaacagtgtacagccggagacacatgccaggttgcagaggaagtattccaagatcggtgatgactaccgttctttgagccaggtgactgaagctttggcacaggcaggccttgaatcttcaaatcttattgtaggcattgattttacaaagagcaatgaatggacaggtaaaatttccttcaatcgccgctgcctgcatgatattggaaacactccaaacccatatgagcaagctatatctattattggaaggacactttcagcatttgatgaagataatttgattccctgcttcggatttggtgacgcatcaactcatgatcaggaggtattcagcttttacccagagaaccgcccatgcaatggatttgaagaggcgctagacagatacagagaaatcgttccaactcttcgattagcaggacctacatcctttgcgccgatgattgagacagcaattggaattgttgacagcactggtggtcaatatcatgttcttctgataatcgcagatggacaggttacccgaagtgtcgatacacaatctggacagttgagtccacaggagcgggatactattgatgcaatagtaagagcaagccagttccccctgtcaattgttcttgtcggggttggtgatggaccatgggacatgatgcaccagtttgatgacaatatacctgctcggtcatttgacaatttccagtttgtgaatttcacggagattatgtcgaagagcatagcagctgacagaaaggaggcagaatttgcattgtcagcgctgatggaaatccctacacagtacaaagcaacaattgatctccaactcttaggccgtcgccaaagaataaccccaagaattgctctgccaccaccaacaaggaccgcgtattcgcggtccagtagctttagccaacagtctggtgtttattcgcgatcaagtagctttgaccaacaaacaagtggcgcctctcagcaacgttctgagagcttgaaacagcagaagaaacctgcagccccgaagagacctgacacttatgcttcagaaagagctttagaggacagaattgtatctgtgccccatctgcatgtataaatccaaggaccttgcatttggatgtggacatcagacttgctacgaatgcgggagaaatttggagcgctgccctctgtgccagcagaacataaccacgaggatcaggctctactgatttgatcaggctatgaattagaaaaatgttggaacaacagactcccgggcaagatgttcagaaccagctttgtttgtaccgtgcttcattttgtaattggtgtcacttttctctgtagttatgccaaaggaaagcgcaccagaaaaaaataatgtacatatttatcttccagtagtactgtacattgcgagctgcacat

SEQ ID NO: 519 - DNA, 2508 bp, Zea mays
agccaccccagtccgctgcttccattccatctcccttctctcgccttctgcggcactgcagtgctctgctgcctcggcgtctccacctcctcccggcgacggcagggcatccgatacgacgccgcgcttccttccgaatcccaagccgcaccccgcaccctcccggtcgccattcccgatgctggtgttctcgagcgacgacgactgctgcggctcctcgtactaggggggcaggatcgatcggcagactcgcagaactataggatatcacagaacagttcttgaggtacttattgcagcctaatagtacatggagcgatattcagatatgagaccaaaggcagaagtttcatatctcggaaggggttccagattctcttctagaaatcaaagttcagaagagaggactaaccatagcagcgataaaccgggaagcagcacaagattcaatcctacgaaagcgagaattggcggtaatcaagggaggccaagatatgtatgcgattcatttaaatctccaagctcaaaggtgtcgcctgcaggctcttccaaatttccacttagcaagtttgaggagaggcgaagacagccttttgtgccagggtttgacattgctgaaagtagtagaagaaaggctgatgccaagcagctacagggtagtaagaaaattgctgcagagaacgacagttcagacaatctgcgaggtgaatcagaaggttttactactgaacaagtagtaaaaccagaaggctctcatgttgtcggtcattcaggtgtttctgcgtatacagtcgggtccctggtccaaactgcttcactaggttctaggacacacagacagaaacacaaagaagtgaatttgggtactccaggagcatcgtcttcaactctgactaacaggtctactatacctggaaattctaccatgggtgtgaggccagcttatggtcatgttaatggagggcagatacatggtcttaaaaaccttggttgttcttcggtacctgatgctcagccatcaggttgcccatctgagtctgttattagtaggaggaggtttgagttcatgagaaagagggcctttgaccaggaaagctcttccagatcagtgaacttaagcttaggtcattcaactcctacagatattcgcagaatcagaatgaatgaacaatcactttgtcaacaaataccacgaagcagcagcagaagccatcaggaatcggcaggttcagttaggacaagacgaccttctcctcatgccactaggatgagtgttcctgatggaagagcagatggcgtgctttctctgcacgagtcatccacaaaggatgtacagccagctcaggaacatctttcattggaagaagtctccactgagagttcaataaggccattctttgtggaatttgataataacattttctcgtctagtcatcttcgtcgctcgagtactcgagctgaaaggggaagaccaagctccctttttgaagaaagtcctcgacaaatgttccatagtctcatgggggagagggacagacatagacacataaccatggaaggaattacagaggttgctttctaaaatgtttcctatactggttccagttgttctgttttcgttgttagatcttatgccattataatccagttaaatatatagtgatactggtcttgattttgataaatatccataactttgactacgatggtggtttaagtgtaacattttggaatgaaataggtttattttctgtaggttttggctgcattggagaggattgaacagcaagcagagctgacctatgatcaattgctaatgctggaggctaatctattttttggcgcctttgcctcctatgatcggcatagagacatgcggatggatattgatgatatgtcctatgaggaattattggccctggaggagagaataggctctgtgagcacagctctttcagaggagcagttcacaaaatgcctcaaaagaagcatatatagtcaggtcgctctagaagtgaacaaatcaaccgttgatgacatgaaatgcagcatctgtcaggaagagtacgcggagggcgaagaggttgggaggctgccatgcgagcaccggtaccatgtgtgctgcataggccagtggcttgggcagaagaactggtgtccagtatgcaaagcgtctgccgtgccttccaagggctgaagcattggggatgctggaaaccccgttccggattacaaaccatccttgcttttgtctacgtacattgttcttttccctatatgcattagatatagatcatgtctagatgtatgacgctagaacagcttgcgatttgggaggaagctaagagagtaatagttagctggttaataatagttcatagctaatatttgctagataactattacttggctacctattagctgtgcctttcacattgtggtacaggacaaatgcttgtcagatcgtgaacaaccttataacttgatgaatggcctaagtcaaagagg

SEQ ID NO: 520 - DNA, 1384 bp, Zea mays
gccgctgttcgcaacccaagcagtagccgagccaacgaaggcgtgcgagcggaggcaatcatacatggacggcagccgcaagagggtggacgcggaagacgtcaaaggggattccaccggcgggaagcgattgcgagcatcggagtcatttcaaagtggcgtaggaagcaaagtgaagctatgcaccaattttttcagtacttatggttgtccctttggtgagggctgccattttgtccattacttccctggtgactaccgggccgtttcagaaatgaccaacctgggtggcgcaacaatcgcacctcctggaggaatgatgatggatgggccacctacacccatcgtgaagactcgcttgtgcaacaagtacaacactgcagagggatgcaaatggggggacagatgccactttgcacatggtgaaagtgagcttggcaagtctatgatggacaactatatgccaccccccatcggaccaccaccaaccggttattttgcacctccacctatggcacctccacctatggcgcctccacccatggcacctccacctatggcacctctacctatggcgcctccacccatggcacctccacctatggcgcctccacccatggcacctccacctatggcgcctctacctatggcgcctccacctatggcacctccacctatggcacctccacccatggcgcctccacccatggcacctctacctatggcgcctccacccatggcacctccacctatggccaaccctggtttggccactccagctagcttcggcgcttatgccacggccaagatcagtgtcgatgcgtcccttgcaggtggcatcattgggaagggtggagctaacataaagcaaatatcttccgtcacaggggccaaggtggtcattcaggaggaccgccatgaatcagacaccagcttgaaaaacattgagtttgagggcacctttgatcagatcaggaacgctagtgctatggtcatcgagctgattgttagcatcagtggcataggaagcaacttcaagaccaagatgtgtgagaacttcgcaaaagggtcatgctcttatggcggcaaatgccactttgcccatggtgagagtgagctgcgcaagcctgccgctgcttgagatccatgccctgtttcttacctcatagtcattagtcaatgtaactcaaaacttggcctctgatgatggatttgttggcttctttaggtctacgctaatgaattgctggcttcaggcctactactaaatttgctgacttctttagtccttcgctgttggccaactaaaaaaaaaaaaaaaaaaaaaaaaaaaaaaaaaaaaaaaaaaaaaaaaaaaaaaaaaaaaaaaaaaaaaaaaaaaaaa

SEQ ID NO: 521 - DNA, 1197 bp, Zea mays
cggacgcgtgggcagctcatcatcacattcgcatacatctcttctagcacgcaaagatcgagctatagctagctctgcaacaagagagaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgaggaggcaagcaagcgtgacgccgagacggcgcccccggcagccaaggcgcccgtggtgggttggccgccggtgaggtcgtaccggaagagctgcttccagcaggccagcagcaagcaggcggcagcggccaaacaggaggcggcggcggcggcgcccggctgcacggcatcgtcagcagccgccacaaacaccaccagcagcagcagcgccgccgtcgtcgttggctccttcgtcaaagtgagcatggacggcgccccgtacctgaggaaggtggacctgaggatgtacaggggctacagggagctccgggaggccctggaggccttgttcgtctcctccagcagcgccaacaacctgtcggagttcgccgtcacctacgaggacaaggacggcgacctcatgctcgtcggagacgtgccgttcgagatgttcgctagcacctgcaagaagctgaggatcatgaagagatctgaagccacaggcctggggtcgtcgtcagcgaggcaacaatgaagatctcatctgatctatcgagaggacctgcatgcccggcaacaacacgtcgatcgatcgtcatggccttattaattgtttctttctttcttttcttttctgtttaattatttttgttgttctggttggcgccgccgtggattggagggatccccaagccgaaggatgagcttggctggcgcatcgaagcgcatgcaacggatgtgtgcggctttggttctgtaataagacaaccaggggtcctttttttcgatctgttattagcggcacaaaaggagctagatgcatgctgaggttgtttcagttcactctccatgtgtgtctgtacaaacgaaacaatacagttatattgatcgttgatcccttaaaaa

SEQ ID NO: 522 - DNA, 1161 bp, Zea mays
cttctctcctcgtccaaagactccaagcttctgtgacctctgttctgctgccgcctctggtccacatctctctacgccgccgccccgccgtccaccgataccgcagcgctgggaaggatcacgggggagcggagcgaggcggggggcccgcggttttgtcgcccggatggcggcgcagcgatgacactggcggcgggagcggcgcggcgttgggatgcggacgatctgcgatgtgtgcgagagcgcaccggcggtgctcttctgtgcggccgacgaggctgcgctttgccggccttgcgacgagaaggtacacatgtgcaacaagcttgctagtcggcatgtgagagttgggcttgcagaccctaataaactggcacgttgtgatatatgcgagaattcacctgctttcttctactgtgagatagatggcacctcactttgcctgagctgtgatatgactgttcatgttggtggcaaaagaacccatggtagatacctgctcctaaggcaaagggttgaatttccaggagataaaccgggccatatggatgacgtgcctatggagatcaaagatcctgaaaaccagagagagcaaaacacgcccaaggagcaaatggcaaaccaccataacgtcaatgatccagtctctgatggcaattgcgatggccagggtaacattgattcgaaaatgatcgatcttaatatgcgcccggctcgtactcatgggcaaggatcaaattcccagactcagggggtggatcttagtgtgaacaaccatgactctccaggggtggtgccaacaagtaattccgaaagagacgccatcaagtaaacattggaagattggaatgtacatttcaactacatatactgttctataggagctcctggggcagaaatggggttattcagtggtctctctgttattactagtaagcgtatttctggcagagttggagctaataactgcatctcaattcggcttgtcgtgccctagacggtattgctgtccaattgcattctctttgcgattgttagaactctgtatagaagcgcagcggctgccgcctgtgctctggagccggagtatcgtgtgccattagaaactgtacaaaagattaatagaccgctcatttttctctggtcgcacaagttcaattc

SEQ ID NO: 523 - DNA, 1183 bp, Glycine max
cggctcgaggagaaagggcttttttgagtaataggattattatcagtgaaaagagttcccttttttctctgtaaataaaagggttgttgttattattattattgcctagtgtttgttttcagatctgtgtcgtattattaagcagaacaagcaagggtgcaaagtgggggtgtttttttcgctggatgagtggtagctgacactcacttatggcgtctgaaacggcgtcgtcggcggatgaagaaaccgttgttgttgtttcggctgctgcgggtgcaggaggaactgataagagaggcaagcaccggattcttgccgaactgaagcgtctcgaccaagaatccaagtttcttcaggaagaattggaagagcttgagaaaacagaaaatgtgtcgaccatatgcacagaattgctacaaaacatagacactaggcctgatccattactcccagaagtccatggacccgtaaatctcttatgggatagatggtttgaagggcctcaagatccacaggcatgaagatgttggatactttgatttgaagctgtgtcaattgccttgcgttgcaaataggatgccacatataactgcattaaagtgactctggagctgaagaaaatgtttgatgacatgttataccacgcacactaattctataatggatccttgcttttattacattagattctgttccgaatactgtttatgtgtaatcacattcatatactgcattcaactgagaagtatcattatttgtgcttgtaatcccaatccaactgttaatgcacctgaccttggtggactttcatgtgtgcacgagacgttagagacattttagcatcattcagccttgaaggtggtgtggcttttggaaaggcctttacaatgcaatggtttgacgagtcatcaactagtcctgaatgataacgagattttttgggcagagacctcttggggttgggagagcaaagaaagctcataatcccttgtttgagtcatttcacaattaaatgttatgataagattttgtaatcatgttacttctaagcctttttaagttttggtgttttatttaacaagccattactttttgcgtgccaaaaaaaaaaaaaaaaaaaaaaactaaaaaaaaaaaaaaaaaaaaaaaaaaaaaaaaaaaaaaaaaaaaaaaaaaaaaaaaa

SEQ ID NO: 524 - DNA, 1404 bp, Glycine max
gtgagactcacggtcatgactcatgtaaattcgtctcccacaacaacactagctctcacgtacataaatataaagatgttgatagcatattataaatcatagagttcattccatacacagaaagaagaacaacactaagaaagcagaatagggaaaaatacatcgatagaggaaaattaattgaagggtgctactactacgaccttctatatcattaatgattgaaattcgtgttggaattgtcttgtaggtgtagtagtgataataagagaggatcatatatatattagtagtgctagaaattaattgaagtgtgtaatagaatagagtgtgatagagagagatatggggagaggaagggtgcagttgaagaggatcgagaacaagatcaataggcaagtgacgttttcaaagagaaggtctggtttgctcaagaaagcacatgagatctctgtgctttgtgatgctgaagtggccctcatagtcttctccaccaaaggcaaactctttgagtactccagcgatccatgtatggaaagaattcttgaacggtatgagaggtattcatatgcagagaggcagcttgttgcaagtgatcaaccacaaactgaaaattggactctagaacatgcaaagctcaaagcaaggttggaagtcctacagaaaaatcaaaggaattttatgggacaagatttggagggcctaagtatcaaagagcttcaaaatttggaacatcaacttgatagtgctctaaaacacattagatcacggaagaaccaaatcatgcatgaatctatttcagagcttcataaaaaggataaggtcctacaggaacaaaataacactctcgcaaagaagataaaggagaaagagaaggcactagcccagcatgcacaaatggagcagcgtggtgatgaaatggatcttacttcctctgccctagtacctcatccattggagacatcaaacattagagagtcctcacaaataaggggtgaaggagataatgaaggaaccccaactccaacccgagcaaatgccattcttccatcttggatgcttcgtccttcaaatgaatagaagagtattaacgacctaaaattttaaattacatatgaatatggcgaatacaaagcttaccctataagatgtaaaatggtctatgtgttgaattgtgaacaccacccaatgagttcaattggaatatcatagatatgtaatgtgtctctgactactacatttcaaggatgctaagtaaattatatggtatggcctgtctagatatagacctgcaatacatatatagtgtcaattatgtatgcttggttcttatcaaaagtttaagttggactttacatgcctctcttcctagaaattcggaaggtaaacataatttcagtacac

SEQ ID NO: 525 - DNA, 1054 bp, Glycine max
gaaaaaagccttgactaatagtccataccataattttcctctttcctctgtgcctcgcttcttcttgaatccatgcgcatgagtttgaagaattgtgttagcggtgaggtgagatatttcaatatttgataattgatagtatatatatggggaggggaagagtggatttgaagaggatcgagaacaagatcaataggcaagtgactttctccaagagaaggtctggcttgcttaagaaagcgcgcgagatttctgtgctgtgcgatgctgatgtggctctcatcgtcttctccactaaaggcaagcttttcgactactccaacgaaccttgtatgaaaagaattcttgaacggtatgagaggtattcgtatgcggagagacaacttgctggagatgatcaagcaccaaatgaaaactgggttatagaacacgaaaagctcaaggctagggtggaggtactacagcgaaatcaaaggaattttatgggagaagatctggacagcttaaatcttagaggacttcagagtttggaacaacaacttgattctgctctcaaactcattagatcacgaaagaaccaagccatgaatgaatctatttctgcgcttcagaaaaaggataagtcactccgggaacacaacaacttgctctccaagaagataaaggataaagagaaggagctggccccacaagagcaagatggactgcaaaataacatggatgtgacctctgtccttgtaactcaaccaccggagtccctgacaattggaggcttcccagaagccaaatgtaatgaagaaactccaacgtcgagtcgacctaaaaccattcttcccccttggatgcctcttcctacaaatgaatagaaagcctgttaactcttgttaaatacgaataccacttgtacaaagactagctatatacatcatcaggggcatttgatggtgactataccacctggattgtaatctctgtgtgacgtttctgactgcattttaatgcagctgcaaggtatattaaatgtactacatataaatataaatgatactgatat

SEQ ID NO: 526 - DNA, 738 bp, Zea mays
atggggcgcggtaaggtgcagctgaagcggatcgagaacaagatcaaccgccaggtgaccttctccaagcgccgctcggggctgctcaagaaggcgcacgagatctccgtgctctgcgacgccgaggtcgcgctcatcatcttctccaccaaagggaagctctacgagtattccaccgattcatgtatggacaaaattcttgaccggtacgagcgctactcctatgcagaaaaggttcttatttcagtagaatctgaaactcagggcaattggtgccacgagtatagaaaactaaaggcgaaggtcgagacaatacaaaaatgtcaaaagcacctcatgggagaggatcttgaaacgttgaatctcaaagagcttcagcaactagagcagcagctggagagttcactgaaacatatcagaaccaggaagagccagcttatgctcgagtcaatttcggagctccaacggaaggagaagtcgctgcaggaggagaacaaggttctgcagaaggagctcgcggagaagcagaaagcccagcggaagcaagtgcaatggggccaaacccaacagcagaccagttcgtcttcctcgtgcttcatgataagggaagctgccccaacaacaaatatcagcatttttcctgtggcagcaggcgggaggttggtggaaggtgcagcagcgcagccacaggctcgcgttggactaccaccatggatgcttagccacctgagcagctag

SEQ ID NO: 527 - DNA, 801 bp, Zea mays
atggggcgcggcaaggtacagctgaagcggatagagaacaagataaaccggcaggtgaccttctccaagcgccggaacggcctgctcaagaaggcgcacgagatctccgtcctctgcgacgccgaggtcgccgtcatcgtcttctcccccaagggcaagctctacgagtacgccaccgactcccgcatggacaaaattcttgaacgctacgagcgatattcctatgctgaaaaggctcttatttcagctgaatctgaaagtgagggaaattggtgccacgaatacaggaaactgaaggccaaaattgagaccatacaaaaatgccacaagcacctgatgggagaggatctagagtctttgaatcccaaagagctccagcaactagagcagcagctggagagctcactgaagcacatcagatcaaggaagagccaccttatggccgagtctatttctgagctacagaagaaggagaggtcactgcaggaggagaacaaggctctgcagaaggaacttgcggagaggcagaaggccgtcgcgagccggcagcagcaggtgcagcgggaccagcagacacatgcccaggcccagacaagctcatcatcgtcctccttcatgatgaggcaggatcagcagggattgccgcctccacacaacatctgcttcccgccgttgacaatgggagatagaggtgaagagctggctgcggcggcgcagcagcagccactgccggggcaggcgcaaccgcagctccgcatcgcaggtctgccaccatggatgccgagccacctcaatgcatag

SEQ ID NO: 528 - DNA, 801 bp, Zea mays
atggggcgcggcaaggtgcagctgaagcggatagagaacaagataaaccggcaggtgaccttctccaagcgccggaacggcctgctcaagaaggcgcacgagatctccgtcctctgcgacgccgaggtcgccgtcatcgtcttctcccccaagggcaagctctacgagtacgccaccgactcccgcatggacaaaattcttgaacgctacgagcgatattcctatgctgaaaaggctcttatttcagctgaatctgaaagtgagggaaattggtgccacgaatacaggaaactgaaggccaaaattgagaccatacaaaaatgccacaagcacctgatgggagaggatctagagtctttgaatcccaaagagctccagcaactagagcagcagctggagagctcactgaagcacatcagatcaaggaagagccaccttatggccgagtctatttctgagctacagaagaaggagaggtcactgcaggaggagaacaaggctctgcagaaggaacttgcggagaggcagaaggccgtcgcgagccggcagcagcaggtgcagtgggaccagcagacacatgcccaggcccagacaagctcatcatcgtcctccttcatgatgaggcaggatcagcagggattgccgcctccacacaacatctgcttcccgccgttgacaatgggagatagaggtgaagagctggctgcggcggcgcagcagcagccactgccggggcaggcgcaaccgcagctccgcatcgcaggtctgccaccatggatgctgagccacctcaacgcatag

SEQ ID NO: 529 - DNA, 1314 bp, Arabidopsis thaliana
atgccaactttgtacaaaaaagcaggctcctgcaggaccatggatcctgaaggtttcacgagtggcttattccggtggaacccaacgagagcattggttcaagcaccacctccggttccacctccgctgcagcaacagccggtgacaccgcagacggctgcttttgggatgcgacttggtggtttagagggactattcggtccatacggtatacgtttctacacggcggcgaagatagcggagttaggctttacggcgagcacgcttgtgggtatgaaggacgaggagcttgaagagatgatgaatagtctctctcatatctttcgttgggagcttcttgttggtgaacggtacggtatcaaagctgccgttagagctgaacggagacgattgcaagaagaggaggaagaggaatcttctagacgccgtcatttgctactctccgccgctggtgattccggtactcatcacgctcttgatgctctctcccaagaagatgattggacagggttatctgaggaaccggtgcagcaacaagaccagactgatgcggcggggaataacggcggaggaggaagtggttactgggacgcaggtcaaggaaagatgaagaagcaacagcagcagagacggagaaagaaaccaatgctgacgtcagtggaaaccgacgaagacgtcaacgaaggtgaggatgacgacgggatggataacggcaacggaggtagtggtttggggacagagagacagagggagcatccgtttatcgtaacggagcctggggaagtggcacgtggcaaaaagaacggcttagattatctgttccacttgtacgaacaatgccgtgagttccttcttcaggtccagacaattgctaaagaccgtggcgaaaaatgccccaccaaggtgacgaaccaagtattcaggtacgcgaagaaatcaggagcgagttacataaacaagcctaaaatgcgacactacgttcactgttacgctctccactgcctagacgaagaagcttcaaatgctctcagaagagcgtttaaagaacgcggtgagaacgttggctcatggcgtcaggcttgttacaagccacttgtgaacatcgcttgtcgtcatggctgggatatagacgccgtctttaacgctcatcctcgtctctctatttggtatgttccaacaaagctgcgtcagctttgccatttggagcggaacaatgcggttgctgcggctgcggctttagttggcggtattagctgtaccggatcgtcgacgtctggacgtggtggatgcggcggcgacgacttgcgtttctag

SEQ ID NO: 530 - DNA, 1320 bp, Zea mays
attcggctcgagcgccaccatccaatcgaagctctggaacctcctccactcccagcttccgccgacgctcgcttcagctgctgctttccttcccatccttcaacaggtgcaatttgcatttcccatggagctcactgattaataacgtgtgagctgaacttgcttttctgtggacaatttggaacttcagtactagtttccgataggattcagggagaaatgatctcttttaacaatttattttggagctcccttcagccttctttcaagttttacagaaagtgcctgacaaactgcccatattttgcactgaccatgcattcaactacaaagcccttgggttcatctatgccggtaaagagggcgcatttgaagccacatgccgcagacatcaagaggaacccccatgtacatgagctttacaaattggtttaccgacttccggagaaccttagctggctgttggcaccaccagaaattcctaaaagacctgcctcaaagaagaaaaaacaaaaagacgaaatagtggccggtaacagctttggtgtgatcttggagtgggagggagttgttgtggatgatgatgatccagacttggagccccgggtttggtatgttctatcactagaagaggggaagtctttccctccagatgcattgctgaagaaaatcgagggaatgagaactgaccaggctattgcagaagtcttatgttggtcagaagatccagcagaaatccaaaggttggcaacacacaaggaggttatatatcaaaaacttcaaggtggatactaccagctgcgaccacatgtgcttgatttcttgaacacccttgtgggttttgacattccaatagcaattgcagctcctcgctcaaggaagagccttgaagaagggatcaaaactgttggtctgcaaggctacttcgatgctatagttgcattggaggacttctgcttagggaaacctgatggtgagatgtttgaagtcgcagcggagcaacttggtctggaaccagatgcctgtgttgtgtttggtaactcaaacttgacgacggaatctgcacataacgctgggatgaggtgtgtggcagttgcaggccgacaccctgcctatgagctccaatcagcaaaccatgttgtgagatggcttgatcagctctctattgttgacttgcagaggcttgctaatggtgaagttattggtcgcaggggtagagaatctgacatggatatggaaattgtgattgaggaatgatgatgtttctgcaaaaatgacgcactaatatattgttgtgcttataaaaaaaaaaaaaaaagg

SEQ ID NO: 531 - DNA, 1710 bp, Glycine max
attcggctcgagggaaacgtatagaaaaagcttttccaagaattggcaaaaagagaagaagggagagagattcatgttcatattttccccttcgtgcccgtcaagtttctgattctctttttcaattcctttctctttcaggtgattttttctccacgataaagttgcgatttcgccggtgtcgttttgccgcaagatggtgtcgttttcgggaatataaaatcagggttgaagttctttcttcagcattgaatctttggttacataggttggtttctttagaactcgattcaatttcaaataattggtcctccctttttgtggaactcaattctattaggttagtggaaagagaaaaaaaaacatggttgaatcaattgctgcaacttcactccttggccaccgtccaatttgtggtggaaatttaaccagggatgtatctgttaaacgcaaatctttgaatactgttcggttcccaacaactgagtttcttggtggtggaaggattgtggtttctctggctttgcctaaatctgataagcaagataggtttgtgttttcatcaattaaggccttggctgtggagttaacaagagaagcacatgcttatagggaagagaaattgcccaacagggataccaagattgatcgtggatttgatcaaaggcctgattcgtggcctcctgcgaatagggcagataaaccgtcgcttcggaatccactactccgtcatgagaggatgggatgtggttggttgggtgctatatttgagtgggagggtgttctaattgaagacaaccctgatttagagaagcaggcttggctggcactctctcaggaagaaggcaaaccctctcctcctgcttttatcctcaagagaatagagggcatgaagaatgaacaggcgatttcagaagtgctgtgttggtctagggatccggcacagttgagaagaatggctaatagaaaggaagaaatctaccaatctttgcagggtgggatatataggttcttgtctggatccaaggagtttgttagtgttttgatgcattataagataccaatggcattggtttccacgcggcctaggaaggctcttgagtctgctataggggagattgggattgaggacactttcagtgttattgtagcagcagaggatgttcataggggaaagcctgatccagaaatgtttgtgtatgctgcacagcttttgaacttcatacctgagaggtgcattgtgtttggtaactccaatctaacagtggaggctgcacatgaagcgcggatgaagtgtgtggctgttgctagcaagcatcctgtatatgagcttggggctgcagacttggttgtcaggcgcctagatgagctttcagtggttgatttgaagaatcttgcagacattgaaatgactgaatttgggtctgtggagcctgagatggagctggaggtggaaaaagattatggctcatcatcagttgatgacaatttctggtaaatcctataatgtacagttgattgaacctcatctgattgttgatgatattagttacaggttagttacttgtgtatatggtaatcagaataaatggggggaaaaaatgataagtggtatgcattgaacattgatgttactactaatgcattttctgttcatatacattcacgaatttttagatttaaaaaaaaaaaaaaaaaaaaaaaaaaagg

SEQ ID NO: 532 - DNA, 1201 bp, Oryza sativa
tgtttttaagacaggtcaagtttgattcttctcttgttctctttgttctttataggagcagaaccagacttgccacgaaggatttgataatctaggggttcgggacgagatgatattttcagtcagcttatttggtagttcccaccagtccattcacaaactttacaggaaatgctggtcaagtaactcacattctacactgaatgtgctttcacttgcaaaaactgtgggtcaaagtatgagaatgaagaggatacgtgtcaagcctcatgccactgacctgaagaatcgcccccaggcccatgaggataatgtgttctacaaattggtttataggctccctgaaaacctcagctggctgttggcgtcaccagaaatggctagaagaccaccctcaaagaagaaactaaagaaggaagaaatggtaagtagtaatcaatttggtgtgatcttggagtgggaaggagttgttgtggaagatgatgatccagatttggagcctcgagtttggtacgtgttatcacttgaagaggcaaagtcttttcctccagatgcagtgctgaaggaaattgaggggatgaggactgatcaggctattttagaagtcttacattggtcagaagatccacaagaagtacaaaggctggcagcacgcaaggaggtaatatataaaacattacgtggtagattctaccaactgcgaccaggtgttcttgatttcctgaacacccttgtggattttgacattccaatagcaatcacaactcctcgcccacggttgagcctagaagaagggataaaagctgttggtcttcaaggctactttgatgctatagtggcagcagaggatttctgccgagggaaacccgagggggagatgtttgaggtcacagcagggcaacttggtcttgagcctgatgtttgtcttgtgctgggtaactcaaattcgacaatagaatctgcgcatactgctgggatgaggtgtgttgcggttgcaagccgataccctgcctatgagctccaagcagcaaaccatgttgtaagatggcttgatcagctatctgtcgctgacctgcaaaggattgccaatggcgagattcttgggctcaggggcagaagatctgacatggacatggacatggagattgtgatcgaggagtgatttttctatatgtatggtgtgctaatattgccctatgta

SEQ ID NO: 533 - DNA, 491 bp, Glycine max
attcataagtgtgacagaaatggaggatttaaaggaaaaggtcaatgaaggggaaccaacgcaaattaagtatagaggagtacgtaggagaccatggggaaaatttgctgcagaaattagagattcagctagacatggtgctcgtgtgtggctcgggacatttaacactgctgaggaggccgcaagagcttatgatcgtgctgcctttgagatgagaggtgctacggccattctcaacttcccagatgaacaccctccttgcaatgtgacttctcttagcaagaagtcctcatcatctaacactgagattggtaaacaagttgtggtatttgagtgcttggatgacaaattgttagaggaactccttgattgcgatggggaaaaccatcaatgaaaacttggattattaggaagataaggttcaactttttaatcctaaattggtatgtagtgcctgtgtacaattaaatacagtaaagttgcttagtgac

SEQ ID NO: 534 - DNA, 1521 bp, Zea mays
atgaacctcgccgtcgcagccgcactgccgtccgtgacgccacgtaccggcgtcgtgctcccacggagcagtcgccgacactgcccccgcggggtcgtcccacgcgcggcctcgagctccgtttcctcctttacctccccctcagcagcggcggcgcccatctacacgcccacgccgcaggaccggtctctccgaacgccgcatagcgggtaccactttgatggcacggctcgacctttctttgaaggatggtacttcaaggtgtcgattccagagtgcaggcagagtttctgctttatgtactctgttgagaaccctctcttccgtgatggtatgagtgatttggacaagttgttatatcgcccacgctttactggtgtgggagcacaaatccttggtgcggacgataagtacatatgccagttctctgagaaatcaaacaatttttggggaagtaggcatgaactaatgctgggaaacactttcatttccaataaagagtcaaccccaccgcaaggggaggtgccccctcaggatttctctaggcgtgttttggaagggctccaagtcaccccaatatggcatcaaggtttcatacgtgatgatggaaggtcaaactacgtgccaaatgtccaaacagctcgctgggagtacagcactcgtccagtttatgggtggggtgatgtcaaatctaagcagttgtccacagctggttggcttgcagcttttcctttctttgaacctcattggcaaatttgcatggctagaggcttgtccacaggatggatagaatgggatggagaacggtttgaatttgaaaatgctccatcttactcagaaaagaactggggcggaggttttccaagaaagtggtattggatccagtgcaatgtcttcccaggagcttctggtgaagtttctttaactgctgctggtggattgaggaaaattggacttggtgatacctatgaaagtccttcactgatcggaatacattatgagggacagttttttgaatttgtaccttggactggaacagtaagctgggacattggactgtggggtctttggaaaatgtctggcgagaacaaaactcacctggtagaaatagaagcaaccactgcagaatcaggaactgctctgcgcgctcctactatcgaggctggactggtaccagcgtgcaaagacacctgctatggagatctaaggctacagttgtgggaaaagaaatacgatggtagcaagggagagatgatactcgacgccacaagcaacatggcagcactagaagttggcggaggcccctggttcaatgggtggaaagggacaactgttgtgaacgaggttgtaaataacattgtgggcacgccagtcgatgtagagagcctcctcccaatcccatttcttaagcccccaggcctataggatcaccaacgaatgtcacaatgaagaagtatcacggatatcaatgttgatcgtacagtaaaactgtgcccagttcaataataattcatgattttt

SEQ ID NO: 535 - DNA, 9795 bp, Oryza sativa
  unsure (1)..(9795): unsure at all n locations
gacgaagagggatagaaaaacatagtgaaaaggtagggtccgatgtccgtgaggaaaagtaacggtaggatggggcgaggcgagcagggtggatatgggcacgttcccagatagtggaacgcataagagattagatcgcaaaggcaaacacggttaagtagaggtcaccgggcgaaaatttagggtcaggtggggccgacggcagaataaggatggacctggaagcgtcgcatgggaaggtatcgataccaggcgctgtcacccagcagtaccgttgggcacaatgcggcacgggcagggcccttgatcagggaggggcctcctcctccccctccccctccacgatggtggcggcgcccgtctacgcccccacgccgcgggaccgggccctgcggacgccgcacagcgggtaagccgtcgcccggagactgatcatcataccctcgattctgattcagaaatgtaggattcagtttggattcctgctttagctcggattcttcggcaatccttttaacatcatgcatgtttgagattcagtatgcctaattgaaatgatgtgatgggatgatgctgtcaggtatcactatgacggcacggcgaggcccttttttgagggatggaacttcaaggtgtccattcccgagtgcaggcagagcttctgcttcatgtacttttgcttaaaaccctttgtttcgagatgggatgagtgatctggaatcggttcatacatggatcgcgcttcactggcgtcggggcacacattcttggcgcctttgataagtacatatgccagttcaccgagaaattcaataacttttggggaagtaagctacttttttagatccagtctttttcacattcaccctcaaagacatttcatttaggatatttttatttccattcaatggtgaaaggaatacatatttgcgctaacaatcagctttttgttctgcgcaaaatcctaaccggctgactgtaagatatttaataaagcaagaatagaagaaaggttattaccaactagttcaaaacaataccaccaaccgccctgaaatcatagccgctctttcatggttacctgaactcaacgaacttgttgcatttcccttccatccttcttgtctggtgcagattgatgaaaagaagcttgtcacagagctttattctgaaccatcacctgaatttgcaacggaaaaggttgcttagtacgatgcaagtatgcaacatgtcctctttcacgcacctttagaatttctaatcagcctttttgagatgagacctaatcaactattttgtaaaagcaagctttcttcatattagagattgatttgaggaaataaatttgtgaaaaaaatatgtttataacaacagggaattatattgtgaaaaatatgttgataacaacaggggcttatattagaaagaccttgtggtctagttctcgaaaaagatatagatgtgtacctgtgtagctcatcacaaacctgttctgaccaataagttggttccagtcttgataatagtgttgtgctgccgaatctagttaatgtgcttaacaagtggttattagttagggatacctaacaattactactttacagccttctgtcattatcaaagttaactaagatgtcaatttgacaacaattcctattggtttatattcgcaaaacctaataagatcagaactaatttgaaatcatgttgttcttttgacggacatacttgtactttcatactcatcctacatcttcccaaacagttcaagtgcatatattcttaggagtcttatttgttttggatgtagtgtgcattccatgcatctataaaggtaaaaagtagtaaacaaaactgcagatcaaaagtcagaacaatgcaaactaagatgcagtgcagatattgattacttcatgcttctgttatttgtagttggtattgtttttcctgttcatatggaactttagtagtgcatcacagtatgttgatttccaaattaataagctgcatttcgataggtaggcatgaactaatgctcggaaacactttcattcccaataatggttcaacacccccagaaggggaggttccccctaggtagattctttatggattcttatgaattgcaaaaactcatataatgatcttgaactattcttcgacttaacattttttcctattaacatatttttaaatgccattcccttgagctactccacatttatttgttattcagtaatttattaaaaaatcttagttttcttggttaaattgtgggtataacggactaactcttatatctagcaatggtgggtccttatgcattaaaatttttttgattatttcacaactacctaatggggatgaattttctttcaataacagaataatttccccttccatttaattaaaaatataaggtggcctaaaatgttaacttacactttcttttgttaggggtctgtatttgacactccttggctaattgtgaggcttttgtttaagaatcagataaaaaatgtttttatcacgcgggtgctgaagggaattaagatataatttggagtttgttctttacaggngagtttttatacaaaagagggtttatttatgtggcaccctatttttatatttatgatgtggtgctcaccaccgtatagaggagaagatattgaacgtcatagtaagatcaaaatcccaataaaagccgacaggattttctcctctctcttgtataatatagaagtattgttttcccatataaaagcttatagagtcgccacattattttttatcatatataaacatcttttcaatgagatggatagaaatacgtggagaacttcactttcataaattgtttcactcccgacagagaaggtgtctccacacatggaatattgtaagtgatttctagaatgtcaaaaatcatatttaatatttttgcattatattgacgaataaattttttttcctattaaaattttttaagagccaattcctataagttccccccaatttttataatccaagtatttacttaaaaaatttaaattttcctgtttaaattggggtaaaaaataacaacccttaaaaatcaagcaaggttggttctttatgacataaaattaattatgattttttcccaactactaattgtgcatattttttttttcattaaccaaatttatttttcaccaacaatattaataataaatattaatgtatgtactaaaatgcatatacttaacatcatctagttgtttaggggtgctgcttattgtgaacgttccttgtccatactgtgcagtgcttctgtattaaagaattcaagtaaaaaaatgtttatttagtaactggtgtgcctgtaagggagattcgcagtatacattcttgtaagctttgatcctttctcagcgtgcaagttttttactaaataatgagatgtcttatctattattctgtttaccctgatatttcctctgatttgtaacttatcactctctacattgctttacatgccaatggctttcttcaagtaatcaacggttattatgtttcattaggaattttctagtcgagttttggaaggcttccaagtgacaccgatttggcatcaaggctttatacgtgatgatggaaggcatgtgcatcttgatgtttatctaagatctattcttgtaactattattatgtttctatgttttattgaaaagtcattacagtttacttactgagcttttttttttgccaatttagtgcgaaatgcttctttccatagctgaactataaagaatagttggatctgcatgttgagaatttatttatttttagctcatcaacacaatgctaaatgaaataacctgagaattgtattctggtcaatcaaaatataatattgtagaatcatgtacaaaatttgaaatatctgcttagtacgaaactatttggagaggaaggtttgcttgtttgtacaaaaggataatagatattagtatccttcgaataccatgatggcaggattttctgccaatctgaattttgaaatcaggcagatggatttcctaatctgtaaaatggaattatgcatttatgcaattgaaaatatgacaagacaaaatgatgagtaaattttagaaaactaaaactatttgtcaaaactattaatttgctacaactttagctaggcatttcagagaactgcaactacattttatgattttatcataaaactacaactttatttgcttgacaagtttggaccaacatgctatacacatataccatactcatgctcctgcaagttgggcccacatgtcataaacacatagggggataaagtcgtagctttcttataaattcgtttgcaattgttgcaattttgtgaaatatgttgttaaagttgcagcaaagtgatagttttaaccatataattgctgttttgttaaatttaccgtaaaatgataaaatgaacatagctctttcgctgtcacttttgaagttcatgaaagcaaacacacttgatacgcttattgccttgtcagaaagggatataaaagtttctatcctttaggtgctccaaatttcttgaactatatattgtgcccaaacacatttttaatagcaaattcaactgtagagaggaaaggtgatgcgacaccatctttgctcatacattgcacttaacttaatataaattttttttaggaaaaaacagtagttcgtgtgtaaccacgattgcaggtaattaagaaaattgctctggatggtttgattgtatcgaatgttacatattataagaaaaaaaaagaccttgacaatgcttttagatttatttagtaatgttatgcaatgtgtttattactactatgatgatgcttatattacatgcaaatcctagagaacaactcctagcagtttatgtcaggactggatacaataccgtaattaatgtttcccttcaaaatgtaaatggggattgagtagaaaagagagtttacactttattgctattaaatgaacaattaaaatttaaattacctgttgctcccctgtcaggtcaaagtatgtgccaaatgtccaaacagctaggtgggagtacagcactcgaccagtatatggctggggtgatgtcacgtcaaagcagaaatcaactgctggttggcttgctgcttttcctttctttgaacctcattggcaaatatgcatggctggtggcttatccacaggtttgtatttctttgtatttgataaactgaacagagagatatttaatttttctttttacctactggttttcattctaggtagatggcacatgtgccactgagtaatttactgaatgatacattcatctctcatgtgtaaaactatcatgtacgatggagttgtatttcttagcctaaaatgtgaaaattggttttccattgatgaagctttatttcaaattttttctttaatatttctgtaggaatccaaattgcactaaaaaataccaggaaatgtggctagtcctatctatatgtccaatccttttattccattcagtatgatttctccagttcagtcctgtagtagcgcacgattgattgaggtgatatgatatagtgttaggaaggttataataatattaagttaatagttcaatactaacttctgcaacttaactactcaggatggattgaatgggacggagagcggtttgaatttgaaaatgctccttcttattcagaaaagaactggggtgcaggttttccgaggaagtggtattgggtgcgtttttctatcttctttctgaccattaatcctgatgtaatggatacactggaatactgaataagttttgcttcatttacagatagaaaatatgctgtttcttgctgtaattctgtgttttgtgttgccagtaatgttcacccgtagtagcttttgggctgtttagatcccttgcctcacctggatttaagagtttaggcctccagtaacaacaaaaatgcttgctttgcctggcaatctcacctcattgagcaaggatattgttagttccttgctcacagggcaatgtttggcttgcatctcatcctgcatctctttatcaaaggaagctgggtgaaggttctgaacaaacccaatatgcatgaaggtttcaagaatggcatgcaatatgatggttgtagtggtcatgataaaaaataccttctttaaacatagtgtggtcggttgaaagtagtcaattttactggtacatttagtcatagttatagaggttatgcacttttaaatattcatgatatagctaggttacaaatacttgtcgcttcacggttcgtaatgcacattttccaattttatccatattaattatctagttagttgtggagggtaatatggtcatttaacatgaaaacaaatgattacacaaatttatgtgccatggttaaaagtgacaagtaaacgtgaatggagagagtatgttttagtttgactcaaaacttcacatgaatgaccaaacttactgattgaacacctttgctcatacaggtccagtgcaatgtcttctcaggcgcatttggtgaagttgcattaacggctgctggcggattaagaaaaattggattgggcgaaacctatgaaagtccttcactggtagagtcctgatactttcagcttttaatctgatgcatacttctaatttgttctgcaacttagctcatcatgcaagcttgattgctggatgtctgccagactgccagtaaggcaaaagggaatattattgatcaaccagttggcctaaaaattttgactgacaaaatcttatccatttccgaagtatgggtttattttcatttcaggactggtcattgatacaacattttatggatttagtggataaatgtattgctggtgatggttatgccacaaattagaatcccctttaccgcagtggttttaagtttagatcttttttgtgtatgtatcatgaaagttacactaattgtatgtatctaggcgacttttcatcccacagaacatttacatctagacctttgacagtcgaaacaaccaacgtacagaaaagccaccagggtgagtaaaaagcattggcagcataagcttgtgtgcagcctgagacagggttggaataatctcttgttccaaaaagaagtgcagcatgctttgtttcctttaaatgtcctgtggtgtttctgtgatgttattatggattcttcctcttttatagaaggtccaacgtcattcttatccactttcttgctttgcttttgtactcacatccacatcaacaaaaccatgtatttattgagaccaggtaatagatatattttctttagccagtaatttcaatacgatgcttgtttgctttgtgccctgcatattaactttcataagaggaagcatacaatgatcagacagaagatttacgaatttaactatgcacatacataacagttctgtttgttccctgcagattggaattcattatgagggaaaattctatgaatttgtgccttggaccgggacagtgagctgggacattgccccttggggtcactggaagttgtccggcgagaacaaaaatcatctggtaattatcatccagcgtgctgaaaatgtaatgcagtgcctgtgctagttggctactgttcacattcgagcaagattcccacttagctttcttacttgtattatagattctcttaggttgtaaggttacttatgtggttctatgttccttgattagcattcaatgttctaaaagcagattatctaggtgctaggcagcctgctggcctagtatccaattaagtgccaggagctgatctatcaccggactagtgcctagcacctggtgaatgcgacccttaacatgcattgctacttttctacaggttgaaatagaagcaaccacaaaagaaccaggcactgctttgcgagctccaaccatggaggctggactagtgccagcatgcaaagacacctgctatggtgatctgaggctgcaaatgtgggaaaagagaaatgatggtggcaagggaaaggtatgcatgcatgataataaggccatcagaatttttcagatagctgatgtattattgcactattactcttgttgcaaaatctaaggtgccagttgggttagctgcctcgaaaattgaactttattatgcaattcacaaggagggccagatgtagcatataatatgcaaatcagtatgcggcccaaaagtccactactaccttcgttccaaaaagagtttatacatgaatttggacaagcacttgtctagataggtgtagagaaaacgaactcttttgggacggaagtagtaatactatttttttctagattagcttggggctgtttggatgggactaaaatttttagtctctgtcatatcggatgtttggacactaattagaagtattaaacgtagactaatgacaaaacccatttcataaccctggactaattcgtgagacgaatctattagccctaattaatccatgattagcctatgtgatgctacagtaaacatgtgctaattatggattaattaggcttaaaaaaattgtctcacgaattagctctcatttatgtaattagttttgtaagtagtctatgtttaatactctaaattagtgtccaaacatccgatgtgacagggactcaagtttagtccctggatccaaacaacctaatgccactattttgccttaggaaatattgaaagttaaggacacaatgaactctgatggattgatggcctctatagttatctgcccccggagcaactgaaaatttattaattcatatatgataatatatgcatgatactatctgtcctgtcaggctctccatattcaaatactagaaaatattttaataacactctttagcctttacctaagcacattgtgggatcaatttctgattctgcacatacatggtcactgttcagtatagacacttttattgaacagaatatagtgaccgacttcattgatagtcatcaaggcatgtaaccatgatccaaatcaaaaaaactctgcttatttactctaaaaaactgtaacaagattatatggtgcattaccaacaaggctacaatgtataaaaattcctagttgttttcagatgatactcgacgcaacaagcaacatggcggcactagaagttggtggaggcccttggttcaatggttggaaaggcacgactgtttcaaacgagattgtgaacaacgttgttggtacccaggtcgatgtggagagcctcttccctatcccatttctcaagccccctggtctgtagcattgttcaggtcgagccatcgataggtagagatgaataggccctccaatcttgtcacaccttgagtcttgatctgttcctcacttagcatcatgttttcagccagagaactacagaaacagtaaaccaatcagcatggagtttattctcgttgggttagagaaaggcgcctttcgggtgaaatcatgttgcacaaatttttacagatcaggaatggatgctgtaattcaagaaaataagtataattcatcttaggcagttccatccttttgtgctcatctgaacttctgaagtatcataaagaagtgatagctggatgcccgggcctgcatctgcaattgtggaggtctttctggtcagaattggctggaaacaattgttgttagcacacttcatatggtaaatctttggggatcctctagagtcgncctgcnggctgcgggatgcagttgtacaaacaaagccag

SEQ ID NO: 536 - DNA, 1467 bp, Arabidopsis thaliana
atggagatacggagcttgattgtttctatgaaccctaatttatcttcctttgagctctctcgccctgtatctcctctcactcgctcactagttccgttccgatcgactaaactagttccccgctccatttctagggtttcggcgtcgatctccaccccgaatagtgaaactgacaagatctccgttaaacctgtttacgtcccgacgtctcccaatcgcgaactccggactcctcacagtggataccatttcgatggaacacctcggaagttcttcgagggatggtatttcagggtttccatcccagagaagagggagagtttttgttttatgtattctgtggagaatcctgcatttcggcagagtttgtcaccattggaagtggctctatatggacctagattcactggtgttggagctcagattcttggcgctaatgataaatatttatgccaatacgaacaagactctcacaatttctggggagatcgacatgagctagttttggggaatacttttagtgctgtgccaggcgcaaaggctccaaacaaggaggttccaccagaggaatttaacagaagagtgtccgaagggttccaagctactccattttggcatcaaggtcacatttgcgatgatggccgtactgactatgcggaaactgtgaaatctgctcgttgggagtatagtactcgtcccgtttacggttggggtgatgttggggccaaacagaagtcaactgcaggctggcctgcagcttttcctgtatttgagcctcattggcagatatgcatggcaggaggcctttccacagggtggatagaatggggcggtgaaaggtttgagtttcgggatgcaccttcttattcagagaagaattggggtggaggcttcccaagaaaatggttttgggtccagtgtaatgtctttgaaggggcaactggagaagttgctttaaccgcaggtggcgggttgaggcaattgcctggattgactgagacctatgaaaatgctgcactggtttgtgtacactatgatggaaaaatgtacgagtttgttccttggaatggtgttgttagatgggaaatgtctccctggggttattggtatataactgcagagaacgaaaaccatgtggtggaactagaggcaagaacaaatgaagcgggtacacctctgcgtgctcctaccacagaagttgggctagctacggcttgcagagatagttgttacggtgaattgaagttgcagatatgggaacggctatatgatggaagtaaaggcaaggtgatattagagacaaagagctcaatggcagcagtggagataggaggaggaccgtggtttgggacatggaaaggagatacgagcaacacgcccgagctactaaaacaggctcttcaggtcccattggatcttgaaagcgccttaggtttggtccctttcttcaagccaccgggtctgtaa

SEQ ID NO: 537 - DNA, 1092 bp, Nostoc PCC7120
atgcgatcgcctacaatgttcaaaactctgcaaactccccatagcggataccattgggacggtagtagtcgccgtttctttgaaggttggtattatcgtgtaactttaccagactgtggtcaaacctttgctttcatgtattccatcgaagaccccattggtggtaaagcctacagtggtggtgcagctcaagtccttggtgctgatgatgaatatatttgtcggacttttcccgatgtcaacaaattttgggctagtccagatgttctggctttgggtcattggggcgaaacaaacctcaacaccaaacctatttacctgttaccagcagagtttgaacgccatgtacagcaaggataccaagctacagccaccatcaatcaaggcataattgctgaccctgcaacaggtaattattgccgttggcgttacgaaattcaaccgatatacggttggggaaatcaagatggtatccagcaatcaacggctgggtggctgtcctttttacagatttttgaaccaggatggcaaattttgatggctcatggcttggctaccggctggattgattggaatggcaaaatctatcaattccagaatgcgccagcttacggggaaaaaaattggggtggtgcttttcctgaaaaatggttttggcttaactgcaacagctttgatggcgaacctgacttagctttaactgctggtggtggtagacgcggtgtactgtggtggatggaatctgtagccatgattgggttacattatcaaggcaaattctacgaattcgttccttggaactcaaaagtagagtggaatattcagccttggggtagatggcaaatgaaagcgaaaaacttagattatgaggttgaattaactggaactacccatctacccggtacagacctacgtgcgccaacagtccagggtttacaatactgctgtcgagacactatgcaaggaaaactagatgtagagttacgacagatccgagggaaaaatcctctagtcatcctgaaagcacacagttatctttgtggtttagaaataggtggtgattcttggagcaattcttggcagtctagttag

SEQ ID NO: 538 - DNA, 1092 bp, Synechocystis sp. PCC 6803
atgaaatttccgccccacagtggttaccattggcaaggtcaatcacctttctttgaaggttggtacgtgcgcctgcttttgccccaatccggggaaagttttgcttttatgtactccatcgaaaatcctgctagcgatcatcattacggcggcggtgctgtgcaaattttagggccggctacgaaaaaacaagaaaatcaggaagaccaacttgtttggcggacatttccctcggtaaaaaaattttgggccagtcctcgccagtttgccctagggcattggggaaaatgtagggataacaggcaggcgaaacccctactctccgaagaattttttgccacggtcaaggaaggttatcaaatccatcaaaatcagcaccaaggacaaatcattcatggcgatcgccattgtcgttggcagttcaccgtagaaccggaagtaacttgggggagtcctaaccgatttcctcgggctacagcgggttggctttcctttttacccttgtttgatcccggttggcaaattcttttagcccaaggtagagcgcacggctggctgaaatggcagagggaacagtatgaatttgaccacgccctagtttatgccgaaaaaaattggggtcactcctttccctcccgctggttttggctccaagcaaattattttcctgaccatccaggactgagcgtcactgccgctggcggggaacggattgttcttggtcgccccgaagaggtagctttaattggcttacatcaccaaggtaatttttacgaatttggcccgggccatggcacagtcacttggcaagtagctccctggggccgttggcaattaaaagccagcaatgataggtattgggtcaagttgtccggaaaaacagataaaaaaggcagtttagtccacactcccaccgcccagggcttacaactcaactgccgagataccactaggggctatttgtatttgcaattgggatctgtgggtcacggcctgatagtgcaaggggaaacggacaccgcggggctagaagttggaggtgattggggtttaacagaggaaaatttgagcaaaaaaacagtgccattctga

SEQ ID NO: 539 - DNA, 1501 bp, Nostoc punctiforme PCC 73102
gatgaagagggattttcagaagtgggaggttcggatggattttctgatttgagcttgttgtaagctacgttaattaatttgattttttcctcagcttcctgtttttgcttttgatcgaaaaagcgatcgggatgccaaatttttaccagtttacggtaagttcgcttcacctctgcttgagatgcaccgggttctagcccaagaatttcataagcatgattaatatcggagcgtagacgtttcggcttgtcgttagacatcgcgcatactgaaaaaatccgcaactatatactatgttaactattcccctcaatttcctccaatcaacccaaacgccccattctggttatcactgggatggtactagtcgccgtttctttgaaggctggtattaccgcatcactttaccggaaattgagcaaacgttcgcctttatgtactccatcgaagaccccatcggcgggaaaccccacagtggcggtgcagcccaaatccttggcccagatgatgaatatttatgccgtacttttcctgatgtgaaaaaattttggggtagtcgagatgttttgggtttaggccattggggtaaaacagatttacaaattgctcctctgtaccttttaccagcagagtttgagcatcatgttcaagaaggatatcaagccacagccaccttgaatcagggaataattcgcgaacttgcaaccaataattattgccgttgggagtatgaaattcaaccaatatacggttggggtaataaaaatagcattcagcaatcaaccgcaggttggctgtcattctcgcagatttttgaacccggatggcagattttgatggctcacggtttagccagtgggaaaattgattggaatggcaaaatctacgaattcaccaacgtcccagcttatggagagaaaaattggggtggtgcttttccgcaaaaatggttttggataaattgtaattgctttgagggcgaacccgatttagcattaactgctggcggtggacggcggggtgtgctgtggtggatggaatctgtagcgatgattgggttgcactatcaagacaagttttatgaattcgttccctggaattcacaagtagactgggaaattcagccttgggctagatggcaaatgaaagctacaaattctaattatgaaattgaattgacaggaaccacagatttagctggtacacctctgcgtgcgcccacagcagaaggtttaagatattgttgccgagacaccatgcaaggaaagttaactttagagttacgagaaataaatggcagaaaatctcaaataatcttaaaagcagaaagttttctttgtggtttagaagtaggtggcggctcttggcataatgtttggcagtctcggtaaaagtactgctataattatatgtgcttcatagttggggttgtagctcagttggatagagcggacgcctcctaagcgtcaggtcgtgcgttcgagccgcaccagtcccgtaa

SEQ ID NO: 540 - DNA, 2022 bp, Zea mays
tcggccgccggactctccccccgtcgagcacacaacacaccctcctcgtcctccaatccaatcaacctggtagactcgcttcgcttctcccccagccgtcggacggagctcctcgcagtcgcagcagccgccgatcagcctgcgctcgggctcagcgctggaaggtgttggaagagaataacctgaaggttcacagtaaccttcatctgtcggaagatgtatcgggctaagagggctgcattgtcaccgaaggtgaagcgccgcgtcggcaagtacgagctcggacgcaccattggggaagggaccttcgccaaggtccggtttgctaagaacactgaaaacggggaacctgttgctatcaaaatccttgacaaggagaaggttaagaggcacagattggttgagcagattaagcgtgaaatttgtatcatgaaattagtaaggcaccctaatgttgttcgactgtttgaggtgatgggaagtaaagcaagaattttcatcgttctggaatatgttaccggcggagagctttttgaaatcattgctactaatggaagattgaaggaagacgaagcacgtaaatacttccagcaactgattaatgctgttgattactgccacagtaggggagtgtatcacagagacttgaagctcgagaatttgctgcttgatgctgcaggaaatctcaaagtttctgactttggtttaagtgctttaaccgagcaagtgaaggctgatggtctgcttcatacaacatgtggaacccccaattatgttgcccctgaggtgatcgaggatggaggctatgatggtgcaactgcagatatctggtcttgcggagtaatcctctttgttcttcttgctggatatttacctttcgaggatgacaacatcatcgccctatacaagaagatttcagaagctcagtttagctgcccctcttggttttcagctggggccaagaacatgattaccagaattcttgatcccaatcctacaactagaatcacgatttctcagatactggagcatccttggttcaaaaaggggtacaagcctcctgtttttgacgagaaatatcaaactagcttggatgacgtggatgctgcttttggagattcagaagaccggcatgtgaaagaggaaactgaagatcagccaacctcaatgaatgcattcgaactgatttctctaaaccaggcactgaatctggagaatttgtttgaagcaaaggaggagtataaaagagagacaagattcacctcacagtgccccccgaaagagataatcacaaagatcgaagaagctgcaaagccgcttggctttgatgttcagaagaaaaaatacaagatgcggatggagaacccgaaagcaggtagaaagggcaatctgaatgttgcaactgaggttttccaaatagccccatccctgcatgtagtcgagctcaagaaggcgaagggggacactctggagttccaaaagttctacagaagcctgtcgacccagctgaaggatgttgtgtggaagtgcgacggcgaggtggacggcaacagcgcggcagcatgaaagtgccctttgaactttccactggacggcgccggttttcctttgtacatagcttctctttcggatgatcccgtgtccattgcagagtcggttttgcaagcaagttctttggtttatttgtagtaagcccggtgaaacaaccgccctggaggctgttgtggatgagcttactggcgtgtttagttcgtttcatggtcgggaggttggatggaatggaaaccacaatcaaggctgtagtagtgtgtgtagtaacgaagtagatacatgcatcagatggtgtaagggagtaccagctgttagttcatggtttcaagcttagccccccttcaatttgttcgatgatgtattacttcacaataaacattattacttagatgtatgaggtgagcacacttggtctttagacaacagacaaccgaattgcgtgctcattgaattttagcaggggcggattca

SEQ ID NO: 541 - DNA, 2768 bp, Zea mays
gcggagcagtgcatggaggtggaggaggtgcgggaactcggcgaaatcggaaggtgatcccggtcatgggatagagtggagtggagggggttgagtgtgtggtatggagccgtcccgtggcggtgttggcggcggcgggcggcggtggggggaggcggagggtgatgcggcggaggaagggagacgaggggaggacgggggcgaggtgagcctgcgggagtggctggaccggccgggccgagcggtggaggcggcagagtgcgtgcacgtgttcaggcaggtggcggaggcggtggccgtcgcgcacgcgcagggggtggccgtgggcagcgcgcggccgtcgtgcttcgtcgtgtcgccgcccttcgcgcgcgtcgccttcatcgagtccgcctccggctccgacgcctcgggctcgtgctcgggctctgacgcctccgaggacgccgacggcgacccggacccggacccggacgcctcgcctccgctgcggcgacgcgacagcgccgtccccggcgaggagcgcgcggggaggtcgttcccgctcaagagcgtgctggccatggagctcagctggtacaccagccctgaggatgcggacgacagcgccgctaccttcgcctctgacgtctacagactgggtgtgctcttgttcgagctgttctatacattcgaaacgatggaggacaagatgcgggcaatggcgaatctgcggcaccgggtgttgccaccgcagttgctgttcaaatggcccaaggaagcatccttctgccagttgctaatgcaccctgtgccagaaaccagaccgaagatgagtgaggtgctgcagagtgagttccttaatcagtcaaggaatagcttggaagagcatgaagcggcacttaggttacgcgaagagatagaagaacaagaattattgctggattttcttcagcagttgcagaaaagaaagcaagatatagccgacagtttgcagggcactattgctttcctctcttctgacatcaatgaggtaccccaccagcaatctgcaattggccactgtgagaacttcttatccgattgggataaagaggtgtgctctggaactgttgaagaacagagtgattgtggatccaggaagcgttttagacctgagctgcaaggtgttgatatggaggaaaataatcgtagtgttgaagaatgttccagaacagtaccatcctctgagttaatccaggaaagtgttctgtctaaaagctccaggttgatgaagaacttcaaaaaacttgaaacagcctattttctaacaaggtccaagttgatgaagcaagttggcagccaaataagtagctgtgatcgagttgttaagaacactactggttcagctgttgggactgagggaagttcattagatgatttttcactggaaaggcaatatggtacaaggcaaagaggttgggtaaactcttttcttgaaggattgtgcaagtatttgtcattcagtaagttgaaagttcaggcagaactgaagcattgtgatttgctgaactcgtcaaacttagtatgctccgtagggtttgaccgagatagagagttttttgcaactgcaggtgtaaataagaagataaaagtgtttgagtataatatgattgtaaatgaacaccgtgatattcactatcctgtagtagagatgtctaatagatcaaagttgagttgtatttgctggaacagttatatgaagagtcatattgcatctagtgattttgagggtatagtacaggtttgggatgttactaggagtcaagtttttgttgggatgagggagcatgagcgacgcgtgtggtcggtggacttctcaattgtggacccaacaaaattggtcagtgggagtgatgatggatctgtgaaactgtgggatatgaatcaggctgggagtattggcactattagaacaagagcaaatgtgtgttctgtacaatttcaacctgatactgctcgctccattgccatcggctctgcagaccacaaaatttactgctatgatctacgtaacatacgagctccttattgtacactagttggccacacaaagactgtaagctatgttaagtatctggatgcatcaacaatactatccgcatctactgacaactcattgaagctttgggacttatcgatgaatccaggaaggataattgacagtccagttcaaacatttacagggcatacaaatacaaagaacttcgttggtctttccatatctgatggttacattgctactggctctgaaacaaatgaggtttttgtctaccacaaagaatttcccatgccagtgttggcttataagttcagcgtgacggaccctatatcgggacaggagattgatgatcagtcacagttcatttcatgcgtctgctggagagggcagtcttcaactctactttctgcaaattccagcggcaacattaagatcttagaaatggactgaggagtttgcatctgtttgagtctcagctataaatagaccgacttcttaggccgtgctcaacaaatcatgcatatagccgtggtagatgtcactgtctagggagtggagttttaaatgggagattggatgggtaatgctgctagagatagcttaccaagttgtgcgcgtgcgtggcttcaaaattcgtggcgattaaatccagagttgccaacggtgcagcttaatccgagttgcagagttgggaaaggtagtagctgtagcagatttagcgtggttttataggattacagattagcgt

SEQ ID NO: 542 - DNA, 3111 bp, Zea mays
ctcgcagggcagccagggctcctagaaaagagaaagtagacgaccaaaagaaactggagaaaaagagaggagctcaaaagcaaggcgaggcctcctccgcccctttttctcccctcccaattcacacaggattcttcactcgcccgcccagttgtttcttttagtgccgcccccattccgctctgatccgagcctttcgctcaaagcctccagcttttgcaattgtttggtcacttcgggaatcaaggaataagttcttgcgctgtgcgcgatagagagcctgatccatctttccccatcctcttcccgtggcatttcggtgtgcttgcgctctgtgcgtggccactgctaggggaggatttttggcctggtttctgtcttcttggggttccaaaatttcgggcgagatcttcgcctcaaggaggttccttgcttttctggtattggcgactcttgttgctccctacaagtccaagaaaagaatttggaggccatggtgggggtcccttgcgaccggttctggtcgattattcgtgctgttgaattcaatatgccgctgtgacccacctctgcctggtttcttggaggaaatttgcttcagttgtgcgtcgttgagttagagctctcctccagctcttgattcggtccatggggctttgccatggcaaaccgacgcaaatcccggaggccgaggcgggggaggatccccatgtagcctccggagcgggtgacagcggggacgggccgacctcgccgtcggcggcggcgcccacggcgaagccgggcacgccgaagcagcccaagttcccgttctacctgccgagcccgctcccgccgtccagctacaagggctcgccggcgaactcgagcgtcgcgtccacgccggcgcgcggcgggttcaagcgccctttcccaccgccatcgcccgccaagcacatccgcgctctcctcgcgcggcggcacggctcggtcaagcccaacgaggcgtccatccccgagggcggcgagccggagctcggcctggacaagagcttcggcttctcgaagcacttcttcgcaaagtacgacctcggcgaggaggtcggccgcggtcacttcggctacacgtgctccgccaaggccaagaagggcgagcacaagggccaggacgtagccgtcaaggtcatccccaaggccaagatgacaacagctatcgccattgaagatgtgagaagagaagtgagaatattgagttctctgacaggccacagtaatttagtgcagttctacgatgctttcgaggatgaagataacgtgtatatagttatggaattatgtaaaggaggtgaactgctggacaggatattggctagaggtggaaagtactctgaagaggatgcgaaggtcgttatggtacaaattttgagtgttgtatcattttgccatcttcaaggtgttgttcaccgtgatctgaaaccagagaatttccttttctcttcaaaggatgaaaactctcccttgaaggtcatagattttggcttgtctgactttgtgaagccagatgaaagactaaacgacattgttggaagcgcatactatgttgctccagaggtcctccacagatcttatgccaccgaggcagatatgtggagcattggagtaattgcctacatcttgctctgtgggagtaggcctttctgggcgcgcacggagtcgggaatcttccgagctgtcttgaaggcggaaccgagttttgatgaggccccatggcccactctcacggctgaagctaaagattttgtaaaaaggcttcttaacaaggattaccgcaagagaatgacggctgcacaagctctcagtcatccatggatccgtaattctcaacaagtgaaggttcctttggatatgataatctataagctaatgagagcgtacatcagctcgtcttcgctgcggaagtctgctttgagggccctagccaagacgctgacgacggaccaactcttttatgtgagggagcagtttgaattgctgggcccgaacaagaatggttacatctcattgcaaaatctgaaatcggctctagcgaagaactccacggatgcaatgaaggactccagggttgtcgattttgttaacaccgtgtgcgctcttcagtacaggaaactggatttcgaagagttcgccgcttccgccatcagcgtctaccagatggaagccctggagacctgggagcagcacgcgaggcgcgcgtacgagctgttcgacaaggaaggaaaccggcccattgtgatcgaagaacttgcgtcggagctcggacttggcccgtcagtgcctctccacgttgtcctccaagactgggtcagacacgccgacgggaagctgagcttcctggggttcatcaagctcttgcacggggtctcgtcgcgctcgatcccaaaggcctagcattgtacaccatccatccctgcatatctatatccatcgaccgagggagacgagtgatggctgagccagtctctggctgcaggtgcgtgcgtgtgtgttcagtgttctgttccacggtggacggcctgaaaccaaacgcaaagaccaagagaaatgcctgacgatagtcctgtgtaagaagagtaaggcagcacagggtctggtgcctgtgcaccacttgtaccacatcccttgccacgtggatagatgacgtcgtcgtcgtcgttgttgtagttgtactgaagtaaagctggttgtgtagacgagtgtacagatgaggatagggaaaagaaatgaacatggtggaagactggaagggccgtaagatttgcggctgctgtttgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccctttttaaagaatcaaattttacttccccgtgtttgcaaagaaaaagtttttttttggggcccccaaaattaaattaattggccggggtttaaaaacgtgggaattggaaaaacctgggggtacccaaattaaatcgctttgaaaaaaatccccttttcg

SEQ ID NO: 543 - DNA, 1008 bp, Zea mays
attcggctcgaggagattagctcttcaactagtcgcgctgtcacggtgccgaacagcgtgtcatcgccttcccctccctacaagccaaacgcgaataccacccccgtgacttcccgatctccggcgatggccgcgcggcgcctcggatcccccgcatctaggtggctgcgcccgtccgcgctgctcctcctggtcgcctctgctctcctctcggccccgtcgccggcccgggccctccggttcgacctcgagtccggccacaccaagtgcgtctccgacgagatcaaggtcaacgccatggccgtcggaaagtaccacatcgtcgggcccgaccccaactcacccgacgcccagctccccgagtcgcaccgcatctccctcagggtgacgtcgccgtacgggaacagcatgcactacgcggagaacgtgcagtcgggccacttcgccttcacggcggcggaggccggcgactacctggcctgcttctgggctcccgaccacaagccgccggtcaccatcgggttcgagttcgactggaggagcggcgtctccgccaaggactatcccagcgtcgccaagaagggcaaggtcgatatgatggaattggagctgaagaagctagaggaaactataaaaaatatacatgaagagatgctttatctgcgtgaaagggaagaggaaatgcaggacgtgaacaggcgaacgaactcaaggatggcttggctagggttcctctcccttggcgtctgcttatcagtggcaggtttgcagctgtggcacctgaagaccttctttgaaaggaagaagttgttgtagactgtagttggcccatggttcacggtagacctcagcgcaggtgtaacctatttttgggtgaactgccgatctgttacggagcttgaaatcccatgtaacaaacggtatgtcgtacttgagaaaatatgctttagcctgtccagttgaaattctaagaaacttgaaatagatactaaaaaaaaaaaaaaaagg

SEQ ID NO: 544 - DNA, 1564 bp, Zea mays
cccacgcgtccgcacctccacgcaactggaagcttcgcttcaatctgccctactcctccgccgcctccaacaccgcagacgcagctgccgcgggcgggagcttggacgtgctactctgctctcatctcgtttccgcgcaggaattgttcacaatggcccgcgtgtatgttggcaacttggattcacgggtgacttctggggaactcgaagatgagttccgtgtgtttggagttctgcgaagtgtttggattgcacgtaaaccacctggctttgcatttattgattttgacgacaggagggatgcggaggatgctattcgtgatctagatggtaagaatggatggagagttgaactatctcgtaattccagtggtcgtggtggtcgtgatcggtatggtggatctgagtcgaagtgctatgaatgtggtgagactgggcactttgcacgtgaatgtcgtctgcgcattggctctggaggtctaggcagtggaagacgtcgcagtcgcagtcgcagtcgcagtcgcagcaggagcagaagccgcagccgcagccgcagccctagataccgcaggagtccaagctatagtagaaggagctatagccctcgttatcgctctccaaggcgccgtagtccttcgccaactcgcgcgcgcagctatagcaggtcaccatagtacaactgcaacgagtaatggtggcaggtactggtgtagcaggagctaggcctgaagcccgtgcctgatacttcttggtgtgagaacttagtccttggtttggctgtcaggaacaaatttggaactgtcgtcaactgcatgacttcagttcaggcatgttctgcttaaacgactcggccaactacggctctcagttagtcttcatggttttgttcctccattcttggcacgtccttatctgcaaacaaatgtcaacgttccattactagctgccttcgatgtttcatcatgaaattcttcaccgaagatgcaacttcatcacaaattagtaacatcctttcccctcatatagttgataaggtttgagtgtactgagcactaacaaatgcagctcgcgaaagtaagaccccttttcgtcatagaacaagacagctattttaattgcagcactcgtgtgaaaatatatctactctgcatggtgggattggggcgattgaagtgtgtggccttcagctgcacctagttgggcatcccaggaacctagtcaggctgactacagcaagaggcgcatcctttgactaaacatgtttgttttatttcttgtggtttgattcttcacttctgttcattgtgttctgccttcactgcaccctattggattggtagtggtcgaacaatgcttctgtctgtggtaagttattcttggtacaatggctcttctttacccctgatcagtgtatgttggactttctgatagagttagcaccaattgtagtataaatatgttcttttttctctggaaggtaattgtaattctatctgaatactccgatttgagatataatctgctcttgtcaaatggttttttaaagatcaaaaaaaaaaaaaaa

SEQ ID NO: 545 - DNA, 2188 bp, Oryza sativa
cggacgcgtgggcggacgcgggggcggggctcccagcccaaacccccccacctcgagctctagggtttcgcggatcgaggggcgccgcggctagggtttgggtggggggtgcctgcgcgatggccgctccggcggcggagtcggcggtggtgggggtaggggtggattcggcgacgagcgcggcggtgagggatggcttcgcggagctggagcggcagcagcagctgctcgcgacctgcacgcgcctgtaccagcagctcacggagcacttcggctcgctggagcgccgtctcgccgcgcgctccgagacgctccgcaccaagcgccgcttcctcgacgtgcgcacctcccgcaggctcgaggcgctccgccgccgggaggcctccatcgacggctccgtctcgctcgcgctctcccggctcgattccctcgccaagggcgacgcggggacgaccggctccgcctccgccgacgccgctggaatcgccgaggggctcaggtcgctctgcgccagcatggactcggccgggttcttcaccttcgtggtcgcgaggcgcaaggaggtggacgcgctccgcgccgagctccccgacgcgctcaagcgctgcgtcgatccggcgaggttcgccatggacgcggtctccgaggtgttccccatcgacaagcgggcggtgaggtcccccaccgacctggcgtgggcgtgcgtgctcatcctggaggcggtggtgccgtcgctggccgatccggacccggagatcggggcggcgcgccccatggtgccgcaggcggcgcgcgagagggcgcgcgggatggcgagggagtggaaggacgcggccgagaagaagggcggggtggagggcgccaagccaccggatgcgcacgcgttcctgcagcacgtcgcgacattcgcagtcgcagagaaggaggacaaggagctctacaggaggatcgtcgtgagcttctcgtggcggaggcagatgccgcgtctcgctatcacactcggcctcgaggatgagatggatgatatcattgaagagcttatcactaaggggcagcaacttgatgctgtgaactttgcatatgaggctggtcttcaggaaaaattccccccagcccctcttttaaaagcctaccttgaagattcaaagaagataccctcaaattcagataacctgagtactagcactggccaatctgggagcaatgccaataagaaggagcagtctgcactgcgggctgttataaagtgtgttgaggaccacaaactcgaagctgagtttccattggaggatctccgtgagcggctggaagaactggagaaggccaagaccgagaagaaaaaggcggcatcaagcagttccagcggtggtagctctggtccagccaacaagcgcatccgggcaagcaccggaggaccgatgccccctgccaaggcaggccgtctcaccgactacaccggtacaccgtcttcgcctgccaccaccacgaccaatgccacattcattcgctccccgtcccatgcctcctacggtacagcatctccttactcttatgataggccagctgcacaccccctctactgtggccagaacacactggcaatgagggagccctatgcataccaccacccatctgaggtatccagcgtcggcctcggcatgtcatacccatcccctcccatgacctacccggcctatgctggatacagcaatggaatcggctacagcaatgcaatggccccagcctttcaccaccaggcttactaccggtaggatcagtcgaagccgatgaaatgacaatgagctgaatcgctgatggtggcagggcggctcgccaccatggccatgttttgtagtgactgactacaacggtaggtgggtgggggcgtgtgttccttaatactagaagatgcttgtgttggttagttctccccgttattagctgctctcgctacttcgcactgaagaaactgaatgtaaattatggacgtgttgtccctggaccctcgtcgtcatcttgtgttgtaattcagtctaaaccactctaaaacccacaaaaaaaaatccggcatgtaatcttcaagcactgaactatctcggcttaattaatgactatcttatgttagttaaaaaaaaaaaaaaaaaaaaaaaaaaggggggcctcgtgccgaattcctgcagcccggggg

SEQ ID NO: 546 - DNA, 11783 bp, Oryza sativa
gaattcggtttggatggatggatcgggtatgtatgatctgggagctgcgggccaatgcgatctcagttctgtcactggtggatgtcggatgtgatttagtagggaggttgagttggccggtctgagaggaggcatggatcatctcagtttgtgcattcttgaatgaatcatcagttggccactgcatggctgtcatttccatttcctttttaatagcgagagtttgtgaatttgtacaggcaaaatggaccgattgtaggatcagattcatgattcactagctattttcaacataaactgttcagccccaaccgatttacgcaccccagcactttttcatgtagttaaccccttttgttttgcaggagagcgatgctggctgaaagcgacttggggtgcttccaacagtgtttctgaactcagattgctgtctcccctgcacacgatatggacgagtaatgatcgtttcagaataggtattatagatcagtatatgcatgttcaattgtgagctaagctttttctatatatcaacttaaccagagaaaatgttgttgagctgctgcaacgttatcgccgtgaccgtcatgtattgctcaactacatgctttctggtaacttgatcaagaaagttgtaatgcctcctggtgcgatctctttggatgatgtggatatagatcaagtcagtgttgattacgtcctcaattgtgctaagaaaggtgaggtggttttagatttacccaagtatgccactctgtatttttcatatgtatattctgaaaattattcgaccgtgtaggtgaagcacttgaccttggagatgccatccggctttttcatgacagccttgactacccttacgtggtgagctgatctatagtagctgctgcatttattttgtttcattgaaaagtttgtcagccattttgcaatgtaggagctatttgagttgcccattttaaagctccaggataaaagacctaaccattccactaaactccatggatacaattatgttcatatatggacattttaatatgtgttttcctattttaatagagaatgtttcatgtttagttgatatgctgtgcacatcatttcagaatcattaaagttcatttcttatgattttgaatgccttgacattatacttttgtcagaataacagtggaactgtggaggaattctttttacttacaaaaccagagtactctggaccagctccagcgagagaaccaccccctgtccctgctattgcaccatcacctgttgtgataccggcaccaattgtggatccaccaccagttgctgtgcactcaccagtctctaccacaaatttatcaaaatcacaatcatttgattctccaactgagaaggagttaaccatagatgacattgaagattttgaggatgaagaagatgaattcgatagccgaagggcttctagaagacatcaaagtgatgccaatgatttatcattgcggttaccactatttgaaacaggtaatagtgatgactgttatgtcattatggtattcagatatccaataacagatagaagtgaaattttcatgacttattttctttagaagtcttcatgctggtatggctacatacattgggtcaagaaagttattgacaacggaaactgtgctgtttttccaggtataacagatgatgacctccgtgaaacagcatatgaaattcttgttgctgctgctggtgcttcagggtaggcttatgcatttctttgtgctcatttttttttccaattagaagattgaaagtcttccaggtataccatatcatttaccttatttccatacctacaggggacttatagttccacagaaagaaaagaagaaagagaagagaaacaaattaatgaggaaactcggacgtagtaagagtgagagtactcaatcccaaactcagcggcaaccaggtttggttggtttgcttgaaaccatgcgagcacaacttgaggtatattgtcttagccttctgcttctggtgactgaataataaacgaataaaagaagttcacctttctgttccctgatgttcattaatgcttcacacaacttaaattagattagcaagtttgagtgttagcagcttataagcttcttttgtcgcttgaaagtccataaactacaactctttgagtttaaggccatcagtcccttcattatgtttctgtgcatccaggttttttaaagcatctcagcatgctaatcttacatacattgacctccgtgttccctgctgtttttggatagataacagaatccatggatattagaactagacaaggattgctcaatgctatggtaggcaaagttggaaaacggatggacaatctcttgattccattggaactactatgctgtatctcaagagccgagttttcagacatgaaagcatatcttcgttggcagaagagacaggttagccatcttattgtgccttaaatgatcttgaattctacagtatttggggccaccctatcatgccttaacattatatgtttcatttgtatctttgcttagctaaacatgctggaggagggccttataaaccatcctgttgttggatttggagagttaggtcgaaaggtcaatgagctacgaaacctcttcagaaagattgaagaatctgaggttttattatttagagattactcagtgaatactcttatagttgacttttagaacaattgtgtaaaactatccagtatactgaggctcatcgtggtgttttacttgctagtccttgcaaccatctgctgtggaggttcaacgcactgaatgcctaagatcactgagagaagttgctacttctctctctgaaagacctgcacggggtgatcttactggtgaggtttgtcattggtctgatggctaccatctgaatgtggcactgtatgagaaaatgctcggcagtgtttttgatatcttggatgagggaaagcttacagaggccagtacttaaaatcatcttttgtaattttcctctgtctagatacactatcagttgcaggtatttctcttaacatttttgcttcaatctaccaggaagtggaagaaatcctggagctcctaaaatcaacttggcggatactaggcattacagagacgattcatgatacatgttatgcatgggtattatttagacaggtatagctctagccaagcagtactattacttgaggttacccttactggaatattttgtggttgcattatggatttatgataggccctaagtacctctacattctgcaataaccctatgtgtttccataaccactgattgaggtctactctgatatctaatgttcttctcttaatagcccaaataagccaaaagcaagtgagttcctcaagcataaacagttttttatgaaatgatttcaaaccttttctgttcataatgtcagacacggtcatctgaaaaggagatcggtgcaaaatcttggttagcctttactattttgtggaaatggtgatgtgtagttccagttaagcatgtcatgaagtaggatgatccatcactagtgttcgttgccagtggatcatttgtctcttgataccataggtgctcttgcataaagactgcttcactaacaatatggcccatatatacttgtaaaccatatcccatggtgtgcaattgacctttttagcttataaactaagtaaccttctcaatagtatggtatttaatggatgttctgcaatacagtttgtttttacaggtgagcaaggactcttgaaagttgtgattgagcatttgaggaagatacctttgaaggaacagcgtggtccacaggaaagattacacttgaaaagtttgcgtagttctgttgatgctgaggatagctttcaagacttcacatttttccaatctttcctatctcccgttcagaaatgggtggacaagaaattgaatgattatcacctacacttctcagaggtttgttttgccaactcctggtttgctcacgtgcttcataacatgcatgagttgtggaaaggatctcctttactctttcacagtcatcttttttattccattgggttcgtactttataaataaaatatttatcattcagtgtagatcaattatatcccctggtattggcttttgcttcttttttttttgttagtgtgcaactcatatatgcataaggcagtcaatcattacagctgagtactatttagtcattcatgcatattgtcttttttagatcctcgatttcatattgtaccaatactttccgtgcctcatggttttgactttcactgttaagcttatcattttcttcaattgttcttcttagggcatttttatgtgtatgacttggagctgtaatttccttctaatcaatttcctcttttcacgctgctgtttctgttcagacttcagccgttcaacatttggtgtttactgaaaccaagtccatagatcacactgaaccattatatctggactttgtttgcaacaagggattattttcccatattaatatttattttcatttacagggccctagcatgatggctgatattgtaacagtggcaatgcttattaggagaattcttggtgaagaaaataacaaggtatttatacttcacttcatttttcatctattacaccatttttaatctaaaattagatcgtttattgccggctcgtgcactagtgtagctagatatttcatgagcaaaagtcatttccgctatataataattcaggggtggctctcacaaaaaaaaaggatataataaattctgttctaaatagtaaatacaggccatctggaatgtagaaagcaatacttctaccatctgcacatgtggaaaattctgatgtcgcgctttatttgttttgtacatcagggaatggagtcgcctgatcgagatcagattgaccgttacatcacttcttctgtcaaaagtgctttcgtaaaggtgactttcttagcggcttcttttgatagcagagctatacactttgcctcctacacttttcgcaattgagatggatgtaaaatcgcttacataatcatgcttgtatgtatgtgaaaccttcagtctcaatccgttattttgtacatgtacttcaattttgaagttccagtaatgtcgtatctgaccatgttcgctcgtaggaaatcatcataccatattattgtcaacgttagcaattttctttgtagttggggtgtttaattattgaaatgtctatttcatgtattagaaattataacatgaccatagtttgatgagagatgtccaagcctaaatattggtggatgttatggtttatgtgattgaatttcagttttttatattttccaaattactttttgtctatatcttttagtagcattaaataaactgaattccgcttttttaccactaccttcctgaaaagtcattatgaaatgtcttgaatgcaatattactatgccacattcatataacaaaatctcagtacatggctgtcctttacatatcaagagatagaaactccgggatctaaaccttgtaactatgctctgtccaaaccaatatttttgtttgttttgtttaccggattggacactcactgtgtgcacctaaagtggacagcatcatccatgtcaagattctgcaatttggagttgtcatagacttgtctagttccttccccttatgaattatatctataatatggactaaagaaacatttatttctttttttattcagatggcacactcagtagaggctaaagcagacacatcacatgaacatgttttagcatctctagctgaggagacaaagaagcttctgaagaaagatacaactgtgttttcatcggttttgtcaaagtggcacccacagtctgcagttgtttctgcttcacttctccataaactttatggaagcaaattggtaagctatgtcagacactcttatctgaaatgtctgtatatccaccaccataggattcttaatgcttgcatgacatttgtgccagaaaccgtttcttgagcacgcggagcatcttacggaggatgtggtttctgtatttccggcagccgatgctttggagcagtacataatgtctgtgatggcttctgttgtgggagatgatggtttggacagcatatgcagacaaaagctagctccttatcaggtttgcttatttaactgtatcttcttcaagtagcagcactcacaacagtgcaaaatggtatccaatccatttgcttgattgttcaccttgacatgatgtgtttatcaatttatgtcagtatttgccattttatcatccagcatacgatgctcagcaatgaactgttagtttattttgtgttaagagttcatatgttgttcatcctagtccttgttttatcccagattgaaagtaaatctggcacgttgatattacgctgggtaaatgggcagcttgagagaattgaaacttgggttaaaagagctgctgaacaagaggtaacactatttgactcaagttacttttttacaaagctcttactgtctcagtatgtttgatttatctatatccaacatcctctttcttaccatgatatgaatgacctaaagtaatttctggtctattccacatgctatacgaatggcctaaagttatttatatccattttattacctttcaatcccatgcttttcggttagtgaagtgaaccagaatgtttcgtggtatattgcgaaagtgatctatttttcatgatatatttcaaacataaatgtcatgttacatctctcaaagcctgccatcgcttcttatacattatttggatacaacattatcttattcattctgtcatcttttttatgccaaacttttttttgctcaacagacttgggatcctatatcccctcaacaacgccatggggcttctattgtcgaagtctacagaatcatagaagaggtgctcctttttgtccctcactccattatctccttgaataaattttgcttaatattatcttacgggataaagtctgtttttgttttcatgtagagatttttttatgccacaacatttcaaagatatttgcatgccttagggcctgtttggtttgttaccaccttcagccttaccaaattttggtaaggcaataaaacaaacatatcccaacaattgctaccataacaaaattccataattctggaagcttaccactcttaaatttatacctttatttggtaaggtttcaaaccaaatgtatccaccaatgctaccaaaatttggcattaccaaaatgtgctaaaatttggcattaccaaatttttttagtgttcgtttgggttgcaacccaaagatgcccttagttttctttagatttattttttttgcttggtagttgaatatgttatggattgatttccatccgtctctaaagagcaatcatttgccccttgcaaactattgcagactgcagatcaattttttgcattcaaggtccccatgagaactggagaactaaatagcctctgccgtggttttgacaaggcatttcaagtttacacacaacttgttacaggaccgataggtttgcatggcaccctttttctgtgaagtactttctgtatatctttcggtcatcatatttttgttcctttcttccttgtctgagtgatttcaaaggaaaatattctcttttacatgagtatatggcaaataatcaatgctgtagatggtgcatcgcttccaagatcataacttaaaagttattactgtggatgtggacgccagaataacttttctgtaattgttggttttgtttgcttgcagttgatagagaagatttaattccacctgtccctgttcttactcgatataaaaaggagcttggaatcaaggctttcgtaaaaaaggaaatacatgaagttagaacagttgacgagaggaaagcaagtgaaataatacaacttactatgccaaagctttgtgtacggcttaacagcctatatgtgagtctttacaacagagcactgctatatggatttgttgctttgactagaatgacttgtcaagttcccgagcaatttctgtgagatataaaacgatatatcttctttatatgccaatcttaataaaaaatttaatttaaaactatgacatttggggatcagtgtatgtatctcattaaaattattttctaggcttcaagtgtgttgataattatgctgctataacctataggtgaatatcttcaccttccagcctggcttcctttgaatttagctattgctagttttttttttcatgatctacatcagtgtcctcatggcatcttttgacttttctcttccctttgaattgtgtccattttcattagttttgaaccagaagcacttttttttttgtcaaacagtatggtatcagccagctaagcaagctggaggacagcataaatgagcggtgggctaggaggaaaagtgagagcattaacatcagtaagtatgctgttatgcgttttcaagaaaaaaaatgtatactgttatgattttctttagaaaaaaaatattttagttgccaatttatctgttgaatattctgataagtttgcaaatcaatctatttgatctaccccttatagataacatcagactaaatctgttatattgaaaatatttgaactttgtcaggacgatcaatgagtgaaaaatcaaagagtgctgtctcgagtcagaagaatcaatttgatggcagcagaaaagaaatcaatgctgcaattgatcggatatgtgagtttacaggtaagaaaatatacatgccccagtgctttcttggaagctgacagatatctattaacatgttaaccttttctttcttagggctaaaggttatcttctgggacctacagcagccatttattgataatttgtacaaaaacaatgtttctcaagctcgactggatgctattatggaagtacttgatacggtatgctcatgaatcgtgcaacctttcaggaacattaaattggagaaacaaaaccctatgatctgacagctagcatgaaacctaccatttatctatgtactaatgctggttagctacttagatgatcaacttttcacagaacacatattgtattctgttatgaatatagtttatttcctcaaaagatatggataagttaattatctgtggccaaagtgcaaaccatttgctatatcacaaaaatcgataatcaatcttgaatcctgtacctctggttattagtgtttttttgataaatatatatattgtgatttggtttgtaagattcgcttgaactaatggagatatttgattccacgcctcaatatttaggtgcttaatcagctttgtaatgtcattgtggagcaactacgggatcgtgtggttacagggcttctacaagcatctctggtaatctttccggataataaattctgtaggattgttgtgacagcttgtgagctatatgttatcttaaagttaccttgcttggcaggatggcctactccgtgtgatattggatggaggtcctacgcgtgtcttctctccaagtgatgccactcttttggaagaagatcttgaaattctgaaggtatatcattatctgaagtacaacctggctgttttttgcgttataaggaacatagtattacctggatgttggttgttttgtgcttattatgcctctggaacatttaatgttgtcttctctttgctggccaaacaaaaaactgttagtcttgatgtaaattttcacttcgcataggaattttttatatctggtggagatggcctacctcgtggaactgtcgagaatttggtctcacgtgttcgccctgtaatagatctgatcaagcaagaggtaagtttggatttaatttctcattttgacactgggtaaaccggtgaacagaacctagggtgtggaactccagatcgtggaggtaacataatgacgtagctccaatggttacataggtgtctagcagttgttagtgaacagacattagcttcatgtcaacaacgaacctaatcatgtcccattcctatttttggtaaaaaaaaacagtagaatcttcactgtttggattgtaggcacctgtataacttgttcgtttagatggaacttctctgttccattagctagttatctctaagtcgtaggcacagaacacacattagcttcatgtcaaactcaaacgaacctaattatgtcccatttcttattttggtaaaaaaaaagtagaatcttcactgtttggattataggcacctgtataacttgttcgtttagatggaacttctctgttccattagctagttatcccaggctgagtttggcactccatcttcccaacccacctctctcgttttccgcatgcacgcttttcaaattactaaacggtgcgtttttttcaaaaaatttctatacgaaagttgctttaaaaagtcatattgatccatttttcaaagaaaaaagttaatacttaattaatcacgtgttcttcccccccattttcccaacccacctctctcgttttccgcgcgcacgctttttaaaatgctaaacagtgtgatttatgcaaaaactttctatataaaagttgttttaaaaaatcatattaatctatttttcaaaaaaaaagttaatacttaattgatcatgcaataatatgagcttcgttttgcgcgccggggagaaggggttcaacacagcctaagtcgttggcacagcaaacaaaccaattcaggatttcaggtagctggtccgcccagatctggttacaacccaagctgcatgtaatcgtgccacattgttccatgccctttgccctagagcagaaatcagtcccaaaatcacactacctccgttttttaatatataacatcgttgattttttttatacatacgtttgtccatttgtcttataagtcacgcttaaaagaaccttgtacgataaataagacataacaaaatgaatgataactacataaagtttttgaataaaatgaatagtcaacgtatcttaaaaggttaatcttaaaatgtcaatggcgttatctctgtctctcctattataaaaattaaagatgtttctgttgatactttggtacgtcatttgtatttgagtcggtttttaagtttgttcacttttgggaatacataataaggagtcgtataagaaatccttaaaaaactcgcatgttaatttggaacaagagtcggactcctaattgctacaaaattcttgccaggcctaataagagttccaaattagatatcaatattatcaaaataaaaatcccatatactttttagacaaaaagatctaacaataatatgattaaaataaccttcacccgtggcaatgcacgtacaatttttctagtatattaaaaatgaagggagtaaaatttagccgtaggaaactcttatttcccaaaaaagactagtgcgtgccaagtcataatcatcatctgtaacggtttgcttctgcatgtttttaccagacacgtgtgctcatcgatgacctacgagaagttactcagggcgctaaaagtaagtttggaaccgattccaaaaccctgcttagggtcctttgccacagaaatgattcggaggcttcgcactatgtgaagaagcaattcaagattcccagctcagctcctgccacctgatttgcaaaaccaactggatttttcggatactgtacagccaatggaatgcgtcttggccttgcgacctggaaatcgtgtccagt

SEQ ID NO: 547 - DNA, 2296 bp, Zea mays
ccctcgaggccggccgggaactgctaaaaccacccaccttctcagtgactcacgaactcacgactccagatctcccaccgctcgccatggacctcgacgcgaggcaccgccacacgccggattcgagctcctccccacatgccgcctctgacatgggtctcccgctcgccggggctgcctaccagccctacgtctctgagctcctctccttctccatcgagcgcctccacaaggagccggagcttctgagggtcgacgcggagcgagtgcggcggcagatgcaggaggtggcggtggagaactacggcgccttcatcgccgcctccgaggcgctctccttcgtccgcgcgcagctcgagagcttcgatggccacctcgaggccatgatagaggagataccaaacttaacatctggctgcactgagtttgttgagtctgcacaacaaattctggaggagaggaagcttaaccaaacattactagccaaccacactacattgcttgacttgcttgaaatcccaccattgatggacacgtgtatacggaatgggaactatgatgaagcacttgatctagaagcttttgtgagcaaaatatcgaagctgcacccagatttacctgttgtccaaggattagctgctgaagtcaagaagacagtacaatcattaatttcccagcttctccagaaactccgatcaaatattcagttacctgagtgcctccgtattgtagcacatctgcgtcgaattggagttttcagtgagtcagaattgcgcttacagttcctgaggtgcagggaagcttggctttctggaattcttgaagatctggaccaaaggaatgtttatgattacctcaaaggcatggtgacttgccacagggtacatctattcgatgttgttaatcaatatagagcaatattcaacaatgataaatctggaaatgatgagaactccgaaggtgggctgcttttcagctgggcaatgcaacaagttagtaatcacctcgctactcttcaagttatgttaccaagcataacagaaggtgggtctctgtccaacattcttgaacaatgcatgtattgtgcaatgggccttggcttagttggattggatttccgtggcctccttccgccaatctttgaggagtaattggtgtttaaattattgaattttatcaccgactctaaaggggctttgttattgatgctgttatctgcattttgcagcgcggttctaaatttattctcaaagaatatgagtatggcggttgaaaattttcaggttgttttggattcgcaccgctgggttccgatgccatctgttggctttgtagcaaatggtgttgtcgatgacacttctgatgatgtgactccaccttctgttttaatggagcatccacctcttgcagtgtttgttaacggtgtttcagcagcaatgaatgagctaagaccgtgcacaccattgagcttgaaagtcgtccttgctcaggaggtggtcaagggactacatgcagtctctgactccctagtaagatacaaagctatgcggatgcttcgtggaaatgagtccgctcttttcctgtcactctgccaggcatttatcgaggttgtacatccttattgtgccgcatgttttggtcgatgctactcgaatggggcaacattgatctcagagtgtcaaggcacactggacgctgtccgtcagctattgaccataccggcaagatctaacagttccagtatcgaaagaaagcagtcaggagccattgaaagaaagcaatctgttgagagctctgggacagcagtcacgtataacgagctgtcagccgatggacctgggctagagatcaacgatgctgctacaaccaccaccccaccggtagaggacgacgtgagtacccatccaccaggaagtaagtagcttggacctccgtttgaatttgttaaagctctttatcaaggcctggtttagtcaaccagagaagaaattgctgcaaacattatattcatcgataataattcatagttttgctccagttctacagtgtacacaatatctcactggatatttgtatcttatttttttatcactcattaaatttttagctgttcattgttatagtcaatacctagatgttgtagagtgtgtccaacccgaacattcagtaatatgatgagtacaaaccgtgttcatcgtgttgactgcacacttctgaaatcaaagatctgattcatgagtcatatatatgtaattgatactactgaccataaaaaaaaaaaaaaaaagcggccctc

SEQ ID NO: 548 - DNA, 2155 bp, Zea mays
gacgtcgccgagaaaactcaaatcgaatccccaaatccttcgccggcgattccactccaagtctcgatcggaaaagcgcagaagagcaacggaatcccaattcccaaagggacaaggcaaagctaacttctccttcttcccatccttcctcatcccgtcggatcaatgccagcgggagcaaattcgaagccgctgccgaaattgtggccggttgaccggtgtttccagcccatccccccgttgcacgcggcgaggtagaggagtttccgccgtcaactccatccgatcggcgtagggtcgcggggtgccgacaactttggtccccgctccccacttgggcgccacggtcgctgcgcatgccgcgggctcccgcgcccactggaccccggtaacaccgacggcgcctcgctccgcgtgcccgcccgctgccagctccatgccaaccgccgcggctacataggtagctgcgcgctggctgaaggctcctgcagtgcgcgttgaaggctttcgctgcgtgttgtgcgttctgcttgaatttcggtctgagtttggatgggccagatgatttcgggtgataaatccgacgaacagacagcacgcgacgatggaatcatcaagaatggaagggaaatcctatttcaggcttttaactgggaatccaataagcacaactggtggagtattttggaggaaaaagtaaccgatcttgcggaatctgggtttacgtcagtgtggcttcctcctccaacacagtcattatcccgagaaggctatctaccacagaatctgtactgccttgactcatgttatggttccctccatgagctaaaattgttgcttcataaaatgagcgaacataatgtaagggctatggcagatgttgttatcaaccatcgaattggaactactcaaggatccaatggcatgtataatcgttatgatggcatcccagtatcatgggatgaacatgctgttacatcttgttctggcgggaagggaaacaagagcactggggataactttgatggggttcccaatatagatcatacacaaccatttgtacgcaaagatattatcgaatggttgatctggcttcgaaaatcagttggttttcaagattttcgctttgatttcacgaaaggttatgcagccaagtttgtaaaagaatacattgaggaatcaaaacctctttttgcagttggggaatactgggatagctgtgaatatagcccccctgactaccgactgaactataatcaagatatccataggcagaggattattaattggatagataacactggaggactttgtgccgcatttgatttcacgacaaagggcattcttcaggaagctgtcaaaggagagttgtggcgtttgcgagattcagaaggaaaaccacctggtgtgatgggatggtggccttcaagatcagttacatttattgaaaatcatgacactgggtccactcagggtcattggccttttccgtcagatcatattatggagggatatgcttatatactcacccaccctggcatccccacggtgttctatgatcacttctatgaccagggtgtgcctctccatgacgaaattgctaaactgatgcaaatcagaaaatgccaagatatacatagccgttcatcaatcaaaattctggaggttgggtcagatctgtactcagcaatcatcgacgataagttgtgcatgaagatcggggacggctcgtggtgcccaagtgatccagagtggaggctggcagtctctggtgacagatatgctgtgtggcacaagtgaagcatataagtgccctcgatacagtttatttctgctctcaggaacaggagtaattagcatgttagctgaataacagcacggtaaaacatgccaaaaatgaccctcttcgaggttttacctgtacaagaggagtgcctaaatgcaatgcttaattagaaatacgtgagatcgtgcggctggtcccgaggtgagacatacattttgctaatcgcaacaactatggattacctgcaaaagaaatatatatagggcatgtgatgtctctgtggaatattttatcctggaaccagaaatttgaattatttttataaaaaatgcatctgtgcaatttacattcaaaaaaaaaaaaaaaaaa

SEQ ID NO: 549 - DNA, 1071 bp, Oryza sativa
atggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgccgcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggacccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctgacccatgtcttagcatccagttcaaaaattctccaaattaagaattgcgcagtgcagaagc

SEQ ID NO: 550 - DNA, 5001 bp, Oryza sativa
ctgccgccgccgccgctaaaaccctaaaacctccaacctcacccatggcggcgagcagcgccgatctcgccgacgacggcttcccggcgccgcgcctcttctcgcagggcgtctcctacacctacgacgacgtcatcttcctcccgggctacatcgggttcccggccgacgccgtggacctctccacccgcctctcccgccgcatccccctctccatcccctgcgtggcctcccccatggacaccgtctccgaggccgccatggccgccgccatggcatccctcggcgccgccgccgtcgtccactgcaacaccgagccccacctccaggcctccatcgtccgcgccgccaagtcccgccgcctcccgttcgtctcctccgtccccttattctcccccgcctccaccccatccctctccgacttcgctggccacgactacggcctggtcacggagcgcggcgattcgctctccaagctcgtcggcgtcgctgttgcagccgagacctcctctcgtcaggctcccctccctgtctccgagtacatgcgccccgccccgcgctcggtgtccgcctcttttgatttcgagcaggcggccgcctttctagcggacgagggtttggattatgcccctcttgtatccgatgatagcgaggtaatcgacctcatcactgtcaatgatgtggagcgcatccggagctatccgaagctaggcaagccgtctcttggagcggacgggaagtttgttgttgcggcttccattgggacccgtgaggatgacaagcgaaggctggagcagctagttaaggcaggggcaaatgcgattgttgtagatagctcgcaggggaactctatctaccagattgatatgatcaagtatgcaaagaagatgtacccggaagtggacttgattggaggtaatgtggtgacgattgcgcaggcacagaatttagttgcttctggggtggatggattgcgtgttgggatgggctctggctcaatttgcactacccaggaggtttgtgccgtgggccgaggacaggtaaatgctcgataaagttcccataaattttttcttcctgagtttttaaattcaattacacaatacattcaaccttctggagaatttattagttatctagtttgtggatcctctgccatgtataggatgaccagcatgcccgtgctgcctcttgttctgagaaccatctgatgcttttgttttagagttaattgcactttggtccaccttttattaccaaagtttcactttggactattctctagctcatattttcactttggaccaggtaagattacctttggtgcactttggaccaccccaagtcattttctttagctgtatttactctataaatgttgtaaagaattacctgcgtaagttggaaaagattactgggttacgggttgctgatgtgtttaaagttggaacagtcttttatgtattcctaaaaaagtttatgggggtggtccaaagtgaaagaaaggtaaagtaacctagcccaaaatgaaaaaatgtgttaaagggtggtccaaagtgaaactttggtaataaaaggtggccctaaacgcaatttactctttgttttatttagaggtctggtaacgagacagaaacattgtttggttacttgtatccccacttttccacaatcccgtgccgaaagtgtgacaaactgcagattttgtgtctcaaaattggtcaccacacttgtggcctattttggctatggagagagttgatgacaagtggggctaaagggttagaaagtgtggcacaccgtagtgatagtaacaaaccaaaagcaccagccatatttggtcaaatccacctaactgatgtgcgacaatacttggcagccatccaaataggcccagaatctgatgccttactaaaatttctaatccttcatctctgccttgctatcccaagcatctaaactagattctgatgccttgctctaatttataatccttcctctctgccttgttatcccaagcatctatccaagcatctaaactagttggatgcttcgtctctgcattgttatcacaagcatctaaagttctaaactagttggatgatctatagcgtcttccatttccaccaacactcaggaggatatggatatcctgtttcatatttttagatggcacaaagtgagaatgagtaggtgttaggttcttcttgtttaattaggctgggttgtccagacgttacattttaagtgtgaactttgtgttagttgctacaacctcccattcatacccgtggaacctgggcattatgttgtttacgagattttgttctgtgatgtattgagaccttgtccagctcattccttttctgctgtttttagacctaaacttgaaatgaggtttgtataataagtggatcatgggacatgtggcggatacaaatgttatagggatacaacaaatatggtatatatatggtatatatcgtataccaaagaattttggcactgctgtgtgctgcatgtgtttgatacttgtttcttgcatttctgtgcgacaggctacagcagtgtataaggttgcatcttatgccaaagatcacaatgtgccagtcattgcggatggtggaatttcaaactctggacatattgtgaaggctttgtctctgggggcatccactgttatgatgggtagcttcttggctggcagccatgaagctcctggtacttacgagtacaaggtattcaattttttaaagcttctgcaggaatttttaggttcagcatgtgattttatttctgatatgcttttaccatgcataaactattttgtagttctttagcaatgtctgtctgagtctgtacaaccgtacgtattgaattgatactttgaaggacgacccacatgccatgcacatgcaaatgtacatcccatgtgaccactgcaatgaaaacatgctatcaatgtttaggcaatattttggtctaattgatgccataaaagtgctaatcaggccgtcataaaagttcctatataagatgattgtgtgtttagatatgttgcttctgaatatttgcttcatggatgacaatattagtaacatggctgctgaaaatcacagttttttaaaacacaacaaacctagtagcgagagacactgagacaatttgcctcctgtgctttgtatgagattgctctgtctgaaccaattgccagcacatattctgttaagtgtaaatactagatatatgtgtgttctattggtctttcacatcactcttggtgatcacaatctgtgtgcctgaagtattcatgttagttcttaattatttctgcaagtgcaaccagtggcatggctagattgttctagctagttgttttaaggtcatatctggtaattagaaaccattgttttggataaccactcttattcttcaatgatgctttgggtgaaaccacaccttagcattttccatttgcagatgtttcagtaaatttgacctgctttaggattattactacaatatactagtaaaaatggggtgataagctgccaatatattagtagctattattgtcctatcttagattgccaatgtgatgcatgtagttgataggatcatgtaatttaatgggcaacattaatccttaaaatattttgaattattataattaagatgtcttcagcattttcctgtgtcatttctagcactgtgtcgtagaagtgggtttttaattgcttattgtgttggttggtcgaatatatttatgttactcttatcacacgtacctgttgtttcactccctcctgtctgaaattatggttcttggaatgcttttaggatggccaccgtgttaaaaaataccgaggcatgggctctctcgaagcaatgacaaaggggagtgacgccaggtacctaggcgataccctcaagcttaaagtcgcccagggagttgttggagcagttgctgataaaggttctgtgctgaggttcattccttatacaatgcaagctgttaagcaagggttccaagatcttggtgcgtcatctttgcagtcagctcatgagctgctgcgatcggagactatcaaattagaggtatctccatgctggacaacatttttaaattatgaaatggaataataatgttaagaatgttagattggataaaatgctttttaacagtacaatttttagaagataatgaacacattccctgtttctaggactacacatgcttgcaggctacagtataaacgctgcctttctgcctctaaattgaaaaaaaaaaggtttagtatcagaagtaaacagctaagatatggtgaataagctgttccactccctattttatagagtatgaatcttatttcccgtgcagtactggctgcttttgagcttattctctgccagctaaaacatagtaaaaattccaagggattagagatcgataaattttaatgttgtgataaggcttcaaggcatatgattttcacccccaagtgaaattcagattgcaatgctcgaggaatgttctattgttgttatgcttgacctttgttttcaagattaagggacgatttacctcatctcgcgaccaaactgtccctgccaagtataatcggtcgtttgttcataccaccaaatgaagtctcctttttagtaaaaaccaaaacggcatactagtagctaactgaacattgtggtcgaataaaactgaaaatgcacaagacgccttgctcgtggatgatgtatagtccataaagtacatgaactgatttaaaattccccaaattatttatgttcatagcattgttaccatgtgtgtttctcttgaaatgctatactgattttgtttaacccccctcccctcccccccaaaaaagaacagagaactgatagaacttttaccatcttccttttcaggtgaggactggcgccgcgcaagttgaaggggggatacatgggctagtgtcgtacgagaagaaggcattctagttc

SEQ ID NO: 551 - DNA, 1772 bp, Saccharomyces cerevisiae
aataatactttttaactgtcataaacgcattttgtttattacaaattaaaagaattaaatataatcagtgcaattaataactccacaagtagcaaaagcaatggccgccattagagactacaagaccgcactagactttaccaagagcctaccaagaccggatggtttgtcagtgcaggaattgatggactccaagatcagaggtgggttgacttataacgattttttaatcttaccaggtttagtcgattttgcgtcctctgaagttagcctacagaccaagctaaccaggaatattactttaaatattccattagtttcctctccaatggacacggtgacagagtcagaaatggccacttttatggctctgttgggtggtatcggtttcattcaccataactgtaccccagaggaccaagctgacatggtcagaagagtcaagaactatgaaaatgggtttattaacaaccctatagtgatttctccaactacgaccgttggtgaagctaagagcatgaaggaaaagtatggatttgcaggcttccctgtcacgacagatggaaagagaaatgcaaagttggtgggtgtcatcacctctcgtgatatacaattcgttgaggacaactctttactcgttcaggatgtcatgaccaaaaaccctgttaccggcgcacaaggtatcacattatcagaaggtaacgaaattctaaagaaaatcaaaaagggtaggctattggttgttgatgaaaagggtaacttagtttctatgctttcccgaactgatttaatgaaaaatcagaactacccattagcgtccaaatctgccaacaccaagcaactgttatgtggtgcttctattgggactatggacgctgataaagaaagactaagattattggtaaaagctgggttggatgtcgtcatattggattcatcccaaggaaactctatcttcgaattgaacatgctcaagtgggtcaaagagagtttcccaggtctggaagtcatcgctggtaacgttgtcaccagggaacaagctgccaatttgattgctgccggtgcggacggtttgagaattggtatgggaactggctctatttgtattacccaagaagttatggcttgtggtaggccacaaggtacagccgtctacaatgtgtgtgaatttgctaaccaattcggtgttccatgtatggctgatggtggtgttcaaaacattggtcatattaccaaagctttggctcttggttcttctactgttatgatgggtggtatgttggccggtactaccgaatcaccaggtgaatatttctatcaagatggtaaaagattgaaggcgtatcgtggtatgggctccattgacgccatgcaaaagactggtaccaaaggtaatgcatctacctcccgttacttttccgaatcagacagtgttttggtcgcacaaggtgtctccggtgctgtcgttgacaaaggatccattaagaaatttattccatatttgtacaatggtttacaacattcctgtcaagacatcggctgtaggtcgctaactttattaaagaataatgttcaaaggggtaaagttagatttgaattcagaaccgcttctgctcaactagaaggtggcgttcataatttacattcttacgaaaagcgtttacataactgaatgttaaaatggcatcatcaatacagtattactgatgttatgttatttagtgctgtccgtatgtcctcctgttcttttttgggctacaatttaattgatg

SEQ ID NO: 552 - DNA, 1467 bp, Escherichia coli
atgctacgtatcgctaaagaagctctgacgtttgacgacgttctcctcgttcctgctcactctaccgttctgccgaatactgctgacctcagcacccagctgacgaaaactattcgtctgaatatccctatgctttccgcagcaatggataccgtaacggaagcgcgcctggctattgctctggctcaggaaggcggtatcggctttatccacaaaaacatgtccattgaacgccaggcagaagaagttcgccgtgtgaaaaaacacgaatctggtgtggtgactgatccgcagactgttctgccaaccacgacgctgcgcgaagtgaaagaactgaccgagcgtaacggttttgcgggctatccggtcgttaccgaagaaaacgaactggtgggtattatcaccggtcgtgacgtgcgttttgttaccgacctgaaccagccggttagcgtttacatgacgccgaaagagcgtctggtcaccgtgcgtgaaggtgaagcccgtgaagtggtgctggcaaaaatgcacgaaaaacgcgttgaaaaagcgctggtggttgatgacgaattccacctgatcggcatgatcaccgtgaaagacttccagaaagcggaacgtaaaccgaacgcctgtaaagacgagcaaggccgtctgcgtgttggtgcagcggttggcgcaggtgcgggtaacgaagagcgtgttgacgcgctggttgccgcaggcgttgacgttctgctgatcgactcctcccacggtcactcagaaggtgtactgcaacgtatccgtgaaacccgtgctaaatatccggatctgcaaattatcggcggcaacgtggcaacagctgcaggtgcacgcgctctggcagaagctggttgcagtgcggttaaagtcggcattggccctggctctatctgtacaactcgtatcgtgactggcgtcggtgttccgcagattaccgctgttgctgacgcagtagaagccctggaaggcaccggtattccggttatcgctgatggcggtattcgcttctccggcgacatcgccaaagctatcgccgctggcgcaagcgcggtgatggtaggttccatgctggcgggtactgaagaatctccgggtgaaatcgaactctaccagggccgttcttacaaatcttaccgtggtatgggttccctgggcgcgatgtccaaaggttcctctgaccgttatttccagagcgataacgctgccgacaaactggtgccggaaggtatcgaaggtcgcgtagcctataaaggtcgcctgaaagagatcattcaccagcagatgggcggcctgcgctcctgtatgggtctgaccggctgtggtactatcgacgaactgcgtactaaagcggagtttgtacgtatcagcggtgcgggcattcaggaaagccacgttcacgacgtgaccattactaaagagtccccgaactaccgtctgggctcctga

SEQ ID NO: 553 - DNA, 1512 bp, Agrobacterium tumefaciens
ttggtcatggcacgcatcattcaaacacccactggtttggacgctctcacatttgacgatgtgttgctgcaacccggacattccgaagtcatgccgggacagacaaatatcgccacccgcattgcccgcgatatcgatctgaacctgccgatcctctcttccgccatggatacggtcaccgaaggccgcctcgccatcgccatggcccaggccggcggcatcggtgtcattcaccgtaaccttacccccatcgagcaggccgaagaagtgcggcaggtgaagaagttcgaaagcggcatggtcgtcaatccggtcaccatcggccccgacgcgacgcttgccgaagcgcaggcattgatgaaggcgcacggcatttccggcattccggtggtcgaaaacggcggtgccggcggccacaagaatggccgcctcgtcggcattctcactaaccgcgacgtgcgcttcgcctccgatccgcagcagaagatctacgaactgatgacccgcgaaaatctggtcacggtcaaggaaagcagcgtcgatcagcaggaagcgcgccgcctgctgcacaagcaccgcattgaaaagctgctggttgtggacggaaagggcaattgcgtcggtctcatcaccgttaaggatattgagaagtcgcagctaaaccccaatgccaccaaggatgcgcagggccgccttcgcgccgccgccgccatcagcgtgggtgctgatgccatcgagcgcgccgaacgcctcatcgatgccggcgttgaccttctggtcgttgataccgcgcatggccattcgcagcgggttctcgatgccgtggcgcaggtcaagaagatgtcgaactcggttcgcatcatcgccggcaatgtcgccactgccgacggcaccaaggcgctgatcgatgccggtgcggacgccgtcaaggtcggtatcggccccggctccatctgcaccacccgtatcgtcgccggcgttggcgttccgcagcttgccgcagtcatggccgcagtcgaagcggccagcctcgccgatattcctgtcatcgccgatggcggcatcaagttctcgggcgatctggccaaggcgatcgccgccggcgcttccgccgtcatgatcggctcgctgctcgccggtacggatgaaagcccgggcgaagtgttcctgtatcagggccgttccttcaaggcctatcgcggcatgggttccgttggcgccatggcgcgcggttccgctgaccgttatttccaggcggaagtgcgcgatacgctgaagctcgtgcctgagggtatcgaaggtcaggtgccctataagggcccagtctccggcgtcctgcaccagctggccggcggcctcaaggctgccatgggttatgtcggtggcagcaacatcaaggaattccaggagcgcgccaccttcgtgcgcatttccagcgccggcctgcgggaaagccacgcccatgacgtgacaatcacgcgtgaaagcccgaactatccgggcgcggtttga

SEQ ID NO: 554 - DNA, 924 bp, Zea mays
atggagggaaccgctgcggcccggaagaggtcccggccggagacggcgaacggggctgccgccgccgggaagcgctccaaagacacggagtcatttcaaactggtctatcaagcaaatcgaagccttgcaccaagtttttcagtacgattgggtgcccgtttggcgagggatgtcattttctgcactttgtccctggtggttacccggcagttgcaaaaatgctgaatctaagtagctctgctgtatctgcgccatcaagaactcatgtggatcatgccgcccttaccggtgcctctcatccagcttctacggtcaagacacgcatgtgcaccaagtacaacactacagaaggctgcaagttcggtgataagtgccatttcgctcatagcgaaagagagcttgcgaagccagcctacatgtctcaagaaggacctcctatgggtggtcgatatggacgagctgaacctatgcaaccagctgccatgggccctccagcaggaaactttggtgcctcggcgactgccaagatcagtgtggacgcctctctggccggtggcataatcggcaagggtggggtcaacactaagcagataagtagaattacaggcgtcaagctctccatccgcgaccacgagtctaaccccaacctaaagaacatcgagctggaaggcaattttgaccagatcaagcaagccagcgacttggtgcgtgatctcatcgcaaccatcagcgcaagcatgccagcgaaaaatccatctgctgccgcggcaccagcaggaggaggccgaggcggtggtccagggggcaagagcagcaactacaagacgaagctgtgcgagaacttcttgaagggtgcctgtacttttggtgaccggtgccacttcgcccatggcgagacggagcagcggagaggtgctgcatga

SEQ ID NO: 555 - DNA, 2031 bp, Zea mays
atgaggccggaggagagagatgctgccgtggggagagtcagggaccagttccccgtcggcatgagggtcctcgccgtggacgacgaccccgtgtgcctcaaggtgcttgagaacctcctgcgccgctgccagtatcatgtgacaacgacgaatcaggctgttgtcgccttgagtatgctgaggcaaaacagggacctgtttgatcttgttattagtgatgttcacatgccagacatggatggctttaagcttctagagcttgtggggcttgaaatggacctccctgtcattatgttatcggtgaatggagagacaaaaactgtaatgaaggggataactcatggtgcctgtgactatctcttaaaaccggttcggctggaagagcttaggaatatctggcagcatgttgttaggaggaaattcagtaactgtgatcgtgctaacaatgatggctatgaggagtgcaataggccatcaaatgcagattttgatcttgctcacagccaaattacagctgggccacctgaccaaagtgggaggcccagcaaaaagaggaaggaatatcatagtgaagaggaagatgaaggagaagagagtaatggccaagataacgatgatccttcagctccaaagaaaccaagggttgtttggtcagttgaactgcaccgaaaatttgttgctgctgtcaatcagctaggaattgacaaagctgtgccaaaaaggatacttgagctcatgaatgttgagagactcaccagggaaaatgttgcaagtcacctgcagaagtatagactctaccttaaacggctaagtgctgtggcatcacaacaggctagcattgttgctgctttgggaggcaacgacccctttatgcggatgagtgcatttgaaggactccatggttatcaatcttttgtctcttcagcagctctgccatctttcagtccacagggactgttaaatagaaataatccagcatcatttgcgattcaaggggtgtctgcttccaggccaattcagattgcaaccggcaataccacaatgagtcattccattggcgatccaaataataaatatcaccttagcttaccaggcactagtagcctacaaggaaatctagcacaaggtttgccaactccagttgggcaggtccagctgccacagaagtggatacacgaagaaaccgacgatctatctactatcctttctgcgagtggccaggctaataatggtgttcctggcacactccaaagtgtcacgaacagtcacttgctgcagcaaggctttgttgaacgtagacaagacaaagttgttatccagccatcttcatctgcaagttcagatcgtcctgaaggcactgttggagtttcctccagtctgatggattcctgtgcatcccatcagagggttgttccattgtctgccttctctagcagtgcagcgccaatgaatggctcgttttgcagcaacggtgtagctgagttgggtgctgcatcctctggaggtacaagtattttcccctccaatgacctgaggatagaaagagacagcaaagtgggagctagctctttcggtagtgtgatacttctgtctccagacactgtgccaaaccaaaaatacttgaacttcggcggtggaagcgatttgagaccgaacatggagggagggaacgcaggcaatctgttgaatcccaagctactatggagttgtttgccggcctctcagccgcctaatcttatcggaagtcatcatcccatgagccaaagactgaaccttggcggctcaatggtcagacagacaacagcaagtgcttcggcagctgccccacagacgaggatcgacatgtttatctccggagacgctccgaagagcgcgtcggatttgagcttccctaaggtccacagcgagcttagctctagcagctgcagcttcgacggcctcctcaactccataatcaaagtggagaaggacgatgcttccttcagcgatgacctgggatgcgacttgtactccctgggtgcctgtatatga

SEQ ID NO: 556 - DNA, 2050 bp, Zea mays
ccacgcgtccgacatgagttcccgttttgctcccgagttctctctcacgtccatccctctctctcgtctcgttctttagcagggccggctggagcgcccactcctccctccagcccggccccagccgcgccgccgcgccggtcgtagacccaacgcccgccgcccagcccagcgcgccctccggccgtgaggcggagaggatcgggcgggcctcggggcgagcgccacgcgtagacggcggttgaggagcctgagaaaacaacggtcctccttcaagatcctgatccctacgcgcaggcgtaggagattgtattccgtctgattaatcggcggagagcaagcgggtgttgcggctgcgcgagcatggcgggcgaggaggctgcggagggcagcggaaccaggaggcacatggatctaaacctgtatctcggcctccctccattgccgcggcctccagtctggctggacccgacgttgatgcccaacttgaccggtgctgcgccagaatcctcaataactggtgagcctgaggaatcgttggccctgggggcggcagcctattctccgtcgaatgcactttccaccccggaggagcacccaatgcttgatcccatagtttattcctggctcgacggcaacaggaccgatggtgaagaggacactgatgctcctgagccggggccagtggatggtgccaatgtctctaggtcgcagcttgtggtagctgccacaggattggaaggggatgatgatcttcctctagtaaggtttgtgcgccctagccagatggttgttgctggtggaatggagacggtgaacacaagtatacttcagcagtccattcaaagggctgctgcaattgaggccaggactcctgaactccgctttcagagggtgatacagattagccagcagcatagaattgtgaggccagcatcagtgaaccgcagtcaaggggcagctagtacagatgcggataggcttgtctgggcaatccagcgcactcataactctttagaagcaacaaggcggcaaaaactagatgacaacaacttgtgtggaaacggttctgctaagaaggatgagtcctgtgactgcaactccagctttgagtgcaatatctgtcttgacccagctaaacagcctgtggttacaccctgcggtcacctcttctgttggccatgcttgtaccagtggcttcatgcacattcaccccactctgagtgccctgtatgcaagggtgaggtgctagaactgaatgtcactccgatatatggaagaggcggtgaagaagggaattccaccaaccctgacttcccacctaggccacgagcaaacagaagggagagcctgaggcaacagctgcaaatgacagacacaagaggaattgcaacagtggtgaggcagttgatacaaaaccagggtataattagcgttctcccaagcccaacagggatcgagatgtcggtggttcctgcaggccggcaaagggctagggctcggagacagcaaaggcaggataataatgcatcatcttccatacacgttgtagcgcagaatatgggcaatgttgcccctgagagcagcaaccaaatccagttgtcacattctaacggtgacaatgctgcacagatggttcttgcagctcctcagcagtcatcatctgtcgaacagctgtcaacttctagcaccacagctgttatattgggcgagcctgggtcaagtaggcggtcaaggccttcggagtctccaaccataagaagaacgaggaggaggccacagtaggtactcgagtgttgtcactcccttcagtaaaatctacagaccatgccccagtgatagttattaccatgattatctccaataacatctcaaggttaataatgtagaaatgtatatgccatcactggtttctgcctttctcttacattccatgtatcatctattatgcaaaacgagtcgaaatatcagttccagtatctatgataatcttgacctttgtatactgggaatataaaaaaaaaaaaaaaaaaaaaaaaaaaaaaaaaag

SEQ ID NO: 557 - DNA, 1982 bp, Saccharomyces cerevisiae
cggctataacataactatatataaaggctctacacccacgagcaatcgccttttcatttgtttcaattttcaaaaaaggaccgacacaaatcaatagataatgacaatttcgaataaatcgtggaggagctacttcccacatttgagaaaactacccgaagatgatcagtacttatactcagacgatactaactccagtatcatagctgaagaggagctacatcatagcgtagataagtcctcgaagacagacgttacggcagaaactacagctgtagaacctcatcctcacaatttaaggcatgacttgccatatgaagtgagagatgaagctgggcgtaaatggtggaaatattttgatgaattcgagtatcgtgttaataaggaatacaagaaatcacgtaagtggtacgagtttttgtatcctaatcatactactcaaaccaaggctgaaagacggcttctttacaagctagacattattattgctttatacttttttatgttatgttggtccaagtcagtggatttgaataactacactaacgcatatgtttccaatatgaaggaagatttaaacatgaaaggtaatgattacgtttacacttctactattgctaatgttggtgccattgtcttccaattaccatttatgtatttgttaccaagatttccctctcatattattttgcctgtaatggacttgggctggacttggttcacatttgcatgttatagggcaaactcactagccgaactaagggcttacagatttattttaagtgcctttggcgctgcttactacccagtgtcccaatatatactaggttgttggtatgccccagatgaaattaattcaagagtctgtttattcttttgtgggcaacaattgggttccgtgacttcaggacttctgcaaagtcgcatattcaaaagtttgaacggcgtccatggtctagcaggctggagatggatgtttctgatcgatgccattgcaatttctcttcccacggctattattggtttttttgttattcccggtgtaccatctaagtgttactctttatttctgactgacgaagaaatacgaattgcaagggccagaaataagaggaaccaaatcaaagatggtgttgataaaagtaagctagccccattatggagcagaaaactttggaagaaagtattttgtactccagcattctgggtacttgttgtttttgatacatgttcgtggaataacatgactgcgtatagtggttcatatactttgtggttaaagtctaatacaaagtactccattgcccaagtgaacaacctgagtgttatacccgcatgtttaggatttgcgtatgtgattttttgtgcctttggtgccgatttatttagatgtaagtggatattcatggtttttgctgctataatgaataccgtttcttgtgccttacttatcaagtgggatattccttcgaaagctaaatggtacgctttcttcaccacgtatttcagtgtggccgcatcgccttgtctatggtcgtttattaatgacttcttaaggtttgatcctcaggtgaaggctattacatggatcgccatttattccttctctcaatccacttacgcctggattcctaccttggcgtggcctaccgtggagtcaccacgttttaagactggttacaccgtgagcttaatttttggtgctatttacggtttatggacgtttgttgtactttttttttacaagagaaacgaaaagaaacatgctctaggtaatggtatcatcttgtatgatagtaataagggtgaagagcttccagaatttgtaaagaaaaatatggaggaaagagatggttactactatttaaagcggtcctcgtagtccaatttacgtgaagtagataggtatattacgctttagacaccatacctcaaataaatatattcatgtatataatttaatcatcttctatctataatta

SEQ ID NO: 558 - DNA, 1913 bp, Arabidopsis thaliana
gtaatttagctttcacaacaaaaaaactcttttctttttgtctgctcgtttttcttttcataatgggagccttggaagcagaaagagccgccaacaatgccacggcgttagagacacagtcgtcaccggaagatctcagtcaaccatctcctctgcgtaagatcatctccgtcgcttcaatcgccgccggtgtacagttcgggtgggccttacagctttctcttctgactccttacatacaactcctcgggatccctcacaaatggtcgtcttacatgtggctttgtggtcctatctccggcatgattgttcaaccgatcgtcggttaccacagtgaccgatgcgagtccagattcggtcgccgtcgtcctttcattgccgccggagtcgcactcgtagccgtctcggttttccttatcggattcgcggcggatatgggacatagttttggagataaactcgagaacaaggtaaggactcgagccattataatcttcctaaccgggttttggttcctcgacgtggctaacaacaccttacaaggaccatgccgtgctttcttagccgatttagccgccggagacgctaaaaaaacgcgagtcgcaaacgcgtgtttctccttctttatggcggttggaaacgttttgggttacgctgctggatcttacactaaccttcacaaaatgtttcctttcacaatgacaaaagcttgcgacatctattgtgcgaatctcaagacttgtttcttcttatccatcactctcctccttatcgtcacattctcgtctctatggtacgttaaagacaaacaatggtctccacctcaaggagacaaggaggagaaaacatcaagtctttttttctttggagaaatctttggagctgttagacacatgaaacgtcccatggtgatgcttctaattgtcacggtcattaattggatcgcttggtttccatttattttgtatgataccgattggatgggtcgtgaagtgtacggtggaaactcagatggagatgaacgatcgaagaaactttacgaccaaggagttcaggctggtgcattgggattgatgtttaattctatacttcttggtttcgtgtcacttggtgttgaatcgattggtcggaaaatgggaggagctaaacgactatggggatgtgtgaatttcatactcgccataggtttggccatgacggttcttgttactaaatcggctgagcatcaccgggaaatcgccggtcctttagccggaccaagcagtggtattaaagccggagtatttagtctctttaccgttcttggtatcccattggccattacttacagtattccatttgcactagcgtccattttctcaaccaattccggtgccggccaaggactttcattaggcgttttaaatatagcaatatgtataccacaaatgatagtatcattctcaagtggaccattggacgctcaattcggcggtggaaacctaccttcatttgtggtcggagcaattgccgcggcgattagtggagtcttagcgttaaccgttttaccttcaccgcctccggacgcaccagccatgtcaggggctatgtgattccattagttaactagtttatatatatatatatatatatatatatatatatatatgaatttccatctaatacagtattgttgtgcaaaagtgaaacccccaaaaaatggataaagtgagaaaaataaaccttggtcgtctgtcttttactgttctttagttttttttttttttttacttttgttattgatgttagtcaatttgttttcgttttgtttggacgttaataaattctgtgtttgactaaaaaaaaaaaaaaaaaaaaaaaaaaaaaaaaaaaaaaaaaaaaaaaaaaaaaaaaaaaaaaaaaaaaaaaaaaaa

SEQ ID NO: 559 - DNA, 596 bp, Glycine max
  unsure (1)..(596): unsure at all n locations
cgggattaaggcacacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaaatttgaatgttagattgatttcaaagcatacctatagtagggtgaatgtcttcatatatgatatgatttccttttaggcagcactttactttggtgagtatggtttataacttaagaatgactttgttgaaccatnttagtttgatcgt

SEQ ID NO: 560 - DNA, 806 bp, Zea mays
tgggacctcgagcggcggggccggtgcacaggaaatctctatccacagacacacaagcagccagtgcagtagtagcccggtatatagagagtgtagcacgattatacaatatatcacagagctagctagttagtatatacgtactatatatatagtctattgctcgctagcttgctgaatcaagctgaactatatagtaagagactaattaaagagctattagccacagcgcgtgatccacgattaatggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcaccatgaagggcgccacggccgtgctcaacttccccaccagcggaggatcagctgccgcggctcccggcggccggaccagcggcggcggctcctcctcgtccaccacgtcgtcggctccggccagcagggggagggcccgtgttcccgactcggagaaggtggagctggagtgcctcgacgacagggtcttggaggagctgctcgcggaggacaagtacaacaagaactaatgaaacgctagctgatgcacaacatacatatgttggtagtagccttattagccgccgcaacgcgctgctagctagagctagctcttcgctgccgcttccagtaaattatatttaagggagacagaactatattaactttaatatactatactcactacccaatt

SEQ ID NO: 561 - DNA, 2091 bp, Zea mays
gtcgatcgggggcgacaacgatggtggttagcgtggccgcgaccgggcccggcacggacgccgagccggtgagctccaccttcttcgcgtcccgctacgtccgcgacccactcccacgtggcaacttccgtttcagcccgccgcgcggaggccgctggttggccaggggacaccacgccttccattattagagtaccactactccattagtaccagcgtaccaccaccaccgaaaacgaatcccagaacagtaccgcagcggcagccatggtgctctcgcacgcgagctccggccgggacgacgacgacgcggtggcctccaccttcgcgtcgcgctacgtgcgcgagcgcctgccgcggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccagaaccgctgcgtaaacatgatagctcacctgttcaacgcgccgatcaaggaggacgagacagctattggggtcggaacagtgggatcctcggaagcgatcatgcttgcaggtctggcgttcaagaggaaatggcagaacaagaggaaggagcaggggaaaccgtgtgacagacccaacatcgtcaccggtgccaacgttcaggtctgctgggagaagtttgcaaggtattttgaggtggagctgaaggaggttaagctatcagaagggtactacgtcatggaccccgtcaaggctgttgagatggtggacgagaacactatctgtgtcgcggcgatcttggggtcgactctcaccggagagttcgaggatgtcaagcagttgaacgaccttcttacagagaagaacaaggaaactgggtgggacgtgcctatccacgtcgacgccgcgagcggagggttcatagcgcctttcctctaccctgagctcgagtgggacttcaggctgcctctggtgaagagcatcaatgtcagcgggcacaagtacggcctcgtctaccctggtgttggctgggtcatctggcggagcaaggatgatctgcctgaggagctcatcttccatatcaactacctggggacggaccagcctacgttcacgctcaacttctccaaaggttcctgtcagatcattgcgcagtactatcaactcattcgtctaggcttcgaggggtacagaaacatcatggagaactgccaggagaacgcggcgatactgcgggagggcatcgcggcgacgggccggttcgacgtcctgtccaaggacgccggggtgccgctggtggccttctcgctcagggacagcagccggttcagcgtgttcgacgtctccgagaacctgcggcggttcggctggatcgtgccggcgtacacgatgccggccgacgcggagcacgtggcggtgctccgagtcgtcgtcagggaggacttcagccgcagcctcgccgaacggctggtctcggacgtccgcaagatcctgcgcgagctggacgcgcgcgcgacccacgccgtgagggtcgccaccgccaccgccgagcagtcgggcgacggcgtcgtggccaagaaaagcgtgctggagatcgagcgggaggtcgccgcgcgctggatgaacgccgtgaacaagaagaagacgggggtctgttgatgcgtcgtgggtcggagactgggaggtttcgccatggtagcttcgtctatatgtcgcgtgcttgtttgtgtctgtgcagggcgcttggatgcgttggtccagttccgcgtatgtgaacaaggtgtcgtatgcagtatgcaaatgttcaggatccaggaaccacaaataatggatgtaaatgttgggtttggtgccgtatgttgggtgtggagtatatttcttcgccaggtatttgctgtaatcctgtccctttacgttcgtgcactgcaatgagaataaaaaaaaataagtgtcgttcacggaaaaaaaataaaaaaaaaaaaaaaaaaa

SEQ ID NO: 562 - DNA, 1236 bp, Zea mays
ccacgcgtccggctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgccgccgtgctggctgaccccgccgagaagccgcgcgccgccaaggctcaggtggtgggatggccaccggtccggtcgttccggaagaacatcatgtccgtgcagtccgacaagggcgccgccgccgccaacggcgacaagtcctcgccggcggcaggcggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagatgttcgtcgaatcatgcaagcgccttcggatcatgaaaggatcagaagccattggcctggcgccaagggccatggagaaatgcaagaacagaagctgaggagaagacggacggacggaagcttgcatctcagcaccaccaggggtggatggatgcaagaagaacaaatctccatggcttttgcagctctgctcgtctctgtatcatactcgtcgtccctgcccttcaggcctctgtatctccctgatcaatgaagtcgttttggtgtgtcaactgttctctccgtgcccagcttgtcagtgaaagagtcagtcagtgtccatcaagtctcatcttgtcctatacagaagagagaagccatgcatgaacatgtacctgtcctataacaatgtctttttttgctaccaaaaaaaaaaaaaaaaaaag

SEQ ID NO: 563 - DNA, 1610 bp, Zea mays
caaaaattcaaaccgcatcaagcttcccaagaccccaaacgaacgccggcgcttcacacatcgcccgacccgaaccaaacccttcaaaccccagcgaaaagcgaaggcaatcggaggaacgaatccgcgcgaccaacacgttggcagcagcattaggatccggatccgaagaccgccagaccggagccggaggcgatgaagagaaaggaaaactccgagcactcggcgccgcctctcaacaggccgcgcgggaagcgcaaggccctggccgagctgcccaagtccaacggactgaacatgaaccacgactcggcgccgcggccgtcgaagccgagaacgcggtcggcggcgcgagctgaggccgaggcggaggcggcgatgaaacggcggaaggccggagacgccgcgcgctggccgatggacacgaggcagcctgacgctgaagcggcggttgcgccatacgtcggggacatcgaccggtacctccggtccctggaggttgaaccgttgaggaggccaagccatagctattttcaggatatccagaaaaacatctgccccaaaatgagggctatccttgtggactggttggtggaggtggctgaagaattcaagcttcacgcagaaacactccaccttgcggtttcctacgtggaccgctttctcacaatgaatgtcgttgctcggaacaagctgcaactactgggtgtcactgcattgctcgttgctgctaagtatgaagaaattgagtcttctaagatgaaggtggtcaagatggagactgacttactaaaatctcttagctttcagattgggggtcccacagtgacaacatttctacggcaatttatagcttcgtgtcgtggaggcaatagtgcaagcagaggaaaacttgagtttgtgtgcagctaccttgcggaattgagcttgctggattatgactgcataagctatctaccctcagtagttgctgctgcctgcttgtttgtagccagattcataatccacccaaagactcgtccttggaacttgtcacttgaacaaagcacgggttatagagtctttgatctgcagaaatccatttatgtcatacatgaattgcagttgacaataaggtgcccaaatcaggtagccatcagggagaagtacaaggaccccaagtttgggtgcgtgtcgacaatggtttcaccacgagaaatccctacgtctttccttgaaggttgccataagtgaagtccggacttggacttggagaagggtttttgcagtaatgctgctggcgagtggcgatgcagaaaatagcttgatggtaggataatttaagggtaggtcggaaaatataccatggccagcgttgtagatcgttggtacggtactggtctcacagttggtagaatatgcaattgaaggctttttgtacaggagttaggctagtccgtgacacacacgtgtgcatcctctatggtctgtctttgcgcacattatgccgagcgccgaccatctcgtgctgttggcctgtctcaattaccaccagacatttgacacgtggaatctttttaagattcaatttttaaaaattgtattaaaaaaaaaaaaaaaagggcggccgc

SEQ ID NO: 564 - DNA, 1837 bp, Zea mays
tgctcttttgagcctcactcctcagtcttcacgccgccggggcagtgctaagatccaggacacgcgctgtcccgctagcaccacgcctccccttgtcatcgtcctcctcccacgtgctgctgtgggggtgcagacgggagacacatccggacctgattgatttcttcgttttgttctgctggtttacatggctgcaagaaagaaaaagcctttgcttattgcttgccaagcaaccagtgccagaataacaagatctcaggctgctgcaaatagtacaagatctgggctggctccttctgtaccagtacctctgaaaacggagcataaccatccagcgaaaaaaaagatgaaaagggaagcttcagatgaaaatgcttctgctgatgctggagcttcagctcctctgcctaaaaggcgtacagttctcaagaatgtaactaacataagctgtgctaaaatttccaaaaggtgcactgctgtgactgggctgaagttgggtccctcccagaaggctgggcagagcataaacaagcaatgcacaaacaagatctccatgcttctccctctggctgttggagggagttcacttgtggatgattctaataatgctgaagaaacacaaatggtagaccttttggcacagaaagagaagcagattgttttgcttaaggaggctcagccattacagaatactgaacaaaacaaaggcggtgcttgtgatgaggcatctgttgaggaaagaaatgccatgaatgtacacgaaactgctgccttaaaggctggggtctctaatggtttaaacattgtagatattgacaaaaataatggtgatcctcaaatgtgtgttacctacgttgcagagatatacagaaatctaatggcctcagaggtttcggacgaatataagcttgtggcagatacactttaccttacagtatatcttattgaccaatttctttctcagaactgtatccaaacgcacaagctgcaacttcttgggataactagtatgctgattgcctcgaaatatgaagagtattctgctcctagtgctgaagaattttgtaacataacggctggtacatatgcaaaggctgaggttctggaaatggagcaacaagtgcttaatgatctgggctttcatttatctgttccaacaacaaacacatttctcaggagattccttagagcagcacaggcttctcgtacagtaagatcagtacccaaaccacattgcaacgagtcctttcagtctatatgtattgtcctcaacactaagttggcaagctacatttccaggctcatctgaccactttgaattatctggcgagttatcttgccgagttgactttaatcagttacgatttcatgaaatttcttccctcagaggtggcagcatcttcgattttccttgcaaaatggacacttgaccaatctgaccatccttggaaccctactcttgagcactacacgtcttacaaaagcttcgatattagaacttgcgtgcgggctctacaggaactgcagcacaacaccagtaattgccccctcaacgccatccgtgagaagtatgggcagcagaagttcgagtgcgttgccaacctcaggtcaccggagctgctgcggtcgctcttcagttgatgtgctcccctgcactctgctgattcactcgccatttgctgcaacgatcctgacactgtataaaatatttcttcagtttctgttccatttccaaactttcttcagtttgaacatgcattctgtgacttgggtcaccgacaaaagaggcgcgacacactaatatatcaatttgtaactcaaaaaaaaaaaaaaaagg

SEQ ID NO: 565 - DNA, 2437 bp, Zea mays
atcgtcgtcgtcgcccgccgctgctaggtttggggtttccggtggccaggacccaagccagctccgtcgggcgccgtggggaactgctgggaggggcggtcgaccggcggtgcctctgcttcgggttctccgtaccggcgtcggaggggatcggatggcataagttggagcaaatctaagtcgttaaattgagaatagtccaaggaaacctaattcatcctattttggcccaagacgacgctttccactagaatgaaggtggcaaatgggttgtctttgaggaaatctaatggtaggtttaaatcaaagcttatgatggaacttgttaaacaatggcgagaacatcaagcaaatatgaggtgcatgaatctatccaagcgtaataacaacatctatgttggggcagaaggagccaacataacttctcccaacgatagcaacatttggccaacgagtgctttagtagcaaagaatagcaacccaagatatgtgctagcctcaaagtgtgcaagccagcctcctacaatgtggctagagaatagcttgaatacttcatcgggtttcaagtgctctaagctctctatcgttaggaatgcacttccttcgaaaacacctaaggcgtctgtctcttggaagtcaaaggatgattcgaatgccataccaagacacctagagcaatctcactgtaaaaagacatctagagcaactcgaactcacttcaaggcgatgccgaatttgattcacaaggcaaagaatgttgatacctcaaatctaaacgatggtacctcgggttcaagttggaggggtcagtcggattcatataagggagaggacataaatatcgggaaggaatgcactaaaacttcagagttgttgaaaagtagagaagcctcaagaaaatcaaacatcctagtggtagatcggaaggatcctaacaaagatgagccagacaaagtgaaaggaatccaagatgaagttatgaccaaagaagagggagtgaaaggccatacctgtgaaggtcgtgcgacgtgttggagttgtcttaagcaggcgaacaccacaaagacaaatgatgctccaaatttaggttcattgttggttggtaacgaacacatgcaaggcctcatgagtaatttgagagataattcatcccatttgtttgaaaagaatcattcaagacaccaaagggatgatccatgtgaatatagagaaacaaacttgaagtttcctaataggatccaatcagttggaggcaatgggaaaaccaatgatgtcacatctaggaggaaacgactcttgttagaagaaaaggctagcgcacacgtgcaaaatgatcttacttatggaccgatgaagaggcggaggtacatagaagccaacgaagatgaagaagagcaaaatgatcttacttatggaccgatgaagaggcggaggtacatagaagccaacgaagatgaagaagattatgtcggcgaccaccatccggtgcatattgaagatgctaccactgaattgacaccgcaggattctatttcaaagcattgcgttgagcgacaatgctattgttgctcaaagcctattgacatacctagatggagtggaacctttaagatagatggaaaggaacacatatcactggctggacatttgtcatccaaatcttgtgagaaagtgtggaaattgtcatcattgccgaaggtggttcaagtgacaaaggttcctagaatggcagtgtggcctaagatatttaaagcatcagaacccagtggtgacaatattggcctatatttcttccctcctgaaatgaggcacgatgaagaactagatcaactagttaatgaagtcatggataaagatttgatcttgcgagctattattggtgaagctgagatgctgatattcccgtctgttctactacctgaaagatatcagacattccaaaccaaacactacctatgggcggccttcaaagcaaaggaggataaaggtgatgcaattgtagaggaggaggttgagaagggaaattgcgtttcaaaccagccagacaaggtacagtctgataatgcttcatttccttcaaaccatggactggaccgtccaagcatggaagctccccctcaaagcagtagcagtgtctttggtattgttgtccgacaagctccaaatcttgaaccagaagtgaagcgatttatccaggagatggaacgcaaaggtgcgttggtaacggttatgaggggggaggcaattggtggagggccatagccaagcaacaccacgaccactatgcattagttgtagagagagtagagagtaaaccatgtcaaactatgctgtagttgtatagagagtctgacacataacgtcgtggacttgagctcttgttcagtttttttgtaaggtacctacaagtttggtcatatgataatttctccggaac

SEQ ID NO: 566 - DNA, 1707 bp, Arabidopsis thaliana
ccacgcgtccgcactctcccaaatctctcttctttaacaacaaaaaaaaaatcacagagacatagagagaagaagacggaacagaggctccaaaaaaatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgttatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaatgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttagagttacatatgtatatgtatatatgtatgattgattgtatgtatagatgatactggagaatgatgagtttttgagaatcaaactcttttcttctttctagtgattgcctttattcctttacatgttttggttctctgtacactatttgatttaccttttttactttctttcttcatttgtcaggaaatgttggaagataacattaatggtaaaaagttggtgtggaccgttgttgcgttggcatttcaaaaaaaaaaaaaaaa

SEQ ID NO: 567 - DNA, 1371 bp, Arabidopsis thaliana
atttattaagcatcaatgagagaacttcagagctgggtttgagttctgtccaataatacataaccacgttatcatttttgtcctttactatctcattacactcttctgttattcgcccaattcttacagtcattactctctatagggctcgagcggccgcccgggcaggtttctatgcagatggttcacacttcccgctccattgcccagattgggttcggtgttaagtcgcaattagtactcactatagggctcgagcggccgcccgggcaggtaaaagatcaaacaatgtctaaagaagctgagatgtcgatcgcggtgtcggctttgttccctggttttagattctctcctactgatgttgaacttatctcgtactatcttcgtcgtaaaatcgatggtgatgagaactctgttgctgtgattgctgaggtcgagatttacaagttcgagccgtgggacttgccagaggaatcgaaactgaaatcggagaacgagtggttttacttctgcgcgagggggaggaagtacccgcacgggtcacaaagccggcgagccacacagctaggatattggaaagcgaccggtaaagagcggagtgttaaatccgggaaccaagttgttggaaccaagagaacgcttgtatttcatatcggtcgggctcctcgtggcgagagaacggagtggattatgcatgaatactgcatccatggagccccacaggatgcattagtggtgtgccggttaagaaaaaatgctgattttcgggctagttcgacccaaaaaattgaggatggtgttgtgcaagacgatggctacgttggccaaagaggtggtttggacaaggaggacaaatcctactatgaatctgagcatcagataccaaatggtgacatcgcagaatcatcaaatgttgttgaggatcaggccgataccgatgatgattgttacgccgagattctgaacgatgatataataaagctcgacgaagaagcgttgaaagctagccaagcgtttcgaccaactaatccaactcatcaagaaacaatatcaagcgagtcatcgagtaagaggtcaaaatgtggtataaaaaaagaatcaacggaaacaatgaattgttacgctttgttcaggatcaagaacgttgccggaaccgactccagctggagattcccgaacccgttcaaaatcaagaaagatgatagccagagattgatgaagaatgttctggccactactgttttcttggctatcttattttctttcttttggactgtattaatagctaggaactaaagctagttacgacatacatattatttatacataaataaatatagtattttgtctatggcaaaaaaaaaaaaaaaa

SEQ ID NO: 568 - DNA, 1387 bp, Arabidopsis thaliana
aagcaaagcacaaccacacttgaacctcataagcggagccacccctccctgcccccaaggaataactcttccgacagcaaccctgttcgtttataaccatcaaccaccttaaaccctgggtagctagctttttttttcattattgtgtcggcaatcggttgaggaaaaaaaaaacacagaggagggtgcaaaaagcagggtggtggatgatggaaggggtttcgagggaggctcagatgtcgattgctgcttcgtccatgtttcctggattcagattctgccctaccgatgaggagttgatttcttattacctgaggaagaagttggagggtcatgaggagagtgttcaagtcatttctgaggttgagctttgtaaatacgagccttgggatttaccagccaaatcattcattcagtcagacaacgaatggttcttcttctctccccgcggaagaaagtacccaaatggttcacaaagtaaaagagcaactgaatgtggatactggaaggcaactggcaaagagcgtaatgtaaagtcaggttccaacattataggaacgaagcggactttggtgttccacttagggcgtgcacctaaaggggaaaggactgaatggattatgcacgagtactgcattaatgacaaatctcaggaatctttggtcatttgtcgcctcaagaggaacacagagttccgtttgagcgatgcttcgaatagagcttcatcaagtcaaaggcatccggtgaattcacatgaaagtggttgtgctatctcaggaggtggtattgatcaaagggatgcttgtgagcaagacaaagaggttggatgtagctccaagagggacagtagcagttatggttctccttcaatggagcaaattgattctgtgtccgaatcgaatcagcgaccagttaacgaagctactttcactgaatcttcaggtcaaccaaaggaggggtatgaagaggattgttatgcagagatactaaaggatgatatcatcaaattagatgaatcatcagtcttggtagagagtcacacaagaccacaggatcctacacagatgcaacctgcaccacaaggcacagcacaacggagaataagattaagggttgggaattcaaagcattctcgtgcagtagttcgtttcccaagcacaatgcactcatcaaagaataccttctttgccagaacaaccaacagtttggtggtattagctttcttcgttttcactttgatggttctatattttttgtccttagtgagaggacaaaaacaagacaagtattgtggggaattttcgggtgtaaatcatgattagtgctacacaaagcgtaggcaatttgttaaactgcttctttcctattaatatgttgcattagcctt

SEQ ID NO: 569 - DNA, 1905 bp, Zea mays
ggcgagggagctcaccaggagagaggggcctgtgtgagcattgagcaaagcaaacgaagcagtacatacatctctcgggggccccggcgaggccggccggctccatgcaacaagggaggacgacgagcggtggcggtgggcgatgatgatgatgatgatggcgggggagcacgtgctggccgctctgggcaccctgctgctggcctcgctcctgaccctggtgctgaaccacttcctgcccttgcttctgaaccccaaggcccccaggggaagcttcgggtggccgctcctcggcgagacgctcaggttcctcacgccgcacgcctccaacacgctgggcggcttcctcgaggatcactgctccaggtatgggcgggtgttcaagtcccacctgttctgcaccccgacggtggtgtcctgcgaccaggacctcaaccacttcatcctgcagaacgaggagcggctgttccagtgcagctacccgaggccgatccatggcatcctgggcaagtcctccatgctcgtcgtcctgggcgaggaccacaagcgcctcaggaacctcgccctcgccctcgtcacctccaccaagctcaagcccagctacctaggcgacatcgagaagatcgcgctgcacgtcgtcggcgcatggcgacggcacggcggcgtcagggtcgtcgcattctgcgaggaggcaagaaagttcgcattcagtgtgatagtgaagcaggtgctggggctgtcgccagaggagccggtcactgcaaggatactcgaggacttcctggccttcatgaagggcctcatctccttccccctctacatcccagggaccccatatgccaaggctgtccgggcgagagagaggatatccagcactgtgaagggcatcatcaaggagcggaggagcgctgggtcatggaacaagcagggcgacttccttgacgtgctgctgtcaagcaacgagctatctgacgaggagaaagtgagctttgtgctggactccctgctgggaggatatgagaccacctcgctcctcatctccatggtcgtttatttccttggccagtctgctcaagatctggacctggttaagagggagcacgacagcataagatccaacaaaggcaaggaggagtgcttgacttcagaagactacaagaagatggaatatacccaacaagtcatcaacgaggcgctgagatgcggcaacatcgtcaagttcgtccaccggaaggcgctgaaagacgtcaaatacaaagagtatctgattccatctggctggaaggtcctaccggtcttcactgccgttcatctgaacccctcacttcatggagacgcgcagcagtttcagccctgtaggtgggagggcacaagccaagggacaagcaagaggtttacaccgttcggtggtggcccccggctctgcccaggatcagagctcgctaaagtggagactgctttcttcctccatcaccttgtcctcaattatagatggagaattgatggcgatgacattccaatggcatacccgtatgtggagtttcagagaggtctgccaatagaaatcgagccaacgtcccctgaatcttgactctcctggagctacagccatcagttatcacaccagagagaaaaggggaaggtgcatggagtatacatgaatggtcagtgacagatctcacaagtgaaggaacactgagggcgcgtgctagtagctagcatatgaggcagctgagactgtaatttaatgtacatggtgtagatatattttgtccatggcaattgcttgaagtggctgattcacttcaccctgtaaaacattctccagtggtttcaactgctatcctataaaaaagaagggcccctgtgtttagtaaaaaaaaaaaaaaaaaaaaaaaaaaaaag

SEQ ID NO: 570 - DNA, 3885 bp, Oryza sativa
atggtatccaatagtttctggcttttcatcctgctagtgagcttcatccccatttctgcttgggcagaatcacgtgatataagtactctgttcactctgagggattcaatcaccgaaggaaaaggctttctccgtaactggtttgattcggaaactcccccatgcagctggtcaggcataacttgcataggacataatgttgtggcgattgatttgtcctctgttccactctatgctccgtttccattatgcattggggcattccagtcacttgttcggctcaacttcagtggatgtgggttttccggagagcttccggaagctttgggaaatttgcagaatctccagtacctagacttgagcaataacgagcttactgggccaatacctatctcactatataacctgaagatgctgaaggaaatggtgcttgactacaactccttgtcaggacaacttagtcctgctattgctcagctgcagcaccttactaagctatctatatccatgaattccatctccggaagccttccaccagatctgggcagcctgaagaacctggagttgttggacattaagatgaacacattcaatggatctataccagcaacttttgggaacctgtcttgtctcttgcactttgatgctagccagaataacctaactggatcaatattccctggaataacctcgttgacaaacctattgacacttgatctatcatcaaacagttttgagggaacaattcctagggagattggtcaactggaaaatctggaattactgattctaggaaagaatgatctcactggaaggattccacaagagattggtagtctgaagcagcttaagttacttcatctcgaggaatgtcagttcacaggcaaaataccttggtcaatcagtggactcagcagcttgacagaacttgacatatcagataacaactttgacgctgagctcccatcatccatgggtgagcttggcaatctaacacagctgattgcaaagaatgctgggctcagtgggaacatgccaaaagaacttgggaattgcaagaagcttactgttataaacctgtcattcaatgcccttattggacctattcctgaagaatttgcagatttagaggctattgtctcattttttgtggaaggaaataaactatcgggtcgtgtcccagattggattcagaaatggaaaaatgcaaggtccatcaggttgggacagaacaaattcagtggacctttgccagtgctgccattgcagcatctgctaagtttcgctgcagaatccaaccttctctcaggttctataccttctcacatatgccaagccaactccttgcattcactcttattgcatcataacaatctgactgggactattgatgaggcatttaaagggtgcacgaacctcactgaattgaacttgttagacaaccatattcatggggaggtaccaggatatttagcagaattacccctggttactctggagttgtcacaaaacaaattcgcagggatgttacctgcggagctgtgggagtcaaaaacccttctagagatatctctcagtaacaatgaaattaccggcccaatacctgagagtattggtaaactctctgtattgcaaaggttgcatatagacaataacttactcgaagggcctatccctcagtctgttggtgatctaaggaatctgaccaatctatccctgcgtggcaataggttatctgggatcattccactagcacttttcaactgcagaaaacttgccacgctggacttgagctataacaatctgactgggaacattccaagtgccatatctcacttgacattgcttgatagcttgattttgtcttccaaccagctgtctggttctatccctgctgagatttgcgtgggatttgagaatgaggctcaccctgactcagagtttcttcagcaccatggtcttcttgatctgtcatacaaccaattgactggtcagatcccaacatctataaagaactgtgcaatggtgatggtgctcaacctccaaggcaatttgctgaatggcaccattcctgtggagcttggcgagctaacaaatcttacatccattaacttgtcatttaatgaatttgttggaccaatgcttccatggtctggacctttggttcaattgcaaggccttattctgtccaataaccacctagatggctccattcctgctaagataggccaaatccttcccaaaattgcagtgctagacttgtcaagcaatgcactcactggcactctaccacagtctttgctctgcaacaattacctaaaccatctggatgtcagcaacaaccacctatctgggcatatccagttctcttgccccgatggcaaagaatactcaagtacactgctcttcttcaattcaagcagcaaccatttctcagggagcctagatgagtctatctcgaacttcacacaattgtctactcttgatatccacaacaatagcctcactggaaggttgccttcagcactttctgatctcagttctttgaattatcttgatctgtcgagcaacaatctctatggtgccataccctgtggaatctgcaatatatttggcctctcatttgccaacttctcaggtaactatattgacatgtacagcttggcagattgtgctgcaggaggcatttgttctactaatggtactgatcataaagcattgcatccatatcatcgggttcgaagggcaattaccatctgtgcctttacattcgtcatcatcattgttttagtgcttctggctgtttatctgagacggaagctggttagaagcaggcctttggcttttgaatctgccagtaaggccaaggctacagttgagcctacctcaactgatgaactgctaggaaagaagtcaagggaacctctgagtatcaatcttgcaacatttgagcatgcacttctgagggtcaccgcggatgatattctgaaagccacagaaaacttcagtaaggtgcacataataggtgatggtggatttggcactgtctacaaggcagcgctccctgaaggccggagagtcgcgatcaagaggctccatggtggccatcagttccaaggtgaccgtgagtttctagctgagatggagacaattggaaaggtgaaacatccaaacctcgtccctctacttggctactgtgtttgtggcgatgaacgattcctgatctacgagtacatggagaatgggagcctcgagatgtggctgagaaaccgagcagatgcacttgaagctcttggatggccggaccgtctcaagatctgcctcggttcagcccgtgggctcgccttcctgcatcatggctttgtgccccatatcatccaccgggacatgaagtcgagcaacattctactggatgagaacttcgagccgagggtctctgacttcggccttgcaaggatcatcagtgcctgtgagacccatgtcagcactgacattgccggtacatttggatacattcctccggagtatggcctcacaatgaagtccaccacgaaaggcgacgtctacagcttcggcgtcgtcatgctggagctcctcaccggacggccacctacaggccaggaggaggtgcaagggggtggaaacctcgtcggctgggtgcggtggatgatcgcccgcggtaagcagaacgagctgttcgatccatgcttgccggtttcaagcgtgtggcgggagcagatggcgcgcgtgctcgccatcgcccgggactgcaccgccgacgagccgttcaagaggccgacaatgctggaggtggtgaaggggctcaagatgacccacggcatggaatgtggacctctggtggtgaccgtctccagggacatgtaa

SEQ ID NO: 571 - DNA, 3333 bp, Oryza sativa
atggacattctcatcccacttctcctctcctcgatctacgtgtcgtcgtcggcggcggcggcggaaaccgatgcggcggcgctcctccgcttcaaggcgttcgtccacaaggatcctagaggagtcctctcgtcgtgggtggatcctggtccatgtcgctggcgtggcgtgacgtgcaacggcgacggcagggtgacggagctcgacctcgccgccggcggcctcgccgggcgcgccgagcttgccgccctctctggtctcgacacgttgtgcaggttgaacctctccggcaatggcgagctgcacgttgatgccggtgacctggttaagctcccgcgcgcgctgctgcagctcgacctctccgatggcggcctcgccggccggcttcccgacggctttctggcgtgttaccccaacctcaccgatgtcagcctcgcgaggaacaacctcaccggcgagcttcccgggatgctcctggcgagcaatatccggtcgttcgacgtgtccggcaacaacatgtccggcgacatctccggcgtgtcgctccccgcgacgctggccgtcctcgacctgtccggcaaccgcttcaccggcgccatcccgccgtcgctgtccggctgcgcgggcctcacgacgctcaacctgtcgtacaacggcctcgccggcgcgataccggagggaatcggcgccatcgccgggctcgaagtgctcgacgtgtcgtggaaccacctcaccggcgccatcccgcccggcctcgggaggaacgcgtgcgcgtcgctgcgtgtcctccgcgtctcgagtaacaacatctccggctccatcccggagtcgctgtcgtcgtgccacgcgctccggctgctcgacgtcgccaacaacaacgtctccggcgggatccctgccgccgtgctcggcaacctcacggcggtcgagagcctcctcctcagcaacaacttcatctccggctctctcccggataccatcgcccactgcaagaacctccgcgtcgccgacctgagcagcaacaagatctccggcgcgctcccggccgagctctgctcgcccggcgcggcgctggaggagctccggctgccggacaacctcgtcgccggcacgatcccgccgggcttgtccaactgctcgcggctgcgggtgatcgacttcagcatcaactacctgcgcggcccgatcccgccggagctcggccggctccgcgccctggagaagctggtgatgtggttcaatggcctcgacggccggattccggcggatctcgggcaatgccggaatctccggacgctgatcctgaacaacaacttcatcggcggcgacatccccgtcgagctcttcaactgcaccggcctcgagtgggtgtcgctgacgagcaaccagatcaccggcaccatccggccggagttcgggcggctgtcccgcctcgccgtgctgcagctggcgaacaacagcctcgccggcgagatccccagggagctcggcaactgcagcagcctcatgtggttggacctcaacagcaaccgcctcaccggcgagatccctcgccgcctcggccgccagctcggctccacgccgctcagcggcatcctgtccgggaacacgctggcgttcgtccgcaacgtcggcaactcgtgcaagggagttgggggattgctggagttcgccggaatccggccggagcggctgctgcaggtgcccaccctcaagagctgcgacttcacgcggctctactccggcgccgccgtgagcgggtggacgcggtaccagacgctggagtacctcgacctctcgtacaacagcctcgacggcgagatccccgaggagttgggcgacatggtcgtgctccaggtgctcgacctggcgcggaacaacctcaccggcgagatcccggcgtcgctcggccgcctccgcaacctcggcgtgttcgacgtgtcgcgcaaccggctgcagggcggcatcccggactccttctccaacctctccttcctcgtccagatcgacatctccgacaacaacctctccggcgagatcccgcagcggggccagctcagcacgctgccggcgagccagtacgccggcaacccggggctgtgcggcatgccgctggagccctgcggcgaccgcctcccgacggcgaccatgtccgggctcgccgccgcggcgtcgacggatccgcccccacggcgcgccgtggcgacgtgggccaacggcgtgatcctcgccgtgctggtgtcggccgggctggcgtgcgcggcggcgatatgggcggtggcggcgcgggcgcggcggcgtgaggtgcgctcggcgatgatgctgagcagcctccaggacgggacgcggacggcgacgacatggaagctcgggaaggcggagaaggaggcgctgagcatcaacgtggcgacgttccagcggcagctccggaagctgaccttcacgcagctgatcgaggccaccaatggcttctccaccgccagcctgatcggctccggcgggttcggcgaggtgttcaaggcgacgctcaaggacgggtcgtgcgtggcgatcaagaagctgatccacctgagctaccagggcgaccgcgagttcatggcggagatggagacgctgggcaagatcaagcacaagaacctcgtccccctcctcggctactgcaagatcggcgaggagcggctgctggtgtacgagttcatgagccacggcagcctggaggacacgctgcacggcgacggcggcagatcggcatcaccggcgatgtcgtgggagcagcggaagaaggtggcgcgcggcgcggcgaggggcctgtgcttcctccactacaactgcatcccccacatcatccaccgcgacatgaagtccagcaacgtgctcctcgacggcgacatggaggcgcgcgtcgccgacttcggcatggcccgcctcatcagcgcgctggacacgcacctgagcgtcagcacgctcgccgggacgccgggctacgtgccgccggagtactaccagagcttccggtgcacggtgaagggggacgtctactccttcggcgtcgtcctcctcgagctgctcaccggccgccgccccaccgacaaggacgacttcggggacaccaacctcgtgggctgggtcaagatgaaggtcggggacggcgccgggaaggaggtgctcgacccggagctcgtcgtcgagggcgccgacgccgacgagatggccaggttcatggacatggcgctgcagtgcgtcgacgacttcccctcaaagcgcccaaacatgctgcaggtggtcgccatgctcagggagctcgacgcgccgccgccggcaactgccatataa

SEQ ID NO: 572 - DNA, 3366 bp, Oryza sativa
atggattccttgtgggcagcgatagcggcactgtttgtggcggcggcggtggtggtgaggggggcggcggcggccgacgacgcccagctgctcgaggagttcaggcaggcggtgccgaaccaggcggcgctcaaggggtggagcggcggcgacggcgcgtgcaggttcccgggggccgggtgccggaacgggaggctcacgtcgctgtcgctcgccggcgtgccgctcaatgccgagttccgcgccgtcgcggccaccctgctgcagctcggcagcgtcgaggtgctgagcctccgcggcgccaacgtcagcggcgcgctctcggcggctggcggcgcgaggtgcgggagcaagctgcaggcgctcgatttgtccgggaatgccgcgctccggggctccgtcgccgacgtggcggccctggccagcgcctgcggcggcctcaagacgctgaatctctccggcgatgcggttggtgcggcgaaggtcggtggcggtggtggcccgggctttgccgggctggactcgcttgatttgtccaacaacaagatcaccgacgatagcgacctccggtggatggtggatgccggagtcggggcagtacggtggttggaccttgccctgaacaggatctccggtgtcccggagttcaccaactgctccgggcttcagtaccttgacctctccggcaacctcatcgtcggtgaggtgcccggcggggcactttccgactgccgcggtctgaaagtgctcaacctctccttcaaccacctcgccggcgtgttccctccggacatcgccggcctcacgtcgctcaacgccctcaacctctccaacaacaacttctccggcgagctccccggcgaggctttcgcaaagctgcagcagcttacggcgctctccctctccttcaaccacttcaacggctccatcccggacaccgtagcctcgctgccggagctccagcagctcgacctcagctccaacaccttctccggcaccatcccgtcgtccctctgccaagatcccaactccaagctccatctgctgtaccttcagaacaactacctcaccggcggcatcccagacgccgtctccaactgcaccagcctcgtctccctcgacctcagcctcaactacatcaatgggtccatcccggcatccctcggcgaccttggcaacctgcaggacctcatcctgtggcagaacgagctggagggcgagataccggcgtccctgtcgcgcattcagggcctcgagcatctcatcctcgactacaacgggctcacgggtagcatcccgccggagctagccaagtgcaccaagctgaactggatttctttggcgagcaaccggctgtccgggccaatcccttcatggcttgggaagctcagctacttggctatcttgaagctcagcaacaattccttctcggggcctataccgccagagctcggtgactgccagagcttggtgtggctggacctgaatagcaatcagctgaatggatcaatacccaaagagctggccaaacagtctgggaagatgaatgttggcctcatagttggacggccttacgtttatcttcgcaacgacgagctgagcagcgagtgccgtggcaaggggagcttgctggagtttaccagcatccgacctgatgacctcagtcggatgccgagcaagaagctgtgcaacttcacaagaatgtatgtggggagcacggagtacaccttcaacaagaatggttcgatgatatttctcgatttgtcatataatcagctggactcggcgattcctggcgagctgggggacatgttctacctcatgatcatgaatcttgggcacaacctactgtcaggtaccatcccatcgcggctagcagaggccaagaagcttgcggtgcttgacctgtcgtataaccagttggaagggccaatacccaactctttctcggcactttccttgtcggagatcaatctgtcaaataatcagctgaatggaacaattccagagcttggttcccttgccacatttccgaagagccagtatgagaataacactggtttatgtggcttcccactgccaccatgtgaccatagttccccaagatcttccaatgaccaccaatcccaccggaggcaggcatcgatggcaagcagtatcgctatgggactgttattctcactgttctgtataattgtgatcatcatagccattgggagcaagcggcggaggctgaagaatgaggaggcgagtacctctcgtgatatatatattgatagcaggtcacattctgcaactatgaattctgattggaggcaaaatctctccggtacaaatcttcttagcatcaacctggctgcattcgagaagccattgcagaatctcaccctggctgatcttgttgaggccacaaatggcttccacatcgcatgccaaattgggtctggtgggtttggtgatgtctacaaggcacagctcaaggatgggaaggttgttgcaatcaagaagctaatacatgtgagcgggcagggtgaccgggagttcactgcagaaatggagaccattggcaagatcaaacaccgtaaccttgttccacttcttggctattgcaaggctggtgaggagcggttgttggtgtatgattacatgaagtttggcagcttggaggatgtgttgcatgaccgcaaaaagatcggtaaaaagctgaattgggaggcaagacggaaaatcgctgttggagcagcaaggggtttggcattcctccaccacaattgcattcctcacatcattcaccgagacatgaagtcgagcaatgtgcttatcgatgaacaactggaagcaagggtatctgatttcggtatggcgaggctgatgagcgtggtggatacacaccttagcgtgtccactcttgctggaacgccagggtatgtaccaccggagtactaccagagcttcagatgcaccaccaagggtgatgtttatagctatggtgttgtgttgctggagctgctcaccgggaaaccgccgacggactcggcagactttggcgaggacaataaccttgtggggtgggtcaagcagcacaccaaattgaagatcacggatgtcttcgaccctgagctactcaaggaggatccatccgtcgagcttgagctgctggagcatttgaaaatcgcctgtgcgtgcttggatgaccggccgtcgaggcggccgacgatgctgaaggtgatggcaatgttcaaggagatccaagctgggtcgacggtcgactcgaagacctcgtcggcggcagcgggctcgatcgatgagggaggctatggggtccttgacatgcccctcagggaagccaaggaggagaaggattag

SEQ ID NO: 573 - DNA, 1686 bp, Oryza sativa
atggcagatctgcaggagcccctcgttcgtccgaagaggaagaaggttttggtggactacttggtaaagttccgatggattctggtgatctttgtggtgctccccatttccgctctgatctacttcaatatctatttgggcgatgtctggtctgccatgaaatctgagaaacgtcgccagaaggaacatgatgacaatgtgcaaaaagttgtgaagcggctcaagcagaggaacccaaagaaggatggccttgtttgcacagctaggaagccctggattgctgttggcatgcgcaatgtagactacaagcgtgctaggcattttgaggttgacctttccgccttcaggaacattcttgagattgacagagagagaatggttgccaaggttgagcctcttgtcaacatgggccagataaccagagctacatgcccaatgaaccttgcccttgcagttgttgctgagcttgatgaccttactgttgggggactgatcaatgggtatggtattgaagggagctctcacctctatggtcttttctctgacactgttgtcgccgtggaagttgttcttgcagacggtcgagttgttagagccactaaggataatgagtactctgaccttttctatggcattccctggtcccagggaacacttgggtttcttgtttccgctgagatcaaactcattcccatcaaggaatacatgaggctcacatatactccagttaaagggtcactgaaggagatagcacaaggttattgtgattcgtttgcaccacgagatggtgatcctgcaaaggtcccagacttcgttgagggaatggtgtacacagaaaatgagggtgtcatgatgactggtgtttatgcttccaaagaagaggcaaagaagaagggcaataagatcaactgtgtcgggtggtggttcaagccttggttttaccaacatgctcagacagcactcaagaagggtgagtttgtggagtacattccaacaagagagtactaccaccgtcacacccggtgtctgtactgggaggggaagctgatcttgccattcggcgaccaattctggttcaggttcctcttgggctggctgatgccaccaaaggtgtctctgctcaaggccacacagggtgaatctatcaggaattactaccatgacaaccatgtgattcaagacatgctggttcccttgtacaaagttggagatgctcttgagtttgttcacaaggaaatggaggtttatccactgtggctgtgcccgcaccggctctacaagctccctgtgaaaaccatggtgtacccagagcctggctttgagcaccaccacaggcaaggtgacactagctatgcccagatgttcaccgatgttggtgtgtactatgctcctggtgctgtcctgaggggcgaggagttcaatggcgctctagctgtccacaggctggagcagtggctgattgagaaccacagctaccagccacagtacgctgtatctgagctcaacgagaaggacttctggaggatgtttgatgcttctcactacgagcattgccgccaaaagtatggtgccgtcggtacctttatgagcgtctactacaagtccaagaagggaaggaagactgagaaggaggtgcaggaagccgaggccgccatcctcgagccagcctacgctgatgaggcgtaa

SEQ ID NO: 574 - DNA, 2056 bp, Zea mays
attcggctcgagcgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggcgacatgtggtccgccatgaagtcggagaagaagcgccagaagcagcacgacgagaacgtgcagaaggtcgtgaagcggctcaagcagaggaacccgaagaaggacggtcttgtttgcacggccaggaagccctggatcgctgttggcatgcgcaacgtggactacaagcgtgcgaggcatttcgaggtcgacctttcttccttcaggaacatccttgagatcgacaaagagaggatggttgccaaggtcgagccccttgtcaacatgggtcagataaccagagctacctgcccaatgaaccttgcccttgcggtcgtcgccgagctcgacgacctcactgttggtgggctgatcaacggttacggcatcgaggggagctctcacctctatggccttttctccgacacggttgtcgcgatggaggttgttctcgcagatggccgggtcgtcagagccaccaaggacaacgagtactctgaccttttctatggcattccctggtcccagggaacactggggttccttgtctctgcggagatcaagctgatccccatcaaggagtacatgaagctcacctacactccagtcaaggggggtctaaaggagatcgcgcaggcctacgcggattctttcgcgccgagggacggtgacccggcaaaggtccctgactttgttgaagggatggtgtacacagagagcgagggtgtcatgatgacgggcgtgtacgcttccaaagaagaggcgaagaagaagggcaacaagatcaactgcgtggggtggtggtttaagccctggttctaccagcacgctcagacggcgctgaagaggggcgagtttgtggagtacatcccgacgagggagtactaccaccggcacacccggtgcctgtactgggaggggaagctgatcctgcccttcggcgaccagttctggttcaggttcctgctgggctggctgatgccaccgaaggtgtccctgctgaaggcgacccagggcgaggctatcaggaactactaccacgacaaccatgtgatccaggacatgctggtgccgctgtacaaggttggggatgcgctggagttcgtgcaccgcgagatggaggtgtatcctctgtggctgtgccctcaccggctgtacaagctgccggtgaagacgatggtgtacccggagcctgggttcgagcaccagcacaggcagggcgacacgagctacgcacagatgttcacggacgtgggcgtgtactacgcccccggggcggtgctgaggggggaggagttcaacggcgcggaggctgtgcacaggctggagcagtggctgatcgagaaccacagctaccagccgcagtacgcggtgtcggagctgaacgagaaggacttctggcgcatgttcgacgcgtcgcactacgagcactgccgccaaaagtacggggcggtgggcacgttcatgagcgtgtactacaagtccaagaaggggcgcaagacggagaaggaggtgcaggaggcggaggcggccatactggagccggcctacgcggacgaggaggcctaaaagctcgtggtcgttttgcttagcccattttaattagaacttgatggatgtagtgtgtgtctgtctcaagtcattttaattagaactcttaaagctcgtggtcggtcggtcagtcagtcagtcattgtcgttgatgtccagcgttgtgttttttttatattctctaatggaatctctcagattgattcgggaaaaaaaaaaaaaaaaaaaaaaaaaaaaaaaaaaaaagg

SEQ ID NO: 575 - DNA, 717 bp, Oryza sativa
atggcgggcggcggcggcgagtacctgcgccagttcgtcgaggagacggcctggtacaacgagatcttcctcagccatgtggtcccgggcgactggtggcgcgccctcccccacccgctccagtcgtggctccgcaacggcctcggcggctacctcatctacttcgcctgcggcttcctctggtgcttcgtcatctactactggaagcgccacgcctacatccccaaagattctatacctacaatcgaagctatgaagaagcaaataattgttgcatcaaaggctatgcctctctattgtgcccttccaaccttatctgagtacatggttgagaatggatggacacagtgttatgttaatatcagtgaagttggttggccaatgtacctggtttatctggctttatatcttatctttgttgagtttggaatttactggatgcacagagagttgcatgacataaagccattgtacaagtacctgcacacataccaccatatttacaacaaggagaataccctatcaccatttgcagaggccgtgtggacaactaacatccatgactgcattcacggcaaggtttggccggtcatgggtgctggctatcacaccattcaccatacaacataccgtcacaactatggccactacaccgtgtggatggactggatgttcggcacccttcgagagccagaagatatcttgaagaaggattag

SEQ ID NO: 576 - DNA, 1112 bp, Zea mays
caactccccaccccagccgatcccaacgcacactgcacccagtgcggcggccgccggcaatggcggtgcacggcggcgactacttgcggcggttcgttgcggagacggagtggtacaacgaggtcgtcctcaacgccgtggcgccaggcgactggtggcgcggcctgccgcacccggtgcagtcgtggatgcgcaactgtgtcggcggttacctcctctacttcatctctggtttcctctggtgtttcgtcatctactactggaagcgccacgcctacatccccaaagatgccatccccacaaatgaagctatgaagaagcaaatagctgtagcatccaaggctatgcctttttactgtgctcttccaactttatctgagtatatgatcgagagcggatggacccggtgttactttaatatcagcgaaatgggtttttctgcgtacctttgttatatggctatgtatctcatttttgtggagtttggaatttactggatgcacagagagttgcatgacataaagccactatacaaacatctgcatgcgacccaccatatttacaacaaggagaacaccttgtctccgtttgctggactcgcgtttcacccactggatggtattctgcaagcgataccgcatgtgcttgcgctcttcctcctcccaacgcacttcaggacgcacatcgctctcgtgttcttggagggcgtgtggacgacaaacatccacgactgcattcacggcaaggtatggccagtcatgggcgctgggtatcacaccatccaccatacgacttaccgccacaactatggccactacaccgtctggatggactggatgtttggtacgctccgtgagccagatgatatcctcaagaaggcctgagttcgtcgtagctgtggttttcctacggtgctggatgtgcttggtctgttctgtccccagtgcctctaatccgctgagcctgttcagcgctctgtttctgtaggctttggtgtgctatttagtttgctaggtttatatgttgtgcttattctgtaatttagtgatgtttgtctgatgacgcaacggagttcaggacgaataaagaaagatttgctagacaaaaaaaaa

SEQ ID NO: 577 - DNA, 1214 bp, Zea mays
cacacacacttcacccagcgcggcggccgccggccgccggcaatggaggccgtggcgcgcagcggcgactacctttggcggttcgtggcggagacagagtggtacaacgaggttgtcctcagcgccgtggcgccaggcgactggtggcgcggcctgccgcacccggtgcagtcatggatgcgcaactgcgtcggcggttacctcctctacttcatctctggtttcctctggtgcttcgtcatctactactggaagcgccacgcctacatccccaaagatgccatccccacaaatgaagctatgaagaagcaaatagttgtagcatcgaaggctatgcctttttactgcgctcttccaactttatctgaatatatgattgagagcggatggactcggtgctacttcaatatcagcgaaattggtttttctatgtacctctgttatatggctatgtatctcatctttgtggagtttggaatttactggatgcacagggagttgcatgacataaaaccattatacaaatatctgcatgcaacccaccatatttacaacaaggagaataccttgtctccatttgctggacttgcatttcatccactggatggtattctgcaagcaataccgcatgtgttcgcgctcttcctctttccaacacacttcaggacacatattgcactcttgttcctagaggctgtgtggacaacaaacatccacgactgcattcatggcaagatatggccagtcatgggcgctggatatcacaccattcaccatacgacttaccgccacaactatggccactacaccatctggatggactggatgtttggtacgctcaatgagccagaagatatcctcaagaaggcttgagtttctcggagctgtggtatccctatggtgctggtgctggaactgctcgatctgttcccagtgtttctaatccgttgagcctgttcagcactgtctgtttatgtaggcatcagtgtgttaattagtttgctaggttcatatggctttgtgcttattctgtaatttagtgatgtttgtctcatgacgcaacggagttcaggacgaataaaactttgctagacacattctggattccagttgcttgtacaatgttgcaactcaactgtcaatataggatgtaaaacggattccttctaaaaaaaaaaaaaaaaaaaaaaaaaaaaaaaaaaaaaaaaaaaaaa

SEQ ID NO: 578 - DNA, 1313 bp, Glycine max
gataaaaggagatccaaagtaaagaacacagatggcatgacaccacgaaaccaaattaaaaactgcgccttctctgtctctgtttgttcttctcactttatattctctctctgtgtatatctcttcactcttattattccttctcttctcaacgacgatggaggacccatcagcagcaacaacgttgttgctgaacagcgaatattcgaggctgttcgtcgaggacacggacttgtacaatcgcattgtgttgggaaccctcttgccgcacttcgtgtggggcccactcccgcacttcctccagacgtggcttcgcaattacctcggcggcgtcctcctctacctcctctccggcctcctgtggtgcttctacatttattattggaagcgcaacgtttatgttcccaaagatgctattccctctcgaagagccatgctcttgcaaatatctgttgctatgaaagccatgccttggtacactttgcttccaactgtttcggagtacctggtagaaactggctggacaaagtgctatcctagattatataatgttggttggcttgcataccttgtgtatttagcaatttatctaagtattgtagagtttggtatttattggatgcacagagaactgcacgacataaaaccgctttacaaatatcttcatgctacccatcacatctacaataaacagaacactctctccccttttgctggtttggcatttcaccctcttgatgggatacttcaggcattacctcatagcctttgtttgttttttatgccaatccattttactacacatttagtcctcatattcattgagggcatttggactgctaatattcatgattgcattcatggaaaattgtggcctgttatgggtgctggttaccacaccattcaccacactacatatcggcacaactatggccactacaccatatggatggattggctatttggaactcttcacaaccccgaggaggacgagggcaaggctatgtgatgaattgcagacttacattggcagtcatttattatcatgtttggattgttgaaatgtgcttacttgcatgtaaagcataaatgtgttagctatatttttctggtgtttcatcacaaggtgatggctctatattagagagacagggttgagggttaaagtggagcttccctgtctctaatcccattgttagtgtatgtgattgaggttattttctttctcaaattgtgtggtagagttgagatagtaatgcagttttttcttttttgaaggtaatgcagttttctctaaaaaaaaaaaaaaaaaa

SEQ ID NO: 579 - DNA, 1982 bp, Oryza sativa
cctcgtcgctgcgttgtgtttgtgctgctgcattgcgacattccgatcggagcttagcttagctttcgtcgtcgcgaatggcgacgcgagggcggattgtagcggcggtggcgagcgttgtggtggcgtggctggcggtcgccgtcggcgtgaacggcggcgggtgcgaggcggagcgggaccgggtggaggcgctgccggggcagccaccggtggcgttcgcgcagtacgccgggtacgtggcggtgagcgaggcgagcgggcgggcgctcttctactggctcaccgaggccgccgccgccgccgccgccaccaagccccgcgcccgctggctcttccccggtcctggatgctcatcgattgcgtatggagcatctgaagagattggcccatttaggattaagacaaacgggacagggctctatctgaacaagtactcatggaacagagaggcaaacctcctgttcctggaatcacctgccggagttggcttttcatactccaacaccacctctgatctcaagacatctggtgatgagaggacagctcaagatgcgttgcagttcttgatcagttggatgtcccgcttcccacagtatcggcaccgggatttctacattgctggagaaagctatgctggacattacgttccccagttggcaaggaagatcgttgagttcaacaaggcctcaccatatcctttcatcaacctcaaggggatccttgtgggcaatggggtgactgacaactactacgacaacatcggcacggtgacctactggtggacgcacgccatgatctcggacaccacctacaaggccatcatgtcgtcgtgcaacttcaccagcgccaacgtctccaggctctgcaaccgcgccatgagctacgccatgaaccacgagttcggcgacatcgaccagtacagcatctacacgccgtcctgcgccgccgccgccgccaacgccaccggccgccgccgcggcaaggccgccgtgctgaggttcaaggacaccttcctacggcgccggtcgttcggctacgacccctgcacggagacatacgccgagaagtactacaaccggccggatgttcagaaggccatgcatgccaacatcactgggattccttacagatggacagcctgcagtgatgtgctcatcaagacgtggcgagattcagagttctccatgctgccgacttacaagttgctgatgaaggccgggctgaggatatgggtgttcagtggcgacacggattcggtcgttccggttactgcgacgaggtttgcgcttagccatcttggactgaagacgaagatccgctggtacccttggtactcagctggacaggttggaggatggtctgaggtgtatgaagggctcacatttgcgtcagtgagaggtgctgggcatgaggtgccactgtttcagccaaggagagcattcaggatgtttcagtcgttcttggcaggggagccattgccaaaatcctgatggtttcctgccaacaactgatgtctagctacaaagtctagaaatctgtaaaagatgcttggtagaggtgcagtgtagttgataggtgaggagtgtgattgattggtgttgggaaaaggataataagagaataaggatggttgtgccatggaaaccatgggcatcgcaacaaggagctaataaacttgaagccttccgctctgtttaccactaaggttccatttggattggaggaatttcgctggaattttagaggaactgaactatttcctgtgaaaatcctataaaattcctgtgctctgaaggaaccctgagcaattatctcatcgaaaaagaatatatcatgtacgcaattcaacgcaaaagggagccatgaagtaatttgctgaatatagccatgtatagtgtcaccagtaacggaagtacctttatttatcatgaaaataagttccctgacatacagggataacatgcaaaaaaaaaaaaaaa

SEQ ID NO: 580 - DNA, 1906 bp, Zea mays
ccggccgggccggggttcacacaccgtcgcgagctagctagccacaccacaccttcctcctcactcccaattccatatagttcctctgcccacgcgcgcacaaaggccatggcgacgacgcggcctcgcggtgggggtggggcggcgagcggcgcgctggtcatggcgatcgtcgtgctgctgctactgccgccatatggagccggcgcggaggagtgcgaggacggcggcatcagcagccgggcgcgcgcgggcgaccgcgtggaggcgctgccggggcagccggcggtggcgttcgcgcagtactccgggtacgtggcggtggaccgggaccgcggccgcgcgctcttctactggctcaccgaggccgtcggcgacgacgcggccgccaagcccctcgtgctctggctcaacggaggtcctggatgctcgtcggtggcgtatggagcgtcggaggagatcggcccgttccggatcaaaccaaacgggacaggcctgttcctcaacaagtactcatggaacagagaggcaaaccttctgttcctcgagtcgcccgcgggagtcggcttctcctacgccaacaccacctcggacctcaagacgtcgggcgacgagaggaccgctcaagacgcgctgcagttcctggtcagctggatgtcacggttcccgcagtaccggcaccgagatttctacatcgccggagaaagctacgcgggccactacgtcccccagttggcaaggaagatcgtcgagtacaacgaggcctcgcctcaccccttcatcaacctcaagggaatccttgtgggcaacgcggggaccgacaactactacgacaacatcggcacggtcacctactggtggacgcacgccatgatctccgaccgcacctacaaggccatcctcaggtggtgcaacttcagcagcagcagcatctcgcgcccctgcaaccgcgccatgagctacgccatgaaccacgagttcggggacatcgaccagtacagcatctacacgccgtcgtgcgccgccgcggccagggccattcggctcgagctcaggttcaagaacaccctcgtccgccgccgccgctcctccggctacgacccctgcacggagacctacgccgagaggtactacaacaggatggacgtgcagagggcgatgcacgccaacaccacggggatcccctacagatggactgcctgcagtgatgtgctgatcaagacatggcaagattcagagttctccatgctgccgacgtacaagaagctgatgaaagcaggactgaggatatgggtgttcagcggcgacacagattcagtcgtcccggtgaccgcgacgaggttcgccatcagtcatctcggtctgaagatcaagacccgctggtatccgtggtactcagctggacaggtaggaggatggtctgaggtgtacgaagggctcacgtttgcgtcggtgagaggcgcagggcatgaggtgccgttgttccagccccggagggcgttcaggatgttccggtcgttcttggccggggagccattgcccaagtcctgaaggttcctcacatgtgactgaggccatgcatgcctacctgatcatgtctagctacggtcctgacgggtgagaaggtgacgttccccaggtagagaatgacttgttgataggcgcgcagttcatagctgaggagtgattgattggtctcgggagaaggatgtagagaataataaggatggctatgttatgccatggaaacccatgagcattgcaatgattagcgaataattttcagtgatctcactctcaagtgcttatgttatgttatgttatgttatgccatggaaacccatgagcaatgcgacgaataaatttgaaggatctcactcttgaaccaaaaaaaaaaaaaaaaaag

SEQ ID NO: 581 - DNA, 2067 bp, Glycine max
agattgttgaatcatcacatggctgtgacaaaagagaaagaggatgttcggaacactgggaagagattgaaatgcatgaggaatgaagaagaagaagtttatgaagaagaagagagtgagcttcctttaaagccaggatttttcttctacccaacaacacccacttcctttgttgtatctgatgctcttgaacccgattttcccatcatatatgtcaacaaggtctttgaaatctccactggatatcgtgctgacgaggccctcggtcgcaattgtcggttcttacagtatagagatcctcgagctcagaggaggcaccctttggtggatcctgttgttgtgtctgagattagaagatgcctcgaggaaggtgttgagttccaaggtgaacttctgaatttcagaaaggatggtactcctttggtgaacagactgagacttgcgccaattcatgacgatgatggaactgtgacacatgtgataggtatccaactcttttctgaggcaaatatagatctgaaccgtgtctcatatccagtcttcaaagagacttgcaatcaagattttgataagactggtaaatataatcctaagagtggacaatcattgtacagtcagcaccaagagatgtgtggcattcttcagctttctgatgaagtcttggctcacaacattttgtcacgcttgacaccgagggatgttgcatccattgggtctgtatgcaggaggatccgtcaattaacaaagaacgagcatgtcaggaagatggtatgtcaaaatgcgtggggcaaagaagtgacgggcacattggaactgatgaccaagaagttaggatggggtcgtctgactcgggaacttaccactctcgaagctgtttgttggagaaaactgacagttggaggtgcagtggagccttcacgctgcaatttcagtgcttgtgctgcaggaaaccgacttgtattgtttggaggtgaaggagtggatatgcaacctatggatgacacttttgttctaaatcttgatgctaaaaatccagaatggcgcagggttagtgtgaaatcatcccctcccggaaggtggggccacacgctctcatgcttaaatggttcttggttggtggtttttggtgggtgtggtaggcagggattgctcaatgatgtgtttgtgcttgatttggatgctcaacagccaacatggagggaggtttgtggtggaacaccaccacttcctagatcatggcatagctcttgcacaattgaagggtccaaattggttgtctccggcgggtgcacagatgctggggtacttcttagtgacacatatttactggacctcacaacagataatccaacatggagagaaattccaacttcatgggctcctccttctcggttggggcactcactctcagtctatgggaggactaagattctaatgtttggaggacttgccaagagtggacacttgcggctacgatcaggcgaggcttatacaattgacttagaagatgaacaaccacaatggaggcaactagaatatagcgcattcacagggttagcgagtcaaagtgctgttgttcctcctcctaggctggatcatgttgctgtcagcatgccttgtgggaggatcattatatttggaggttccattgctggtcttcactcaccatctcagctctttctgttggacccctctgaagaaaaaccatcctggaggatcctcaatgttcctgggcaaccgccgaaatttgcttggggtcatagcacttgtgtggttggagggacaagggtgttggtgttgggtggacacactggggaggaatggatactgaatgagttgcatgagttatgcttggcaagtcgacaggactctgacctgtgaagtgcataaaaccagaccctcttctctcaagacaagattttggttgcaaaaaggttttgggtggctttcctttagcagtttggtttttgtatatgagccactattacatgattgttatatgaaatgacgtgtgtattaccagtgtttttgaatgatatatgatgtcatctggctcctctgtaaaaa

SEQ ID NO: 582 - DNA, 2511 bp, Zea mays
atcatttatttttgtcaggctagtcgatccaaataattccatactataacgtcttgtagtagttattttatgattgcttgtgccaaccttaaatttgctaacagtgccaaacttgacagagggcctatcgaagcatctcacaaactgtgttcactcaaaattgtctttcccggctccatttccccccgcaccaaaccagccaaaccactggcgcacgccgaggagagagaaagggggtgtgcggggcggcgaccggcctccgacgacgcggggcgtcgcggcgtcgtggcggtgaagcggatgaggctgtgggaggaggaagacgaggaggggatggaagtggacggggaggcggaagatgagccggggtggccgtgtggggcgccggaggcggggctcggcgagacgaggccggcagcgatcctcgtggcggacgcggcggaggtcgacttccccgtcatctacgtcaacgccgccttcgaggccgccacggggtaccgcgcgcacgaggtgctcgggcggaactgccgattcctacaattccgggatccacatgcccaaaggcgacaccccctcgttgatcccatggtcgtttcagagatacggcgatgcctcagcgaggggatcgaattccaaggcgagctgctgaatttccggaaggacggtgctccacttcacaacagattaaggctcgttcctatgcacggcgatgatggctatgtgacgcatgttatcggaatccagctattctctgaggcgaacatcgatctcagcagcgtatcgtatccggtgtacaagcaaaagtccagcagcaggcccagcattcaagatctgaactcatctccccacgagcacgctccgaaaatccagagtgcagaccactgcggcatgcttcagttgtcagacgaagttctcgcacacaacatcctatcccgcctgtccccaagagacgttgcgtccatcggatcggtgtgcaccagaatgcatgagctgaccaagaacgatcacctgaggaagatggtctgccagaacgcgtggggaagggacgtcaccgtgaggctggagatgagcaccaagatggtaggatggggccgtcttgcgagagagctaacaactctcgaggccgcctcatggcggaagttcacggtcggagggcgtgtcgagccttcccggtgcaacttcagtgcctgcgctgttggcaaccggcttgtccttttcggaggggaaggcgtgaacatgcagcctatggacgacacgttcgtgctcaacctggaggccgcaacgccggagtggcggcgcgtcaaggtttctgcctccccgcccggccggtgggggcacactctgtcgtggctgaacgggtcgtggctggtagtgttcggaggctgcgggcagcaaggtctgctcaacgacgtcttcgtcctcgacctcgacgcccagcagccgacgtggagggaggtcgcgagcgagggccctccgctgccgcggtcctggcacagctcatgcaccctggacggctcgaagctcgtggtctcaggtggctgcgccgagtccggcgtcctcctcagcgacaccttcctcctcgacctcaccaaggagaagcctgcgtggagggagatccctacgtcctggtcgcccccgtcccgcctcggccacaccacgtccgtctacggcgcgaccaagctgttcatgttcggtgggctggcgaagagcggctcgctccggctgcgctccagcgacgcctacacggtggacgtcagcgaggacagcccgcagtggaggcagttggccacgacgaccgggttcccaaacgtcagtccgccgccgaggctcgaccacgtcgcggtgagcctgccctgtggacggatcatcatattcgggggctccatcgcggggctccactcccccgcgcagctgttcctgatcgatcccgcggaggagaagccgatctggaggatcctgaacgtgcctgggcagccccccaagttcgcatgggggcacagcacctgcgtggtcggcggtaccagggtcctggttctcggaggccacactggcgaggaatggatactgaacgagctgcatgagctctgcctggcaagcaggcccgacgaggacggctgatgacttcttttcgttgcacttgcacacatatggttcgttcgtctctctctgttttacgtcctatatatgcgcgctatgtcttgtttgtgtatcatctactttcagtctgttgctgcgtcgtgtcggtccgtcggtatgagaaaaaaaaaagcggaaattgattttttaaaaattagtctggatgagtttagtctattttattgtcattggagaagttctctttcatcggtctaggataagattctatggtctatatgtatgtatattttcatgtctcagaaaacacaaaaaaaattattgaaggtccaatgtcttgtactcgtattttttaaaaacaaaaaaaaaaaaaaaaaaaaaaaaaaaaaaaaaaaaaaaaaaaaaaagggcggccgc

SEQ ID NO: 583 - DNA, 1361 bp, Saccharomyces cerevisiae
gtgtgcttataccagcttgagaaagtactgacccttgaatcgttaagtttacttctacaaaatctccaagtaaagaaggaatataagtaatataagtacaatgtccgccgctactgttggtaaacctattaagtgcattgctgctgttgcgtatgatgcgaagaaaccattaagtgttgaagaaatcacggtagacgccccaaaagcgcacgaagtacgtatcaaaattgaatatactgctgtatgccacactgatgcgtacactttatcaggctctgatccagaaggacttttcccttgcgttctgggccacgaaggagccggtatcgtagaatctgtaggcgatgatgtcataacagttaagcctggtgatcatgttattgctttgtacactgctgagtgtggcaaatgtaagttctgtacttccggtaaaaccaacttatgtggtgctgttagagctactcaagggaaaggtgtaatgcctgatgggaccacaagatttcataatgcgaaaggtgaagatatataccatttcatgggttgctctactttttccgaatatactgtggtggcagatgtctctgtggttgccatcgatccaaaagctcccttggatgctgcctgtttactgggttgtggtgttactactggttttggggcggctcttaagacagctaatgtgcaaaaaggcgataccgttgcagtatttggctgcgggactgtaggactctccgttatccaaggtgcaaagttaaggggcgcttccaagatcattgccattgacattaacaataagaaaaaacaatattgttctcaatttggtgccacggattttgttaatcccaaggaagatttggccaaagatcaaactatcgttgaaaagttaattgaaatgactgatgggggtctggattttacttttgactgtactggtaataccaaaattatgagagatgctttggaagcctgtcataaaggttggggtcaatctattatcattggtgtggctgccgctggtgaagaaatttctacaaggccgttccagctggtcactggtagagtgtggaaaggctctgcttttggtggcatcaaaggtagatctgaaatgggcggtttaattaaagactatcaaaaaggtgccttaaaagtcgaagaatttatcactcacaggagaccattcaaagaaatcaatcaagcctttgaagatttgcataacggtgattgcttaagaaccgtcttgaagtctgatgaaataaaataggagtacttaattaaactaagtaagcatgactcaaattttctggaatactttgaaaatcaacgtcctacattctatcaaatatcatatatatgcgcacaat

SEQ ID NO: 584 - DNA, 1110 bp, Escherichia coli
atgaaatcacgtgctgccgttgcatttgctcccggtaaaccgctggaaatcgttgaaattgacgttgcaccaccgaaaaaaggtgaagtgctaattaaagtcacccataccggcgtttgccataccgacgcatttaccctctccggcgatgacccggaaggtgtattcccggtggttctcggtcacgaaggggccggcgttgtggttgaagtcggtgaaggcgtaaccagcgtcaaacctggcgaccatgtgatcccgctttacaccgcggagtgcggcgagtgtgagttctgtcgttctggcaaaactaacctctgtgttgcggttcgcgaaacccagggtaaaggcctgatgccagacggcaccacccgtttttcttacaacgggcagccgctttatcactacatggggtgctctacattcagtgaatacaccgtagtcgcggaagtgtctctggcaaaaattaatccagaagcaaaccatgaacacgtctgcctgctgggctgtggcgtgaccaccggtattggcgcggtacacaacacagctaaagtccagccaggtgattctgttgccgtgtttggtcttggcgcgattggtctggcagtggttcagggcgcgcgtcaggcgaaagcgggtcggattatcgctatcgataccaacccgaagaaattcgatctggcgcgtcgcttcggtgctaccgactgcattaacccgaatgactacgacaaaccgataaaagatgtcctgttggatatcaacaaatggggtatcgaccatacctttgaatgcatcggtaacgtcaacgtgatgcgtgcggcgctggaaagtgcgcaccgcggctggggtcagtcggtgatcatcggggtcgcggttgccggtcaggaaatctccacccgtccattccagttggtcactggtcgcgtatggaaaggttccgcgtttggcggcgtgaaaggtcgttcccagttaccgggcatggttgaagatgcgatgaaaggtgatatcgatctggaaccgtttgtcacgcataccatgagcctggatgaaattaatgacgccttcgacctgatgcatgaaggcaaatccattcgaaccgtaattcgttactga

SEQ ID NO: 585 - DNA, 1110 bp, Nostoc PCC7120
atggaagtgaaagcagcaatagcttacggcgcgggtaagccgttgacaattgaaaccgttcaactagaggggccaaaagctggggaagtattggttgaagttaaagccagtggcgtttgccataccgatgcttacaccctttcaggaaatgatcccgaaggtttgttccccgccattttaggacatgagggtgcgggggtagtagtagatgtgggcgctggtgttaccagtgtcaaaccaggggatcatgtgattcctctctacaccccagaatgtcgccaatgtgcctattgtttaagctttaagactaatctgtgtcaagctattcgtggtactcaaggacgtggtgtgatgcccgatgggactagtcgttttagtatcaatgggcagatgattcatcactatatgggtacatctacgtttgctaactacacagtgttaccggaaattgctgtagccaaaattcgagaagatgccccatttgacaaggtttgttacattgggtgcggtgtaacgacaggtattggtgcagtcatttatacagccaaggtggaagcaggggcaaatgtcgtcgtttttggcttggggggtattggtttaaacgtcatccaaggggcgcggatggtgggtgcgaatatgattgtcggcgtagatattaatcccagcaaacgcgccttggctgaaaaatttgggatgacacattttgttaatccccaagaagttgagggtgatttagttgcttatttggtggacttaacgaaaggcggcgctgattacagttttgaatgtattggtaacgtcaatgtgatgcgccaagccttagaatgctgtcataagggttggggtgtgagtgtaattattggtgtagctggtgcaggacaagaaattagtactcgtccctttcaattagtgactgggcgtgtgtggaaaggttctgcttttggtggcgctagagggcgtacagatgtgccgaaaattgttgattggtatatggatggaaagataaatattgatgatttaattactcatgtgatgccaattgaaaaaattaatgatgctatggatttgatgcacagaggtgaatcgattcgcagtgtggtgactttttaa

SEQ ID NO: 586 - DNA, 4027 bp, Oryza sativa
ctaataatttggaaatgcgatattccaatatccaaagtggacccggcccaattaacccaaccaaaacccacgcccactcctctccccttctcggcgtgctcttctccccctccctatcctctcctctcacctcgcaatcacatcctcttcccttctcttgtccatcgcatctaccaccgagcgtgcaaggagggggggtgaaaatggcttcctcgacccagggccaggtcatcacctgcaaaggtaacctcttggttcccctctcttagtatcgtggattcgtggtggtagatttgctagtgtgctagagttggatgtatggttgctgtttcttggagtgttcttggtttgatctggagtgggggatcccccggtgtggtggtggtgcagcggcggtggcatgggaggccaacaagccgatgacgatcgaggacgtgcaggtggcgccgccgcaggccggcgaggtccgtgtcaagatcctcttcaccgcgttctgccacaccgaccactacacctggagcggcaaggtttctctctctctgtcccaccgactcttactcgccgtgtttcttcgaaatctagatttctcgaactcgccatttacactggtagtagggtagtatactctttccaaccacgtatctggtgatggtagttggtgaccgcactggatggaacccgattcatttttttgtttaattagtggattagtatttaattgtcaagtaacatcgttatgttattgtttcaaggatttaggtgtttcttcagattattatgaatgggaagattaaacaattttgtactagaggactctgggtttcttctaggcttctagctagcgttgcatgagttcgtcctatatttttatttttccttgactgcaaaatgggtgtagattgatggcaatcatctgtaggaaatcaaaattactggcagaaacctggaagtgttgagtatttctacagtggtctctactggcaggcagtagaccatcagtattctcgtcagtagtagcatctaaaccgttgatttgagttctactagtataatacaatattctaccgccagtagattactgtaccttgtggcaaatgttggcaacattattatataccaaccaaacaggcccttatcaagtgatttacgtgtcatgcaggatcctgagggtctatttccttgcattcttggtcatgaagctgctgggtaagcatatagatgtgctaattacatatatgatcatgcacagctaagataattgagcatcgatatgtttcttctgtttatgtttatagaattgttgaaagtgttggggaaggagtaactgaggtgcagcctggggaccatgtcattccttgttaccaagcagaatgcagagaatgcaagttttgcaagagtggaaagaccaacctctgtggcaaagttcgtgctgccacaggggtcggtgtcatgatgaatgatcgcaagagccgtttctcaataaatggaaaacccatttatcatttcatgggaacatctacattcagccagtatactgttgtgcacgatgtcagtgtcgcaaagataaacccacaggcacctctagacaaagtttgcctgcttggctgcggtgtttctactggtaggttcttcattggaggccaaacttttattcaccaattatagttccttttgtacctactatcattttgtagctttacaaaccttacatgcagagctcgttgggttgtttgaatgcattgtgcttgattttttttaccatatttcataaatatggaaagcctcactatatctgtgtcaatgatacctccaaatttccaattcttacttttcttttggtacactggatacaatattacataccattgcctcgcacattcttgttattctcttctagataattatgatatattcgtatgtgtatctcacaaattactattgttaggcctcggagcagtatggaataccgcaaaggttgaagcaggttccatcgttgctatttttggacttggcacagttggacttgcagtaagtcaaaatatgtccatgcacatttaacatgttagtctggaaagagagctttgacatctaagattttcattttaggttgctgagggggcaaaatcagctggtgcttctcggattattggcatcgacattgatagcaaaaagtttgatgtcggtatgtttcataatttccatttttctgtttattgcaccttttggttggtagagtaaagggcatattccactctcttaagtatatctggtgaaagcaggcaatccatgtctggtggtgcaacttgctaatagacctttctctcttgaatcgaacctgaaagtgcaaatctacgtattgtttgattatcaacaaatactagaataaattccaaaggcttactatccctttatagtaattcgtttttgacttgcaaaggcagtgatgcaccatcaacaattcctgaatttgccaccattgtatttgtctgagttgtgataggaaagattttgatctgtgatccattgttaacttgttattaccatttatcttcttttgcttgcatgcaccttgctcttattaatcatcacattgcttttcggcatcaggtccagagatcaaacttattattatttgtttatttccgcccatatgcaccacaaatgtgttcttacaaattggatgctttgtatgtgttattgaatgataaagaatgtattacattgcatgagttatttcataaaaattgtctgcaaatcaaacatagcttattttccaactctttttctgctgttattgtttgcagcaaagaactttggggttacagaatttgtgaacccaaaggaccatgacaaaccaatccaacaggtcatagttgaccttacagacggtggtgtggactacagctttgaatgcattggaaatgtttctgttatgaggtctgcattggagtgctgccacaaggtaagctacggctgcagcttttattcggacatctttgtgaattttggtcgcctggtacaaattaatgacaaacttcaaaagaattaataaattgagttgaatcatttggtgcggtaatgtctatttctaatgaattaatgacatttgatctgaatcatatcttaaatgtgttgcactgtcatttggataaactgcttttatttgaaatacagcgtatctgtttttatatttccatttatagatcaatcatactgttttccacccatcacaaagtaaaatattttcgctttcaactgttaaatttctgcgggtattactgtagggctggggaacctctgtcatcgttggtgtagctgcttctgggcaagaaatctctacacgaccattccagctcgtcactggccgtgtctggaagggaacagctttcggcggcttcaagagccgaagccaagttccatggctcgttgagaagtacttgaacaaggtaacaaatcatcacagtctaaactctaaacctgcagaagtttcgtcaatctgtagtgattcatctgaccagaattctcatgtaatccgcacaggaaatcaaggtggacgagtacgttactcacagcatgaacctgactgacatcaacaaggcgtttgacctgctgcatgaaggtggctgcctgcggtgtgttctggcaactgataaatgaaccgatgatggttcatctgcttttggctgtgcttctgagctgtgtcacgccaaattgtaatccagatctaccagccttggaaattgaattattctgctcgtttcgcttagaagcactttgaactgtgacaccactctgctataataatatatgtgctgtttggatctttggggatgattgctgttagaacattgccgtgattttgttgaataagcgcctctttgtcatgttttctacagtagaagttctgcactattaccattagacctactcccaccgtcatatttttgtacacaacagtttttcgtttatgcttatacttatcagctacaatttaaatttcaaccttaaatttaaaatttgtgcctat

SEQ ID NO: 587 - DNA, 1446 bp, Zea mays
ggccggggacctcacagccacatctctccactgctccgtccagcgcgtccacctcccaaacccctactcccccaggaagcaatggcttcccccacccagggccaggtcatcacctgcaaagcggcggtggcgtacgagccgaacaagccactcgtgatcgaggacgtgcaggtggcgccgccgcaggccggcgaggtccgcgtcaagatcctcttcaccgcgctctgccacaccgaccactacacctggagcggcaaggatcctgagggtctttttccttgcattcttggccacgaagctgctggaattgtggaaagtgtcggtgaaggagtaactgatgtgcagcctggggatcatgtcattccttgctaccaagcagaatgcaaagaatgcaagttttgcaagagcggaaagaccaacctctgtggtaaggtccgtagtgccacaggcgtaggtgtcatgatgaatgatatgaagagcaggttctctgtaaatggaaagcccatttaccatttcatggggacatcgacattcagccagtacactgtggtgcatgatgtcagtgttgcaaagatcaacccacaggcacccttagataaagtctgcctgctcggttgtggtgttcctactggtcttggagcggtgtggaatactgcaaaggttgaatctggctcagttgttgctgtttttggccttggaacagttggacttgcagttgctgagggagcaaaagctgctggtgcttctcgagttattggcattgacatcgacaataaaaagtttgatgttgcaaagaactttggagttacagaatttgttaacccaaaagagcatgacaaaccgatacagcaggtcctggtcgatcttacagatggcggcgtggattacagctttgagtgcattggaaatgtttcgattatgagggctgcactggaatgctccgacaagggctggggaacctccgtcatcgtcggagttgccgcctctggccaggagatctccacacgaccattccagctcgtgactggtcgtgtctggaagggaaccgcttttggtggcttcaagagccggacccaggtcccatggcttgttgacaagtacatgaagaaggaaattaaggtggacgagtacattacgcacaacatgaacctggctgacatcaacgacgccttccacctgctgcacgaaggtggctgtctgcgttgtgtgctggcgatgcagatctgaaattcctaagctaagcagtttttggatgtgtcggcatagactgtcttttgttttggaactagaattcctttttgcctcgttaggcctggacccactgtataatgctatgttgctttggatggctgacgatggttaccgctgtgttgctagccatgtggtacttgatctgtatcacggttgcaaataagtgctgtttctaaaacactccctcggtgaata

SEQ ID NO: 588 - DNA, 1383 bp, Zea mays
gttctcctcctctcactgctgctgtgaccatcaaggtatcacactgaacccgcagctgcacccactcacccacccaatccgcgaagcactaatacaaagcttacgccatgtccgacactgcaggaaagaccatcacttgcaaagccgccgtagcatgggaggccggcaaggacctcgtggtcgaggacatcgaggttctgcctccacgagctcatgaagtccgcatacaagtctactacactggtgtgtgccacacagatgcgtacatgctgagcggaaaggaccccgagggtgctttcccagtcattgcaggacatgagggcgctggtatcgtcgagagcgtcggcgagggtgtcaccaacgtgaaggttggcgacactgtcgttgccctatacacgccagaatgcaaagagtgcaaattctgcaagtctggcaagaccaacctctgcggcaagattcgcgcaactcaaggaaagggtgtcatgcctgacggcacttcacgcttcaagtgcaagggcaaggacctcctccacttcatgggctgctccaccttctcgcaatacaccgtgctcgctgacatctccgtcgttgctgtgacgccagatgcgccaatggacaggacatgcttgttgggctgcggtatcacaaccggctacggtgcagctgttatcacagcaggacgcggaggtgtagagaagggttccaacgttgcaatcttcggtgctggatgtgttggtctctccgtcatccagggtgccgtaaagcagggcgcctctaagatcattgtcgtcgatgtcaacgatgcgaagaaggaatgggcaaagaagttcggtgctactgacttcgtgaacccagccaaggatctcaaggagggcgagaacattcagagcagactcatcgacatgaccgatggtggatgcgactacacattcgactgcacaggaaacgttcacgtcatgagatcagcgctcgaggcttgccacaagggctggggtgagagcattatcatcggtgtcgctgctgccggacaggagatttccacaagaccattccaactcgtcactggccgtgtgtggaaaggatgcgctttcggtggtgtcaagggccgcagccaaatgggtcaactcgtgcaagattacatggacaacaagctcaaggtcgacgaattcatcacacaccgacagccactcggcggcatcaacgaggctttccacgacatgcacgccggagactgcattcgctgcgtcgtggacatgcgcaaggtttaaacaatgttagatttgggaaatgaaaaacaacttgtgaatagtgaagttagcgttgctgcaaccaaattgtgaagctataggtgtaaaaaaggaacgttcacattcataaaaaaaa

SEQ ID NO: 589 - DNA, 1390 bp, Zea mays
tgtaaagagtgcgaagaagcagtagcaaaaggattccattctcgtgttcttggagtggtccatcgatcgagctccgtgagagagatagcaagcaatggcgacagcagggaaggtgatcaagtgcagagccgccgtggcgtgggaggccggcaagccgctgtccatcgaggaggtggaggtggcgccgccgcaggccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttccacttcgtcgggacgtccaccttcagcgagtacaccgtcatccatgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggccttgctgctatggaaggtgctagactggctggtgcatcaaggatcatcggcgtggacatcaacccagcaaaatacgagcaagctaagaaatttggctgcactgaattcgttaaccccaaggaccacgacaagccagtgcaagaggtgctgattgagctgaccaacggcggcgtcgaccgcagcgtggagtgcaccggtaacgtcaacgccatgatatccgccttcgaatgtgtccacgacggctggggtgtcgccgtgctggtgggtgtcccgcacaaggacgaccagttcaagacccaccccatgaacttcctcagtgagaagacactcaagggcaccttcttcggaaactacaagccccgcaccgacctgcccaacgtcgtcgagatgtacatgaagaaggagctggagctggagaagttcatcacgcacagcgtgcccttctcggagatcaacacggcgttcgacctgatgctcaagggggagagcctgcgctgcatcatgaggatggaggattagagcttcattgcaagcttgctcctcctgcagggcaggcatgtcgcacagcaaatgggcatgaaaagttgaaggcgctccagtcctccagcttgtgtagtacacagtagcaataaaacgttagtgtttgtcctgtgcccaaaaaaaaaaaaaaaaaaa

SEQ ID NO: 590 - DNA, 1475 bp, Glycine max
taaattcctcgtggaatattgaagaagccatgtctacagctgggcaggtcatcaagtgcagagctgcggtggcatgggaagcagggaagccactgtcaatagaaaccatagaagtggcaccaccccagaaaggtgaagtgcgtttgaggatcctcttcaactccctttgccgtagtgatgtttattggtgggatgctaaggaccagactcctctgtttcctcgtatcttaggccacgaagcttcagggattgtggagagcgtgggcgagggtgtgacacatctgaaaccaggtgaccatgcactcccaatattcactggggagtgtggtgaatgcacttattgtaagtctgaagagagcaacctgtgtgagctactcaggatcaacactgacaggggtgttatgctgagtgatggaaaaacaaggttctccaaaaatggccaacccatttaccacttcgttggaacctccactttcagtgaatacactgttctccatgaaggatgtgtagccaagattaaccctaatgccccacttgacaaagttgctattgtcagctgtggattctgcacaggttttggggctactgtgaatgttgcaaaaccaaagcctaataatactgttgctgtctttggcttaggagctgttggtcttgctgcctgtgaaggggcaagggtttctggtgcatctagaatcatcggggttgatttacttcccaatcgatttgaacaagccaaaaaatttggggtcactgattttgtaaacccgaaagatcacaacaaaccagtccaagaggtcattgctgaaatgactaatggaggagtagatcgtgctattgaatgcactggaagcatccaagcttcaatctcagcatttgaatgcactcatgatggttggggtactgctgtccttgttggtgtgccaaagaaggatgttgaattcaaaactaatcctatgaagttcatggaagggagaactcttaagggtaccttctatggtcactacagaccccgcactgacattcctggtgttgtggagaagtacctcaacaaggagttggaactagacaaatttatcactcactctgtgccattctcaaagatcaacactgcatttgatcttatgctgaaaggggagggcataaggtgcctcatctgcatggaagagtaaatcaatgatgaatgatgttccctgctgtgagaacaatgtttctgtgttatgtgaaaagagaattgaataaatttggcatgcaattcggttgttggattcatgctatatgagtgtgtaaagaggtaacggggggtgatgactttcttggtcattgtcgtggctttgtgacttctattgcaaatgttgtcttgtaactttgttgtattttcggcaatatatctatatgatatctatctttctatcttttttttgtgaaaaaaaaaaaaaaaaaaaaaaaaaaaaaaaaaaaaaaaaaaaaaaaaaaaa

SEQ ID NO: 591 - DNA, 1113 bp, Oryza sativa
atgtcgtcggcgacggacggcgcggcgtcgaggctcggcgtcgccggggctctggggatgtcggtcacgtcgtcggtggctattgtcatctgcaataagtaccttatcagcaccctgggcttcttcttcgcgacgacgctgacgagctggcacctgatggtgaccttctgcacgctgtacgtcgcgcagcggctgcggttcttcgaggcgaagccgatcgatgcgcagaccgtcatctccttcgggctgctcaatggtatctccattggcctcctcaacctttgccttggattcaactcagttggcttctaccagatgaccaagctggctatcataccattcaccatgctcttggaaaccatctttcttagcaagaagttcagccggagcatcaagatctccctcatggtcttgctccttggagtcggtatcgcgtcggtgaccgatctccagctcaatctcctcggctcgatcatcgccgtgctcaccatcgccgcgacgtgcgtcagccagattctgacgaaccaaatccagaggaggctgaaggtgtcgtcgacgcagctgctgtaccagtcgtcgccgtaccagtccgccgtgctgctcgtcaccggcccgttcgtcgacaagctcctcaccaaccgcgacgtcttcgccttcacctacaccttccaagtcgtggcgttcatcgtgctgtcctgctcgatcgcggtgtgcgtgaacttcagcacgttcctggtgatcgggacgacgtcgccggtgacgtaccaggtgctggggcacctcaagacgtgcctcatcctctccttcggctacgtcctcctcagggaccccttcaccttccgcaacgtcgccggcatcctcgtcgccatcttcgggatgggcctctactccttcttctccgtctccgagtcccgcgacaagaagctcgccgacggcccctcccctcctctccccatctcttcctcccagatggcggagatgaaggactcggagccgctgctgggcggcggcggcggcgcggcggcgaagagctcgccgtggaacgaggtgaaggggttgcagagcttcgacgaggtgccgaggacggcgaagagcgcgttcagccggccgtga

SEQ ID NO: 592 - DNA, 1071 bp, Oryza sativa
atgggggtgacaggggagaagttccagctggggacggtgggggcgctcagcctctcggtggtgtcctcggtctccattgtcatctgcaacaaggccctcatgagctccctcggcttcaacttcgccactactttgacaagctggcatctcctcgttacattttgctctcttcacgtggcattatgtatgaagctctttgagcacaaaccttttgatgcaaggactgtcatgggatttggtgtgctcaatggcatttcaattggtcttctcaacttgagtctaggtttcaattctgttggtttctaccagatgacaaagctggcaattatcccctgcactgttatacttgagactcttttcttcaggaagaagtttagtcggaatatccagctctcccttagtgttctcctttttggtgttggagttgcaactgtgactgacctgcagcttaatgctgtgggatctgtcctgtctttgctcgcaatcattacaacctgcattgctcaaatcatgacaaacacaattcagaagaaattcaaggtatcttcaacacagctgctgtaccaatcatgcccataccaagcattgaccttgttcatcgtcggccctttccttgatgggtttttgactaaccaaaatgtctttgcttttgattacacatctcaagttgtgtttttcattgtgctgtcatgcttgatatcagtctcagtgaacttcagcacttttcttgtgatcgggaaaacctctcctgtaacttaccaagtgcttggccatctcaagacatgcttggttcttgcctttggttatgttttgcttcacgatccatttagctggagaaatatacttggaatcctcattgctgtgattgggatggtatcgtactcatacttctgcacaaaagaggctccaccaaaacccactgaagcctccccacaactcaaccaggtaaaagaaagcgaatcggaccccttgatctcggactctttgagcactgctgaaaatgggggcaacgcaggcgacgacgaggctctgaaggtacctatgtggagctccaagtactcaaaggcatga

SEQ ID NO: 593 - DNA, 1390 bp, Zea mays
gcgctagctgcggcacggaaccagcgccattagaggccacaagcccgcaccacgcctccctcgttctcgcgcgcgcgcacgcatgcacgaggagctgctgcagagaagaggaggcctgtcgatttgattgaactttccaaattcagattcagaagctggccaagatgactgccggtttccagctcggcgtgatcgggtctctcacgctctccgtcgcgtcgtcggttgccattgtcatctgcaacaaagccctcatcagcaccctaggctttccattcgctacgactctgacaagctggcacctgatggtgaccttctgcaccctccacgtggcgcagcgcctgcgctttttcgagcccaaggcgatcgacgggcagacggtagttctgtttggcttgctcaacgggacctcgattggccttctgaaccttagtttagggttcaactccatcggattctaccagatgacgaagttggccataatacccttcacggtgctgttggagactatattcctgaagaaaagattcagtgagacgatcaagttttctctgctggtcttgctgctcggagttggcatcgcctcagttacggacctcaagttaaactgcctcgggtccgttctttccggcctcgccatcgccaccacttgtgtcggccaaattctcacgaatacgatacagaggaagctgaaggtctcgtcaacgcagctcctgtaccagtcagcgccttaccaagcagccattctgttcgccactggccccttcgtggaccatctcctcaccggccgcagcgtcttcgcccatagatacactttcccggttgtgggcttcatcgtcctgtcgtgcttgatcgcggtgtcggtgaacttcagcacgttcctggtgatcgggacgacgtcgccggtgacgtaccaggtgctgggccacctcaagacgtgcctggtgctgtcgttcgggtacacgctgctgcacgatcctttcaccgtgcggaacatcctgggcatcctcgtcgccatcttcgggatggcgctctactccatcttctcggtgcgtgagggcaagaagaagtccgcaggcgacgccctcccggtgtcacagatgcctgacaaggagacggagccgctgttggcgaccaaggacaacagcgacaccaaaaaggcgaacggggttgctcacgactgctaagatgttcccgtttgccgttgcttatagcctaattagtccagctctagtgttactacgacgcactgttctgaatctcagaaagtcagggaagaagtcattcctttttgtttcttataatattgtatatgtaatattcctctattgcgaattataagccgtttcaatttttttgaaaaaaaaaaaaaaaaaaaaaaaaaaaaaaa

SEQ ID NO: 594 - DNA, 1860 bp, Oryza sativa
acatgtcggccaccacgtccaattcccggcggctatgcaacggccggggacaggtcatacctgggcccaccttaccagaggctgtcaagatgggcccacacgccattcggattgtagtcggagggctcggagaaggcgagctctcgaccgccactactgtacacggcccagagcgagcctcctcctcctctgcaccaccggagatggcttccgccgcgctgccggaggccgtcgcgccgaagaagaagggcaacgtccggttcgccttcgcctgcgccatcctcgcctccatgacctccatcctcctcggctacgatatcggggtgatgagcggggcgtcgctgtacatcaagaaggacttcaacatcagtgacgggaaggtggaggttctcatgggcatactgaacctctactcgctcatcggctccttcgcggcggggcggacgtcggactggatcggccggcggtacaccatcgtgttcgccgccgtcatattcttcgcgggggcgttcctcatggggttcgccgtcaactacgccatgctcatgttcggccgcttcgtggccggcatcggcgtgggctacgcgctcatgatcgcgccggtgtacaccgccgaggtgtcgccggcgtcggcgcgtggcttcctgacgtcgttcccggaggtgttcatcaacttcggcatcctgctcgggtacgtctcgaactatgctttctcccgcttgccgctgaacctcgggtggcgcatcatgctcggcatcggcgcggcgccgtccgtgctgctcgcgctcatggtgctcggcatgccggagtcgccgcggtggctggtcatgaagggacgcctcgcggacgccaaggtggtgctggagaagacctccgacacggcggaggaggccgcggagcgcctggccgacatcaaggccgccgccggcatccccgaggagctcgacggcgacgtggtgaccgtccccaagagagggagcggaaacgagaagcgggtgtggaaggagctcatcctgtccccgaccccggccatgcggcgcatcctgctgtcgggcatcggcatccacttcttccagcaggcgtcgggcatcgactccgtcgtgctctacagcccgcgcgtgttcaagagcgccggcatcaccgacgacaaacacctcctcggcaccacctgcgccgtcggtgtcaccaagacgctcttcatcctcgtggcgaccttcttcctcgaccgcgtcgggcggcggccgctgctgctgagcagcacgggcgggatgatcctctccctcatcggcctcggcgccgggctcaccgtcgtcggccagcaccccgacgccaagataccttgggccatcggcctaagcatcgcctccaccctcgcctacgtcgccttcttctccatcggccttggccccatcacgtgggtgtacagctcggagatcttcccgctccaggtgcgcgcgctgggctgctcgctcggcgtcgccgccaaccgcgtcaccagcggcgtcatctccatgaccttcctgtcgctgtccaaggccatcaccatcggcggcagcttcttcctctactccggcatcgccgcgctcgcctgggtgttcttctacacctacctcccggagacccgcggccggacgctggaggagatgagcaagctgttcggcgacacggccgccgcctcggaatcagacgagccagccaaggagaagaagaaggtggaaatggccgccactaactgatcaaactaaccgcaaaatcaccaaatcctaagggttttcttgcaaaaacgtgtgctgtactggctagctagcaagtagtagcagcaacgtgggaagattcgctgatccggcgttgctggagagc

SEQ ID NO: 595 - DNA, 1829 bp, Glycine max
gaaacagagactgagagaaacaaaactgattgcgtggctctatagtggttttgttcttatttccacaaattgtcatttcttccttttaacaagttcgtaaaagaaactcactcacctacacatacagacagaccccatcaataatctgaacataaagtttcgttttttgtgaagattttggaggaagagggtggtggttgagtttaattcaaggtcttgcaatggcacccagttttgactttgcttctagcctcctttgcacagaggacagcaccgttttcgacgagagtcataataatgggggtacgatgatgacggcgatgggggtgtacgaggacacgaggagtcctaggaggcgccactttgacgaagaaccagatgagttgccattgctaagtgatgagagcttggtgatgatggtggaaaaagagtgccaacactggtctggtctgcgttacttgaataagtttcaaactggggatttggacttcggtgccagaatggaggccattgattggattcacaaggtccgatcgcattttggatttggtcctctctgtggatatctatctataaattacttggaccgattcctctttgcatatgaattaccgaagggaagagtttggacaatgcaattgttggctgtggcgtgtttatctctagcagccaaattagatgagacagaagttccactctctcttgatttgcaggtgggtgaatcgaagtttttatttgaggctaaaaccatacagagaatggagcttcttgtactaagcacattgaagtggagaatgcaagcaattactcctttcaccttccttgattactttctttgtaagatcaacgatgatcaaagtccattaaggtcttcaattatgcgatccatccaacttatatcgagcactgcaagagggattgacttcttggaatttaaaccatcagagattgcagcagcagtggctatgtatgtcatgggggaaacccaaacagttgacactgggaaagcaatttctgttctgattcaacacgtagaaaaggagagactattgaagtgtgttcaaatgatccaagagttatcatgcaacagtggctctgccaaggattcaagtgcttctgtcacttgcttaccccagagcccaattggtgtgttggatgctttgtgcttcaactacaaaagtgatgacacaaatgctagttcatgtgttaattcttcacacaatagtcctgttgccaaaaggaggaagttaaacaaaacctgtggagctgagcaattgtagtgatgttggagtgggaattttacaatcatccataggatgcttttccaaaaaaatgggcatcatgtgtgttttatggaaggtgctcccctcaaagcaataccaaaatgaggcaggaagacatagctagaaatcttttatttttttaatttctcaaaaagaaaaaagaaaaaaagaccttagtgtaaaaaatacaaaaaactatattaaggtgaggtggatcatgagtggaagatgggtgatcaagcgaacagtgcaatacattgcattctattggcatgaagtgagtaatcaccagctgttaaatattttagatctattaacagcagctagagaacaaaggatctgaagaagagggataaggattattagagtattgtatgtgtaggtaaagttgggggggagtttttcatttgttcaattttttacttttaaaatgggagagagaaaaatagactgaagaaaaaaaagagatagctatatatatgcgggaaatattttatttatgttattatttttattctgttagttatttttacttaatcagatttt

SEQ ID NO: 596 - DNA, 1063 bp, Oryza sativa
cgcaaccgagtcgagactagacaaggggagcagccgccgcgatccaagtcctcctccgccgccgccgacgccgccatggatccgaagctggtggaggtgacgcagctcttctcccgcttcaaggcagccttcgccaggaacgacttcgacacctgcgtagacctgctgtcgcagctcaaggtccgcctcaccaagttccccagccttcctccatcatttcagcagacaccgaatgcagtggaagagctgaaaattgcgagggacatctatgagcatgcagttgttctgagtgtgaaaattgaagaccaagatgcatttgaaagggacttttgtcaactcaaaccttattacatggatacatgcggcataattccaccatcaccacaggagtatccaatcttgggtcttaatcttctaaggctgttagttcagaacagaattgcagagttccacactgagctggaacttctgccggtcacagcacttgaaaatccttgcatcaagcatgcggtggagcttgagcagtcatttatggagggtgcttacaaccgagtgttgagcgctcgccaggctgtgccccacgaaacatatgtgtacttcatggatcttcttgccaaaacagtcagagatgaactggctggttgcagtgagaagggttatgattatatgtcaatagctgaagcaagacaagtgctgatgttcagctctgacaaagaattgcaccagtacatcgcagaggagcaccctgaatgggaggtaaaggatggttccgtcttcttccagaaggcgaaggagacccagccctgcaaggagataccatctttgcaggttatcaaccaaacgctcagctatgctagagagctggagcggattgtatgatttgttaatgaatatcatttgagatcatttgggacggcatgttcatgctatgtacacatcaggtgtcacggttgagatgcgcatgttgcagctttgaacgtttgagatgcccatgttaccttatgatactttttttaaaaatttcatttaatgggcaaaaaaaaaaaaaaaaaaaaaaaaaaaa

SEQ ID NO: 597 - DNA, 1025 bp, Saccharomyces cerevisiae
ttatttgccacccattgaaattgtagcttgtattaatagggaaaagccggaagtataaccggtggaaagtactattgaagtgagataagaagccatcgtaatgccctcgttagccgaattgaccaagtcgttaagcatagcctttgaaaacggcgattatgccgcgtgtgagaagctcttgccccctatcaagatcgaacttatcaagaataaccttttaatacctgacttatccattcaaaatgacatctatttgaatgatttgatgattactaaaaggatcctggaagtaggtgcccttgctagcatccaaactttcaattttgacagcttcgagaattacttcaaccaattgaagccttactactttagcaacaatcataaattatctgaatctgacaagaaatcgaagctgataagtctgtatttgttgaacttattgtctcagaataacacaaccaagtttcactcggaattgcagtatctagataaacatatcaagaacttggaagacgattcacttttgtcttaccctatcaaactagacagatggctcatggaagggtcgtaccagaaagcatgggatcttctgcaatctgggtcgcagaatatatcagaattcgactcttttaccgatatcctaaaatcagctataagagacgaaattgctaaaaataccgagctatcctacgactttctccctctctccaacataaaggctttgctctttttcaacaacgaaaaagaaactgaaaaatttgcactagagagaaactggcctattgtcaactcgaaagtttacttcaataaccaatcaaaggagaaagctgattacgaagatgaaatgatgcatgaagaagaccaaaagacaaacattatcgaaaaagcaatggattatgccataagtattgaaaatattgtgtaatatttgtatatataatatgtgcacaaaattactacaaaataaacaactttttctctcccggagaacaaagtaagtggaaaaaattatactaataacaatc

SEQ ID NO: 598 - DNA, 1199 bp, Zea mays
cgttcccaccgcaagcaaagcattttcagccgccccaccgcagcagcagagaagaggccgccgccgccgcgaccaagagccgatggatccgaagatgacagaggtgacccagatgttcgcccgcttcaaggcggcctacacccgcaacgacctcgacgcctgcgtcaccctcctctcacagctcaaggtccatctcaccaaattccccagccttccgccctcatttgagcagacacctaaagccgtggaggagctcaaacttgcaagggacatttatgagcatgctgttgttttgagtgtgaaacttgaggaccaagatgcatttgaacgtgatttctgtcagctaaagccttattacatggatacatgtggcataattcccccctcaccagaggagtacccaattttgggactcaatcttctgaggctgttggttcagaatagaattgctgagttccatactgagctggagcttttacctgtcaaggcacttgagcacccttgcatcaagcatgctgtagagcttgagcaatccttcatggagggtgcctacaaccgagtgttaagcgctcggcaagctgtgccacatgagacctatgtttacttcatggaccttctcgccaagacagttagagatgagatcgctgggtgcagcgaaaaggggtatgattccctatctgtaagtgatgcaaaacaaatgcttatgttcagttctgaccaagatctgcacgagtacatcacagaggagcacccggaatgggagcttaagaacggtgccgtcttcttccagaaggcaaaggagtcacagccctacaaggagatcccatccttgcagctcatcaaccagacgctcagctatgcgagggagctggagcgtattgtatgatttaatttcacagtaatccctggttgatgtttatttctgtggtcacttggcatggcatgtactgtcctttacatttgagatcagctctgatcgcagctcatgtcagctctgatcaatctctgaagggcttgatctctgcggcattgtttcaccacattaactgcattgcttgaaagatgcctgtcatccattgctgctgttaacttttgatgggcttaatattgaattattacatcgaaaaaaaaaaaaaaaaaaaaaaaaaaaaaaaaaaaaaaaaaaaaaaaaaaaaaaaaaaaaaaaaaaaaaaaaaaaa

SEQ ID NO: 599 - DNA, 1142 bp, Glycine max
ccacgcgtccgatcgctgtggtttttctttttctctgttgaggttgtcattgggagcactcaacctaaactattcaagttgtgaaagcacatcacaagaaaattcgcaagcgatggatccgaagctaaaagaggtttctcagctcttcgatcgctttaaggcttcgtttatcaggaacgactttgatacctgttccaatctcctttctcagctaaaggtgttacttacaggtttcagaagccttccaccgttgtttgcagatacacctaatgcagttcatgaattaacaatagcaagggatatatacgagcatgctgttgtccttagtgtgaaaaatgaggatcaagatgcttttgaaagggatttcttccagttgaagccttattatacagatgcctgcaatcgacttccaccatctcctcaggagtacccaattctgggtctcaacctgttgagattacttgtgcagaataggattgctgaattccatactgagttggaattgctttcatctgctgctcttgagaatccttgcattaagcatgctgtggagttggaacaatcttttatggaaggggcttacaatcgtgtcttgagtgcacgacagacagtgccacatgatacatacgtttattttatggatcttttggcaaagactgtcagagatgaaatagctggttgcagtgagaaggcctatgactatctttcaattaaggatgctaagcaaatgttgctgttctcctctgaccaggaactccttgaatatattaaagaggagcatcctgagtgggagattaagaatggtagtgtctttttccaaaaggcaaaagaatctgcaccttgcaaagaaataccctctctgcagctcatcaaccagacgcttagttatgctagggagttggagaggattgtctgagaagaaatgcaatggcggcttctgttcccaaaatttctaggtgtctggataatagttgctaatactgtcttttgaaattgttcatttctgattcaatgtgaaactataaaattgttcacctctgtattttgatcatttaggtggcagtatggttactttttttttttaacttgtgctctgggttttccaaaaaaaaaaaaaaaaaaaaaaaaaaaaaaaaaaaaag

SEQ ID NO: 600 - DNA, 1491 bp, Sorghum bicolor
cccacgcgtccggaaacccccaaatccgctcccttcccctatccacctcgactcccttccttccatagcagcggcagcggcggcggcggcgaagggcggcggagccatgggcggagccggcggcggcggcgaggcgaagcggtcggagatctacacctacgaggccgcctggcacatctacgcgatgaactggagcgtgcgccgcgataagaagtaccggctcgccatcgccagccttctcgagcaggtcaccaaccgcgtcgaggtcgtccagctcgacgaggcctcgggcgacatcgcccccgtcctcaccttcgaccaccagtacccgcccaccaagaccatgttcatgccggacccgcacgcgctccgccccgacctgctcgccacctccgccgaccacctgcgcatctggcgcatcccgtcccccgacgacgccgacgacggcgccgcctctgccaacaacaacaacggctccgtccgctgcaacggcaccccgcagccgggcatcgagctgcgctgcgagctcaacggtaaccgcaacagcgactactgcggcccgctcacctccttcgactggaacgacgccgacccgcgccgcatcggtacctcctccatcgacaccacctgcaccatctgggacgtcgagcgcgaggccgtcgacacccagctcatcgcccacgacaaggaggtctacgacatcgcctggggcggcgcgggggtctttgcctccgtctccgccgacggctctgtccgcgtctttgacctacgggacaaggagcactccacaatcatttatgagtctggttcaggtggcggcggcggcggttccaactcgggcgccggggatggtgggactgcgtccccgacaccactcgtgaggttgggctggaacaagcaggacccaaggtacatggccaccatcatcatggacagccccaaggtggttgtgcttgatatccgctacccaacactgccagtggtagagctacatcgtcaccatgcccctgtcaatgccatagcgtgggcgcctcactcttcttgccacatctgcacagctggggatgacatgcaggcactgatatgggatttgtcatctatgggaactggtagcaatggtagtggcaatgggaatggtaacgcagctgcggcagcagcagctgagggcggtcttgatcccattttggcatatacagcaggggcagagattgagcagttgcagtggtcggcaacccagcctgactgggttgcaattgcatttgccaataagcttcagattctcagggtctgatttcctaattctgccctgtttcactgaggagtaaaaagaatgccaaacttggataatgaggttaggccatgggaggataatcttttgtgcttgctttagttgcttatttatgttgtggacaactgatattcgtggtgggtcatttctagttatagaacagaagacttgctaaaaaaaaaaaaaaaaaaaaaaaaaaaaaa

SEQ ID NO: 601 - DNA, 1661 bp, Zea mays
tgacggccttcactgcacactacaatcaatcagccggcttttcctctcttcccctcgacagaagcccccaaatccgataccttcccctatccacctcgagtcccttccttccttagcggcggcgcgaaggcggcggagccatgggcggagtcggcgaaggtgacgcgtgggcggatcaggagcagggcaacggcgggggcagccgtggtgttggcggtggcggcggcgaggcgaagcggtcggagatctacacgtacgaggccgcctggcacatctacgcgatgaactggagcgtgcggcgcgataagaaataccgccttgccatcgccagccttctcgagcaggtcaccaaccgcgtcgaggtcgtccagctcgatgaggcctcgggtgacatcgcccccgtcctcaccttcgaccatcagtacccgcccaccaagaccatgttcatgccggacccgcacgcgctccgccccgacctgctcgccacctccgccgaccacctgcgcatctggcgcatcccgtcctccgacgacgccgaggacggcgccgcctccgccaacaacaacaacggctccgtccgctgcaacggcacccagcagccgggcatcgagctacgctccgagctcaacggcaaccgcaacagcgactactgcgggccgctcacctccttcgactggaacgacgccgatccgcgccgcatcggtacctcctccatcgacaccacctgcacaatctgggacgtcgagcgcgaggccgttgacacccagctcatcgcccacgacaaggaggtctacgacatcgcctggggcggcgcgggggtctttgcctccgtctccgccgacggctctgttcgcgtctttgatttacgggacaaggagcactccacaatcatttatgagtctggttcaggtggcagcagcggcggcggttccaactctggcgccggagatggtgggactgcgtccccgacaccactcgtgaggttgggctggaacaagcaggacccaaggtacatggccaccatcatcatggacagccccaaggtggttgtgcttgatatccgctacccaacactgccagtggtagagctacaccgtcaccatgcccctgtcaatgccattgcgtgggcacctcactcttcttgccacatctgcacagctggggatgacatgcaggcactgatatgggatttgtcgtctatgggaactggtagcaatggcagtggcaatgggaatggtaacacagccgctggagcagcagcagagggcggtcttgatcccattttggcatatacagcaggggcagagattgagcagttgcagtggtcggcgacccagcctgactgggttgcaatcgcattcgccaataagcttcagattctcagggtctgatttcctagttccaccctgtttcagtgaggagtaaaaaatgctaaacttggataatgagctgatgcccggaggataatcttgcaattgctttactgttgcttatttatgttgtggacaactgatattcatggcgggttagttctagaaatagaacagaagactttctagttagaagctgaattgtcaatgaatttggtttgtagagtaaggaactgctctggtgttagcgatggtgataatgggaactgaatttagtttgttctaaaaata

SEQ ID NO: 602 - DNA, 3041 bp, Zea mays
gggcactgggcgggggaataaggaggaagagaaagaggaggaggagcggcagtagatttgggccgcacaggcagggatggggggcaagtaccgcgcggcgaggacgaagaggtggtggagggggctggcagcggccgggtgggtgctaaccgcggtggtctgctccgcggtgatgcactggaccctgcgccgggacagcatggaccgcgccgaggagcgcctcgtcagcatgtgcgaggagagggccaggatgctgcaggagcagttcggggtcaccgtcaaccacgtccacgccatcgccattctcatctccaccttcaacttcgagaagtcccctccagccatcgaccaggacacctttgcaaaatacacggcaaggacatcatttgagcgaccgctgctcaatggggtggcattcgcacagcgtgtattccatcatgagagggaaatgtttgaaagccagcagggatgggttatgaatacgatgcagcgggagcctgcacctccgcaggttgaatacgccccagtgattttctctcaggatacggtttcctaccttgcacgcattgacatgatgtctggggaggaggaccgagaaaacattttccgggccaggactactggcaaagctgtgttaacaaacccatttcggttgcttggatcaaaccacttgggagtagttctcacgtttgctgtgtaccgccctgatctccctgctgatgcatcagttgagcaacgtgtggaagcaactatcggatatctcggtggagcctttgatgtggagtcacttgtggagaatttgttgagcaaacttgctggcaatcaggatattgtggtaaatgtctatgatgtcacaaatgcttcagatgctatggttttgtatggaccttcaagtttggacgagcaagtgcctttcttgcatgttagcatgttggattttggagatccatttaggaagcatgaaatgagatgcaggtatagacaaaagcttcctatgccgtggtctgccataaccaatcctttgggcacatttgtcatatggatgcttcttgggtatagcattgctgctgcatattctcgatatgacaaagttactgaagattgcagaaagatggaagagctaaaaacgcaggcagaagctgctgatgttgcaaaatctcagttcctggcaactgcgtcacatgagatcagaacacctatgaatggcgtccttggaatgctggatatgcttttaggaacagatctaactatgacacagaaggattatgctcaaactgctcaaatgtgtggcagagcattgattacactgataaatgatgtccttgatcgagcaaagattgaggctggaaagttagagcttgaagcggtgccttttgacctgcgttctctcatggatgatgttgtttccttgttttcttcaaagtcacgggagaagtgcattgagcttgccgtatttgtatgtgacaatgttccgaaggttgttattggagatccttggaggtttcgacagatactgacaaatttggtcgggaatgcagtcaaattcacagaacgaggtcatgtatttgtgcgggtgtgtttggctgaaaactcaaatatggaagccaatcaggtcctacatggagccatgaatggcaaaggtggtagagttgagtcaacagctaatggtgccttcaatactttgagtgggtttgaagcagcagacagacgaaatagttggcaatattttaaactgctcctctctgataaggagtcgcttttggatgatcttgagagcgaaaactctaatcaaagtgattcagatcgtgtcacactagcaataagtattgaggacacaggtgtcgggataccactgcaagcacaagatcgtgtttttacaccgtttatgcaggctgacagttcaacttcaaggaattatggcggtactggcatcggtttaagcatcagcaagtgtctagctgaacttatgggtgggcagataagtttcaccagccatccttctgttggaagcacgttcactttctcagccacactgaagcactcacacaaagatatttcgggtgattcaagtaggagcttgacagaggcactaccaaccgcttttaagggaatgaaggccatcttggtagatgggagacctgtacgtagtgctgttacaagatatcacctcaagaggttgggaatacttcttcaagttgtgaacaatatgaacgcagtagtaaaagctttcccaggacaaaatggagcagccggttctagggaaaaggcatcaattctttttattgagagtgacttctggaggcctgagacagatgttcagttattgaaccatctacgtgagcagaagaacggtcagttgtctgatgggcacaaggtagttcttttggtcacctctgaagccgacaaggacaaatatggatccatatttgatattgtgatgtgtaagcctataagggcaagcacaattgcttcatctattcaacaactgctcaaagtagagatagccgaaagaaaagataatcaaaaccggccgtcgttccttcgaagcttgctggttgggaagaatatattggtcgtagacgataataaagtcaacctcagagttgctgcggctgcactcaagaagtatggtgctaatgttagctgtgttgaaagcggcaaggatgctatcagtctacttcaacccccgcatcgcttcgatgcatgttttatggatgttcagatgccagagatggacgggtttgaggcaaccggacaaataaggcaaatggagttgaaagcgaacgaggaaaggaagaacaagttggcttcgatcgaaggctcgacaactgccgagtaccatctgcctgttctggcaatgacagccgatgttatccaggcaacttacgaagagtgcataaaatcgggaatggatggatacgtatctaaacccttcgacgaggagcagctataccaagcagtctccagattggtagtgggaacgacagattcggctgtttgatgttcaaaatacgatggaccggacttctcattcatcaatc

SEQ ID NO: 603 - DNA, 3694 bp, Arabidopsis thaliana
  unsure (1)..(3694): unsure at all n locations
aaaaaatctcactaaaacaaaagaagaagaaagaagaaagaaaatggaatacctacatttttgaagtgatgagaagagattttgtgtataataataatgcaatgttcaatcctctcacaactcattacagctcagatatgaactgggcactcaacaatcatcaagaagaagaagaagagccacgaagaattgaaatttctgattccgagtcactagaaaacttgaaaagcagcgatttttatcaactgggtggtggtggtgctctgaattcgtcagaaaagccgagaaagatcgatttttggcgttcggggttgatgggttttgcgaagatgcagcagcagcaacagcttcagcattcagtggcggtgaagatgaacaataataataataacgatctaatgggtaataaaaaagggtcaactttcatacaagaacatcgagcattgttaccaaaagctttgattctgtggatcatcattgttgggtttataagcagtgggatttatcagtggatggatgatgctaataagattagaagggaagaggttttggtcagcatgtgtgatcaaagagctagaatgttgcaggatcaatttagtgttagtgttaatcatgttcatgctttggctattctcgtctccacttttcattaccacaagaacccttctgcaattgatcaggagacatttgcggagtacacggcaagaacagcatttgagagaccgttgctaagtggagtggcttatgctgaaaaagttgtgaattttgagagggagatgtttgagcggcagcacaattgggttataaagacaatggatagaggagagccttcaccggttagggatgagtatgctcctgttatattctctcaagatagtgtctcttaccttgagtcactcgatatgatgtcaggcgaggaggatcgtgagaatattttgcgagctagagaaaccggaaaagctgtcttgactagcccttttaggttgttggaaactcaccatctcggagttgtgttgacattccctgtctacaagtcttctcttcctgaaaatccgactgtcgaagagcgtattgcagccactgcagggtaccttggtggtgcgtttgatgtggagtctctagtcgagaatttacttggtcagcttgctggtaaccaagcaatagttgtgcatgtgtatgatatcaccaatgcatcagatccacttgtcatgtatggtaatcaagatgaagaagccgacagatctctctctcatgagagcaagctcgattttggagaccccttcaggaaacataagatgatatgcaggtaccaccaaaaggcaccaataccattgaatgtgctcacaactgtgccattgttctttgcgattggtttcttggtgggttatatactgtatggtgcagctatgcacatagtaaaagtcgaagatgatttccatgaaatgcaagagcttaaagtgcgagcagaagctgctgatgtcgctaaatcgcagtttcttgctaccgtgtctcacgagatcaggacaccaatgaatggcattctcggaatgcttgctatgctcctagatacagaactaagctcgacacagagagattacgctcaaaccgctcaagtatgtggtaaagctttgattgcattgataaatgaggttcttgatcgcgccaagattgaagctggaaagctggagttggaatcagtaccatttgatatccgttcaatattggatgatgtcctttctctattctctgaggagtcaaggaacaaaggcattgagctcgcggttttcgtttcagacaaagtaccagagatagtcaaaggagattcagggagatttagacagataatcataaaccttgttggaaattcggttaaattcacagagaaaggacatatctttgttaaagtccatcttgcggaacaatcaaaagatgaatctgaaccgaaaaatgcattgaatggtggagtgtctgaagaaatgatcgttgtttccaaacagtcaagttacaacacattgagcggttacgaagctgctgatggtcggaatagctgggattcattcaagcatttggtctctgaggagcagtcattatcggagtttgatatttctagcaatgttaggcttatggtttcaatcgaagacacgggtattggaatccctttagttgcacaaggccgtgtgtttatgccgtttatgcaagcagatagctcgacttcaagaaactatggaggtactggtattggtttgagtataagcaagtgtcttgttgaacttatgcgtggtcagataaatttcataagccggcctcatattggaagcacgttctggttcacggctgttttagagaaatgcgataaatgcagtgcgattaaccatatgaagaaacctaatgtggaacacttgccttctacttttaaaggaatgaaagctatagttgttgatgctaagcctgttagagctgctgtgactagataccatatgaaaagactcggaatcaatgttgatgtcgtgacaagtctcaaaaccgctgttgttgcagctgctgcgtttgaaagaaacggttctcctctcccaacaaaaccgcaacttgatatgatcttagtagagaaagattcatggatttcaactgaagataatgactcagagattcgtttattgaattcaagaaccaacggaaacgttcatcacaagtctccgaaactagctctattcgcaacaaacatcacaaattcggagttcgacagagctaaatccgcaggatttgcagatacggtaataatgaaaccgttaagagcaagcatgattggggcgtgtctgcaacaagttctcgagctgagaaaaacaagacaacaacatccagaaggatcatcacccgcaactctcaagagcttgcttacagggaagaagattcttgtggttgatgataatatagttaacaggagagtagctgcaggagctctcaagaaatttggagcagaagtggtttgtgcagagagtggtcaagttgctttgggtttgcttcagattccacacactttcgatgcttgcttcatggatattcaaatgccacagatggacggatttgaagcaactcgtcagataagaatgatggagaaggaagctaaagagaagacgaatctcgaatggcatttaccgattctagcgatgactgcggatgtgatacacgcgacctacgaggaatgtctgaaaagtgggatggatggttacgtctccaaaccttttgaagaagagaatctctataaatccgttgccaaatcattcaaacctaatcctatctcaccttcgtcgtaatccaatcttccggcgagtttttttctctccgcagccggaagaatggactgcttctgctgattgattgggataaatatgcattttggtttctgtacatatagtaggttcacaatctagagattttgaaggttttttttaatttctcacttaagtaatgtagcttgccatgactagtgtatgttgttaaacgacgacgtctaagatggttcagtgttgatcttagcgtaagtattaatcccatgggaatcggttgtactgtatcagatttggttagtcgtttaancattgtaatgttctaataatcactttttcatatatancctcatgttataacatgagacgagaccattttgattaaaaaaaaaaaaaaaaaaaaaaaaaaa

SEQ ID NO: 604 - DNA, 3531 bp, Arabidopsis thaliana
atgtctataacttgtgagctcttgaatcttacttcaaagaaagctaagaagtcgtcgagcagtgacaagaaatggctaaagaagcctctcttcttcctgattttgtgtggctctttggtaattgttttggttatgttcttacggttaggtagaagtcagaaggaggagacagattcttgtaatggagaagagaaagtgttgtatagacatcaaaatgtcacaagaagtgagattcatgatttggtctctttgttctctgattcagatcaggtaacatcctttgaatgtcataaggaatcaagccctggaatgtggacaaactatggtattacatgttccctgagtgtgcgttctgataaacaagagactagagggcttccctggaatcttggcttaggacattctatctcatcaacatcttgtatgtgtggtaatcttgaaccgattttacagcaacctgaaaaccttgaggaagaaaaccatgaagaagggctggagcagggtttgtcatcgtatttaagaaatgcatggtggtgtctaatccttggtgtgttagtgtgccataagatttatgtatctcattctaaagcacgaggtgagaggaaagagaaagtacatctgcaagaggctttagctccaaagaagcagcaacaacgtgctcagacttcttctagaggggctggaagatggaggaagaatatccttctccttggtattttaggaggagtttccttctctgtttggtggttttgggacactaatgaggagatcataatgaaaaggagggagactttggcaaacatgtgtgacgaacgagcacgtgttttacaagatcagttcaatgttagcttgaaccatgttcatgccttgtctattcttgtatctacatttcatcatggtaaaatcccatctgccattgatcagagaacatttgaagaatatactgagagaacaaactttgagaggccacttactagtggtgtagcgtatgctttgaaagtcccacactcagaaagagagaaatttgaaaaggagcatggatgggcaataaagaaaatggaaactgaggaccagacagttgtacaagattgtgttcctgaaaactttgatcccgcaccgattcaagacgaatacgcgccagttatatttgctcaagaaactgtttcccatattgtatcggtcgacatgatgtctggagaagaagaccgtgaaaacatcttacgggcaagggcatcaggaaaaggagtgttaacatctccatttaagcttcttaagtcaaatcatcttggtgttgtgttgacctttgctgtctatgacacgagcctaccgcctgatgctacagaagaacagcgtgttgaagcaactattgggtaccttggtgcatcatatgatatgccatcgctggtggagaaacttcttcaccaacttgccagcaaacagacaattgctgtggatgtttacgacacaactaacacttcaggtctaataaaaatgtatggctcagaaattggggatataagtgagcagcatataagtagccttgattttggtgatccatcaaggaaccatgagatgcattgcaggtttaagcataaacttcccattccctggacagcgataacaccgtcgatcttagttctggttattacttttcttgttggttatattttatatgaagccatcaaccgaattgcgacagttgaagaggattgtcagaagatgagggaactcaaagctcgtgctgaggccgctgacattgcaaagtcacagttcctagcaactgtttctcatgagatacggactccgatgaatggagttttaggaatgctgaaaatgctgatggacaccgatcttgatgcgaagcagatggactatgcgcaaactgctcatggcagtgggaaggatcttacatcactaataaatgaggttcttgatcaggcaaagattgaatccggaaggctcgagcttgaaaatgtgccttttgatatgcgttttattcttgataatgtttcatctctcctctctggcaaggcaaatgaaaaaggaattgagttggccgtttatgtttctagtcaagttcctgatgttgtagtcggtgatccgagtcggttccggcagatcattacaaacctggttggaaactcaatcaaattcacacaggaaaggggacacatatttatctcagtgcaccttgcagatgaggtaaaggagcctcttactattgaagacgcagtgctaaaacagcgactagctttaggatgcagcgagtccggtgagacagttagcgggtttcctgcggtaaatgcatggggaagctggaagaatttcaagacatgttacagtactgagagtcagaattctgatcaaatcaaattgctagttacagtggaggacactggagttggcatacctgtggatgcacaaggccgaatcttcacaccttttatgcaagccgacagttccacatcgcggacttatggtggaactggcataggtttgagtataagcaaacgtttggttgaactcatgcaaggagagatggggtttgtgagtgagcccgggataggcagtactttttcatttactggagttttcgggaaagcagaaacaaatacgtcgattactaagctggaacgattcgatctagctattcaggagtttacaggattgagagcattagttattgataacagaaacattagagcagaggtcaccaggtacgaacttcggagactgggaatatctgcagacattgtttcaagtctgagaatggcatgcacttgttgtatcagcaaattagaaaatttggctatgattctaatagacaaagacgcctggaacaaggaagaattttcagtacttgacgagttgtttacccgaagcaaagtaacctttacaagagtcccaaagatttttcttttggcaacttctgcaactcttactgagcgcagtgagatgaagtctactggtctcatcgatgaggtggtgataaagcctcttcggatgagtgtcttaatatgttgcttgcaagaaacccttgtcaatggcaagaagaggcaaccgaacagacagcgaagaaatcttggacacttgctaagagaaaaacagattctggttgtggatgataatcttgtgaacagacgagttgcagaaggtgcacttaagaaatatggagctattgttacatgcgttgagagtggcaaagctgcattggcaatgcttaagccgcctcataacttcgatgcttgcttcatggatctccagatgcctgaaatggatggatttgaagcgacaaggagagtccgtgagctggagagggaaatcaataagaaaatagcttctggagaagtttcagctgaaatgttctgtaaatttagtagttggcacgtcccgatattagcaatgacagcagatgttattcaggctactcatgaagaatgcatgaaatgtggaatggatggttatgtatcaaaaccgtttgaagaggaagtgctctacacagcggtagcaagattctttgaaccttgttaa

SEQ ID NO: 605 - DNA, 3111 bp, Arabidopsis thaliana
atgagtctgttccatgtgctagggtttggtgtcaagattgggcatctcttctggatgctatgctgctggtttgtttcttggttcgttgataatgggatcgaggacaagtctggtcttttagttggctctgtcggtgatcttgagaagactaagatgactacgttgaagaagaagaacaagatgtggttctggaataagatctctagcagcggactcaagatcccgagtttctcttatcagtttcttggctctgttaaattcaacaaggcgtggtggaggaagcttgtggtggtttgggttgtcttctgggtcttggtctctatttggacgttttggtactttagctcgcaagctatggagaagaggaaagagacgctagctagtatgtgtgatgagagagctcgtatgctgcaggatcagttcaacgttagcatgaatcatgttcaagccatgtctatcttgatctcaaccttccaccatggcaagattccttctgctatcgatcagagaacattctcagagtacactgatagaacttcctttgagaggcctcttactagcggggtagcttatgctatgagggtgctccattcagagagggaagagttcgagaggcaacaaggttggactattaggaagatgtattctcttgaacaaaacccagttcacaaggatgactatgacctggaagctttggaaccatcccctgtccaagaagagtacgctccagtcatctttgctcaggacactgtttctcacgttgtttctctcgatatgctgtctgggaaagaagatcgtgaaaacgttttgcgggccaggagttcaggtaaaggggttttgacagctcctttcccattgataaagacaaatagacttggggtgatcctgacatttgcagtgtacaagagagatctcccctccaatgcaacgccaaaagagagaattgaggctactaacgggtatctcgggggagtgtttgacattgagtccctggtagaaaacttgcttcaacagctggctagcaagcaaacgattcttgtcaatgtgtacgatatcaccaatcactctcaaccgattagcatgtatggtacaaatgtgtcggctgatgggttggaacgtgttagtccactaatctttggcgatccattgagaaagcatgagatgcgttgcagatttaagcagaaaccaccatggccagtgctatcaatggtgacatcattcggtatccttgtgattgcgttacttgttgcacatataatccacgcaaccgttagtcgaatacacaaagttgaagaagattgtgataaaatgaagcagctcaagaaaaaggctgaagcagcagatgttgcaaagtcacagttccttgccactgtttcacatgaaatcagaactccaatgaatggtgttctaggaatgttgcatatgcttatggacacagagttagatgttacgcaacaggattatgttaggaccgcacaggcaagtggaaaagctttagtctcgctaataaatgaggttttggaccaagcaaagattgaatctggaaagcttgaacttgaggaggtgcggtttgatttgagaggaatattagatgatgtcctgtcactcttctctagcaagtcccaacaaaagggggtggagttggcagtatacatatctgatcgtgttccagatatgttaattggtgatcctgggaggtttcgacaaatactcacaaatcttatgggtaattccattaagttcactgagaaaggacacatctttgtaactgttcatttggtggatgagctatttgaatctatcgatggagagacagcatcatctccggaaagtacactgagtgggcttccagttgcagaccggcagaggagctgggaaaactttaaagctttcagctccaacgggcatcggagctttgaaccatctccccctgatataaacctaatcgtctcagttgaggatactggcgtagggatccctgtagaagcgcagtcccgtatttttacgcctttcatgcaagtcggaccatccatatccaggacgcatggaggcacaggaattggacttagcataagcaaatgtctagttggactgatgaagggagaaattggattctcgagtactcccaaggttgggtccacattcacatttactgctgtattttccaatgggatgcaaccagctgaaagaaagaatgacaacaaccagcccatattctcggaattccggggcatgaaagctgtggttgtggaccataggcctgcaagggcaaaagtctcgtggtaccattttcagcgtcttggaattcgagtcgaagtagttccacgtgttgaacaggctctacattatctgaagattggtactaccactgtgaatatgatactcatagagcaagaaatatggaatagggaagcagatgatttcattaaaaagctacagaaagaccctcttttcctttctcctaagttgattttgttagcaaactcagtagaatcgtcaatatcagaggctttatgcaccggtatagatcctccaatagtgatagtgaaaccattgagggcgagtatgctagcagcaactttgcagaggggattgggtattggaatcagagaaccacctcaacacaagggacctcctgctttgattctcaggaatcttctccttggtagaaaaattttaatcgtggatgataacaacgtaaacctcagagtggcagcgggagctctgaaaaagtacggagctgatgtggtctgcgctgagagtgggataaaggcaatctcattgcttaagccacctcacgagtttgatgcttgcttcatggacattcagatgccagaaatggatggatttgaagctacaaggagaatacgagatatggaagaggagatgaacaagagaataaagaatggggaggctttgatagtagagaacggtaacaaaacaagctggcatcttccggtattagcaatgacggcagatgtgatccaagcaacgcatgaggaatgtctgaagtgtggaatggatgggtatgtatcaaaaccatttgaagcagagcagctgtacagggaagtttctcgctttttcaattcgccttcagatacagaatcataa

SEQ ID NO: 606 - DNA, 2229 bp, Zea mays
tggccataaggagacgcggcgatcaggccttccttaattttcttctgttccatcctcgctctacctgcctgctgccagtttcaactctccaaggtcaacgccagccctcgcgcgcttggtgtactctagtttagtacaccaatccgcatgcattcttttttgtttgtttgtttgtttgtttgttttgattgacaaatatatgcggcagagttaagaacgaatcgactccgtcgtctcggctagtcgaccgtacatatccacgacctccaaaggccgccaaaacacccgatccggccagccttgtcgtgtcatcgtccagttagatgtcaactcccatctgaatctcctcctccatggcggctttcctataaatacgtcgcctttccatgttggatgtcattccacgcgtccgggcaacagcagctatagtttccaagggaaagggatacatcacctgctgctctagctctgctatagcgctagcagcaatataatggcggccgtcggcgccccgggcagctctctgcacggagtcacggggcgcgagccggcgttcgccttctccacggagcacgaggaggcggcgagcaatggcggcaagttcgacctgccggtggactcggagcacaaggcgaagagcgtccggctcttctccgtggccaacccgcacatgcgcaccttccacctctcctggatctccttcttcacctgcttcgtgtccaccttcgccgccgcgccgctggtccccatcatccgcgacaacctcaacctcaccaaggccgacatcggcaacgcgggcgtggcctccgtgtcgggctccatcttctcccgcctcaccatgggcgccgtctgcgacctgctgggcccgcgctacggctgcgccttcctcatcatgctgtccgcgcccaccgtgttctgcatgtcgctcatcgacgacgccgcgggctacatcgccgtcaggttcctcatcggcttctccctcgccaccttcgtctcctgccagtactggatgagcaccatgttcagcagcaagatcatcggcaccgtcaacgggctcgccgccggatggggcaacatgggcggcggcgccacgcagctcatcatgccgctcgtctacgacgtcatccgcaagtgcggcgccacgcccttcacggcgtggcgcctcgcctacttcgtgccgggcctcatgcacgtcgtcatgggcgtcctggtgctcacgctggggcaggacctccccgacggcaacctcaggtcgctgcagaagaagggcaacgtcaacaaggacagcttctccaaggtcatgtggtacgccgtcatcaactaccgcacctggatcttcgtcctcctctacggctactgcatgggcgtcgagctcaccaccgacaacgtcatcgccgagtacatgtacgaccgcttcgacctcgacctccgcgtcgccgggaccatcgccgcctgcttcggcatggccaacatcgtcgcgcgccccatgggcggcatcatgtccgacatgggcgcgcgctactggggcatgcgcgctcgcctctggaacatctggatcctccagaccgccggcggcgccttctgcctctggctgggacgcgccagcaccctccccgtctccgtcgtcgccatggtgctcttctccttctgcgggcaggcggcctgcggcgccatcttcggggtcatccccttcgtctcccgccgctccctcggcatcatctccggcatgacgggcgccggcggcaacttcggcgcggggctcacgcagctgctcttcttcacctcctcaacctactccacgggcagggggctagagtacatgggcatcatgatcatggcgtgcacgctacctgtggtgttcgtgcacttcccgcagtgggggtccatgttcttcccgcccagcgccaccgccgacgaggagggctactacgcctccgagtggaacgacgacgagaagagcaagggactccatagcgccagcctcaagtttgccgagaacagccgctcagagcgcggcaagcgaaacgtcatccaggccgatgccgccgccacgccggagcatgtctaagtctactactaataagatggatcgatccatcatccatgttcacctgctacctacctctacgtgtatgccttgtaacgcgccggaccggagcacttgtttgataaaaaaaaaaaaaaaaaaaaaaaaaaaaaaaaaaaaaaaaaaaaaaaaaaaaaaaaaaa

SEQ ID NO: 607 - DNA, 1952 bp, Oryza sativa
aattgcatccgagctcacctagcttctctcttgcaaccagcgattcgatcgattccatctccaagaagcagcggctagcagcagctagtagttgccatggactcgtcgacggtgggcgctccggggagctcgctgcacggcgtgacggggcgcgagccggcgttcgcgttctcgacggaggtgggcggcgaggacgcggcggcggcgagcaagttcgacttgccggtggactcggagcacaaggcgaagacgatcaggttgctgtcgttcgcgaacccgcatatgaggacgttccacctatcatggatctccttcttctcctgcttcgtctccaccttcgccgccgcccctctcgtccccatcatccgcgacaacctcaacctcaccaaggccgacatcggcaacgccggcgtcgcctccgtctccggctccatcttctccaggctcgccatgggcgccatctgcgacatgctcggcccgcgctacggctgcgccttcctcatcatgctcgccgcgcccaccgtcttctgcatgtcgctcatcgactccgccgcggggtacatcgccgtgcgcttcctcatcggcttctccctcgccaccttcgtgtcatgccagtactggatgagcaccatgttcaacagcaagatcatcggcctcgtcaacggcctcgccgccgggtggggaaacatgggcggcggcgcgacgcagctcatcatgccgctcgtctacgacgtgatccgcaagtgcggcgcgacgccgttcacggcgtggaggctggcctacttcgtgccggggacgctgcacgtggtgatgggcgtgctggtgctgacgctggggcaggacctccccgacggcaacctgcgcagcctgcagaagaagggtgacgtcaacagggacagcttctccagggtgctctggtacgccgtcaccaactaccgcacctggatcttcgtcctcctctacggctactccatgggcgtcgagctcaccaccgacaacgtcatcgccgagtacttctacgatcgcttcgacctcgacctccgcgtcgccggcatcatcgccgcatccttcggcatggccaacatcgtcgcgcgccccaccggcggcctcctctcggacctcggcgcgcgctacttcggcatgcgcgcccgcctctggaacatttggatcctccagaccgccggcggcgcgttctgcctcctgctcggccgcgcatccaccctccccacctccgtcgtctgcatggtcctcttctccttctgcgcgcaggccgcctgcggcgccatcttcggcgtcatccccttcgtctcccgccgctcgctcggcatcatctccggcatgaccggcgccggcggcaacttcggcgccgggctcacgcagctgctcttcttcacgtcgtcgaggtactccacgggcacggggctggagtacatgggcatcatgatcatggcgtgcacgctgccggtggtgctcgtccatttcccgcagtggggctccatgttcctcccgcccaacgccggcgccgaggaggagcactactacggctccgagtggagcgaacaggagaagagcaagggcctccacggtgcaagtctcaagttcgccgagaactcccgctccgagcgtggccgccgcaacgtcatcaacgccgccgccgccgccgccacgccgcccaacaactcgccggagcacgcctaaggcgtaaacaattctgcgaccgagaccagcaatacgctggagttcgactcgatgataacacgccggagcacgtccttgttgcaaacgggtgatgaaattaagagtgaaatatttccttaggaattgaatcctttgaaattaattcctttggaatttctccgatacaaacggaggtataataagggagaggcatttatacctatgtacatgttacacttttttgaatttacagtgtattccatattgatgttgtc

SEQ ID NO: 608 - DNA, 1551 bp, Oryza sativa
atggaggctaagccggtggcgatggaggtggagggggtcgaggcggcggggggcaagccgcggttcaggatgccggtggactccgacctcaaggcgacggagttctggctcttctccttcgcgaggccacacatggcctccttccacatggcgtggttctccttcttctgctgcttcgtgtccacgttcgccgcgccgccgctgctgccgctcatccgcgacaccctcgggctcacggccacggacatcggcaacgccgggatcgcgtccgtgtcgggcgccgtgttcgcgcgtctggccatgggcacggcgtgcgacctggtcgggcccaggctggcctccgcgtctctgatcctcctcaccacaccggcggtgtactgctcctccatcatccagtccccgtcggggtacctcctcgtgcgcttcttcacgggcatctcgctggcgtcgttcgtgtcggcgcagttctggatgagctccatgttctcggcccccaaagtggggctggccaacggcgtggccggcggctggggcaacctcggcggcggcgccgtccagctgctcatgccgctcgtgtacgaggccatccacaagatcggtagcacgccgttcacggcgtggcgcatcgccttcttcatcccgggcctgatgcagacgttctcggccatcgccgtgctggcgttcgggcaggacatgcccggcggcaactacgggaagctccacaagactggcgacatgcacaaggacagcttcggcaacgtgctgcgccacgccctcaccaactaccgcggctggatcctggcgctcacctacggctacagcttcggcgtcgagctcaccatcgacaacgtcgtgcaccagtacttctacgaccgcttcgacgtcaacctccagaccgccgggctcatcgccgccagcttcgggatggccaacatcatctcccgccccggcggcgggctactctccgactggctctccagccggtacggcatgcgcggcaggctgtgggggctgtggactgtgcagaccatcggcggcgtcctctgcgtggtgctcggaatcgtcgacttctccttcgccgcgtccgtcgccgtgatggtgctcttctccttcttcgtccaggccgcgtgcgggctcaccttcggcatcgtgccgttcgtgtcgcggaggtcgctggggctcatctccgggatgaccggcggcgggggcaacgtgggcgccgtgctgacgcagtacatcttcttccacggcacaaagtacaagacggagaccgggatcaagtacatggggctcatgatcatcgcgtgcacgctgcccgtcatgctcatctacttcccgcagtggggcggcatgctcgtaggcccgaggaagggggccacggcggaggagtactacagccgggagtggtcggatcacgagcgcgagaagggtttcaacgcggccagcgtgcggttcgcggagaacagcgtgcgcgagggcgggaggtcgtcggcgaatggcggacagcccaggcacaccgtccccgtcgacgcgtcgccggccggggtgtga

SEQ ID NO: 609 - DNA, 3442 bp, Zea mays
  unsure (1)..(3442): unsure at all n locations
actcgtcgacgcgacgctgctcgcaagagaaaaaaagctcccaaatacctccaccaccaccaccaccaaagctgcgacgaacacgaacggcacaagcacaagagaaagagagagagagagagagagagagagagagagaggggagggagagaggccttctcttctctgctgcggcggcggcgcatgtgaattggggtgggatgggtgtgggaggaggcggaggaggaggaggaggggaggcggcggcggcggtggcggtggagggggatgaggcggggaaggggaggaggtggtggagggtgaaggtgaagctgagcacggtggcggtggtggcgtgggtgctggcgtcggcggcgctctgggcggggctgcactggcgcttccgccgcgcggcgctgcacaaggccgaggaggccctcgtctgcatgtgcgaggagcgcgcccgcatgctgcaggaccagttcgccgtctccgtcaaccacgtccacgccctcgccatcctcgtcgccaccttccactacgacaagcaccctcccgccctcgaccaggacacgttcgccgtgtacgccgcgaggacgtccttcgagcggccgctgctgagcggcgtggcgtacgcgcagcgggtggtgcacgccgacagggagagcttcgagcggcagcaggggtggatcatcaagaccatgaagcacgagccgtccccggcgcaggacgagtacgccccggtgatctactcccaggagaccatctcctacatcgagggcctcgacgtcatgtccggcgaggaggacagggagaacatcttgagggcgagggcgacagggaaggccgtcctcacgaggccgttccggctgatgtcgaatcacttgggtgttgtcttgacgtttcctgtctacctcgtcgatctcccaaatgataccgcggtggaggatcgtgttgctgctactgcaggataccttggaggagcatttgatgtggagtcactagtagaaaatttgttgagacagttagctggtaaccaggaattggtggtcaatgtttatgatgtcacaaaccactcaaaccctcttgtgatgtatggatctgaggttcctcttggtattccctcaccatcacacacctatacgttggattttggtgatccattgagaaagcatcagatggtttgcagatacagaaacaagcttcatgtttcatggtctgcaattactacaccatcaggggtctttgttatatgtatgctggtgggctacataatatatgctgcttggagtcgctacgataatgttaaggaagattgccggaaaatggaagcgctgaaaaaacgggcagaagcggctgatattgctaaatctcagttccttgcaactgtttctcatgagatcagaacacccatgaatggcgtgctgggaatgcttgatatgttattagacacagagctgaagtcaacccagagggattatgcacaaacagcccaagtctgtggaaaggcattaatatccctgattaacgaagtgcttgacagggccaaaatcgaggctggcaagatagatctcgagtcagtaccatttgacctgaggtccatccttgatgatgtcatctcgttattttcttcaaaatcaagagagaaaggaattgagcttgctgtatatgtttctgaaagagttcctgaaatcctgttgggcgaccctggaaggtttcgtcagataattacaaacttggtgggaaactcgatcaagataacaatatttaccttgtcgcagttcacagaacgggggcacatttttgtacaagttcacctggcagatcactcaaatcttgcaacagaagcaaaaattgaaccagtagtcaatgggatgaatggacataaagacgaggctattgctatacccaccagtgggtctcataacactttaagtggttttgaagcagctgatagccgaaataactgggaaaacttcaagcttttgctctcttacgagaaaaatgaaatgccatatgaaagtgattctgataaagtaactcttgttgttagtgtggaagatactgggataggcataccactgcatgcccaaggccgggtcttcacgcctttcatgcaagctgacagctcaacttctaggaactatggtggaactggcattggattgagcatcagcaaatgtcttgttgaaataatgggtggtcagataaactttgtcagccgacctcttgttgggagcacattcacattcactgctgttctgagaaggtgtgacaaaaatgctattagtgacagtaagactgttgctttgcacccattaccgtccagttttaaaggcttatctgcgctattggttgataaaagacctgtaagagcaactgtgactaagtatcatttgcaaaggcttggaatcacttctgaagttgttggtaccattgatccgacatttggtgtgttgtctgggagaaatggcagttctctaaccagcattggtaagaagcagccatgcatgttgctaatcgagagtgattcctggggaccacagatggatgtctccttacatgctagacttcaggagatgaaacagagtgatcgcatacatgtattgcccaaggttttccttctttctgctgcagaatcagacaaagtaaagaagatacatgcagttgattctgtgataccaaagcctctgaaagcaagtgcacttgcggcctgtctgttccaagcacttggtatcacacagccgagccatgagaaacgtgacgattcaggttctcttcatgggcgtgatggttcaggttctcttcatgggttgcttcttggcaagaacatattggtagttgatgacaacaaggtaaacctcagagtggccgctggtacattgaagaaatatggggcaaaggtggagtgtgtggagagtggaaaagatgctctttcccttctacaagtgccgcacaagtttgatctgtgtctcatggacattcagatgccgnagatggatggatttgaggcaactcggcaaatacgagcaatggaagggaaggcaaatgagcaggcagacgacagcgaatcgggttcagaaatcgcagcaaagacggccaaatggcacttgccaatcctggcaatgaccgctgatgtcatccaggccacccacgaggaatgcacaaagtgcgggatggatggctacgtctcgaagccctttgaggagaagcagctcttccaggcagtacagaagttcttgggcccatgcgtttccagctgacaccaaccgatgcattctgctgtacaccaagagagtaaagaatgagcactgactgtgaactgaggcggctaaaattcttctccattttgttgctcttcaacagaggatgcgatctgaatgagagcctgcactcaaggcgacattgcacagaaaggatcggagccttcattgtgtacatgtatttttatcggcagagacca

SEQ ID NO: 610 - DNA, 1957 bp, Arabidopsis thaliana
gtcgacccacgcgtccgtagataggtagcttcaacgtaaggaatctaaattggttcagctcaaaaaacgaaaacgatgggttccatcgaagaagaagcaagacctctcatcgaagaaggtttaattttacaggaagtgaaattgtatgctgaagatggttcagtggactttaatggaaacccaccattgaaggagaaaacaggaaactggaaagcttgtccttttattcttggtaatgaatgttgtgagaggctagcttactatggtattgctgggaatttaatcacttacctcaccactaagcttcaccaaggaaatgtttctgctgctacaaacgttaccacatggcaagggacttgttatctcactcctctcattggagctgttctggctgatgcttactggggacgttactggaccatcgcttgtttctccgggatttatttcatcgggatgtctgcgttaactctttcagcttcagttccggcattgaagccagcggaatgtattggtgacttttgtccatctgcaacgccagctcagtatgcgatgttctttggtgggctttacctgatcgctcttggaactggaggtatcaaaccgtgtgtctcatccttcggtgccgatcagtttgatgacacggactctcgggaacgagttagaaaagcttcgttctttaactggttttacttctccatcaatattggagcacttgtgtcatctagtcttctagtttggattcaagagaatcgcgggtggggtttagggtttgggataccaacagtgttcatgggactagccattgcaagtttcttctttggcacacctctttataggtttcagaaacctggaggaagccctataactcggatttcccaagtcgtggttgcttcgttccggaaatcgtctgtcaaagtccctgaagacgccacacttctgtatgaaactcaagacaagaactctgctattgctggaagtagaaaaatcgagcataccgatgattgccagtatcttgacaaagccgctgttatctcagaagaagaatcgaaatccggagattattccaactcgtggagactatgcacggttacgcaagtcgaagaactcaagattctgatccgaatgttcccaatctgggcttctggtatcattttctcagctgtatacgcacaaatgtccacaatgtttgttcaacaaggccgagccatgaactgcaaaattggatcattccagcttcctcctgcagcactcgggacattcgacacagcaagcgtcatcatctgggtgccgctctacgaccggttcatcgttcccttagcaagaaagttcacaggagtagacaaaggattcactgagatacaaagaatgggaattggtctgtttgtctctgttctctgtatggcagctgcagctatcgtcgaaatcatccgtctccatatggccaacgatcttggattagtcgagtcaggagccccagttcccatatccgtcttgtggcagattccacagtacttcattctcggtgcagccgaagtattctacttcatcggtcagctcgagttcttctacgaccaatctccagatgcaatgagaagcttgtgcagtgccttggctcttttgaccaatgcacttggtaactacttgagctcgttgatcctcacgctcgtgacttattttacaacaagaaatgggcaagaaggttggatttcggataatctcaattcaggtcatctcgattacttcttctggctcttggctggtcttagccttgtgaacatggcggtttacttcttctctgctgctaggtataagcaaaagaaagcttcgtcgtagtaatgctgttatctatctactttcattacatacaaaagtttgtttctttcaactgtaactgtctctgtatcaataacaacattgctgtgtacttttcctttcaaaaaaaaaaaaaaaaaaaaaa

SEQ ID NO: 611 - DNA, 2065 bp, Zea mays
cccacgcgtccggcggaagcgacccagcagcgaagcgacgactagctctgcggcctctgccccaagcgccgacgatgggtgccggtgctactgccagggacgaggagactgctaccggccgccaccatgggaggaagccgcatggcgcggcggcggagtacgcgcaggacgggtccgtggacctgcgcggcaatcccgtgctccgctcccagcgcggcggctggaccgcctgctccttcatcgtcgtgtacgagctgttcgagcggatggcctactacgggatctcgtccaacctcatcatctacctgacggacaggctccaccagggcaccgtcgaggcctccaacaacgtcaccaactggtccggcaccgtcttcctcacgccgctgctcggcgcctatgtcgccgacgcctacctcggccgctactggaccttcgtcgtcggctccgccatttacctcctggggatggtgctgctggtgctgtccgtctcggtgccggcgctgaagccgccgccgtgcggcgccggcggcgtgtgcccgcaggcgtcggcgctgcagctcggggcgtacttcggcgggctctacatcgtggccctgggaaacggcggcaccaagcccaacatctccaccatcggggcggaccagttcgacgagttcgacccgcgggagcggacgcacaagctgtccttcttcaactggtggatgttcaccatcttcctgggcatcctcttctcctccaccgtcctcgtgtacctgcaggacaacgtgagctggtccgtgggctacggcatccccacgctgggcctcatggtctccatctccgtcttcctcgccggcaccaggctgtaccgccacagggtgccgcagggcagcccgttcacgagcatgggcagggtcctggccgccgcgctctggaagtggagcgtcccggtcccggccgacgccaaggagctgcacgagctggacgtcgaggagtacgcgaggaagcgtaagttcaggatggactccaccgacgccatggccttcctcaacaaggccgccgccgtgcccagcggcgggccggcggcgacgccggcgtggagcctctgcacggtgacccaggtggaggagacgaagcagatcctgaggctggtgcctctcctggtggccatgatcgtgccctgcacgctcatcgcgcagaccaacacgctgttcgtaaagcagggcacgacgatggaccggcacatgggcccacgcttcgagatcccagcggcgagcctgggcgcgttcgtgacgctgaccatgctggtggccgtggtggtgtacgaccgggtgttcgtgagggccgtgcggcggtacaccaaggacccgcgcgggatcacgatcctgaggcggatgggcacgggcatgctgctgcaggtggcgaccatggcggtggcgtcggcgatcgagagccggaggctggcctacgcgcggagccacggcctggacgccacggggggccagctggggctcaccatcttcgcgctgctcccgcagttcgtgctgatgggactggccgacgcgttcctggtggtgggcaagatcgagttcttctacgaccaggcgccggagagcatgaagagcctgggcaccgccatgtccctcaccgcgtacggcatcggcaacttcctcagcagcttcctgctgtccacggtcacgcgcgtcacgcgggaccgcggccacgcctgggtcaccaacaacctcaacgcctccaacctcgactactactacgccttcctcaccgcgctcggcgtcgtcaacttcgtcgccttcctcgcgctcagcgccaggtacaggtacaaggcccagtccaccgacacgatcgacgctgccgtcggcctggagaccgagaaagccaagcttcaggcggagccactgggctgacgtcgacgacgacgacggggtgcgtctgcctctgctgttaaaagcggagaagatcagccatgaatgcgtatcgtccaaggcgacgtgtgtagcatcaactcacttgtaaaaaaaagcacaggatttccacccgaaaccaaaagcagtgtctgcaaaaa

SEQ ID NO: 612 - DNA, 2225 bp, Zea mays
gccagagagagatgcgggtgggagttgggatacctcggaggcggcgacgacaggatcgcagtggtcagtagccgggtcggccggtggccgcagattctcaccagcagcgccatccctcgccgtcgcccggcgctccagcccagggcaggagaggaagccactctgactctgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcctactatggcatgagcaccaacctggtgaactacatgaagacccggcttggccaggtgaactctgtcgcctccaacaacgtcaccaactggcaagggacgtgctacatcacgccgctcatcggcgccttcttcgccgacgcgtacatggggaggttttggaccatcgccatcttcatgatcatctacatttttggcctggcgctgctgacgatggcgtcatcggtgaaggggctggtgcctacgtcgtgcggcgacaaggacgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacggtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggcggccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggcaacacgctggaccagagcatggggccccggttcaagatcccctcggcgacgctgtccatggtggacactatcagcgtcatcgtctgggtccccgtgtacgaccgcgccatcgtgcccctggtgcgctcttacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgagaacgacatcgtgcccatctccatcttctggcagataccgcagtacttcatcatcggatgcgcggaggtgttcaccttcgtggggcagctggagttcttctacgaccaggcgcccgacgccatgaggagcatgtgctcggcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgcagtgctcagcctcctcaacttccttgcctacctcgtcatcgccagctggtacaagtacaagaagacggccgatgattaccctggcgccaaaggggagcacggtacagagcactgatgggcgagagatggcggaaattgagtgatttctatgtgtggttagctgtctgcctgtctgtcgacttgttttgccacagtttgggtgcttaaacgttaacgtacgtactagttcaatatagtgtctcgggggcgaattggttgtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 613 - DNA, 2183 bp, Oryza sativa
gtacccggagaccccacatatccagatctgcaagcggcctcctcctccttcctcctgatcctttagcttcctatatacgattccaccatcgaaggccagggcccagacttgcttgccgcaggttactgatccaccgaaggagggaggcgcccgcccgccgccatggccgaggtgacggtggtccgtgcggagcgcgaggaggagtccaccctggagcagggtctcctcgccatcccggaggaatccaaccaacttacatacactggagatggatctgtcgacttttctgggaatcctgttgtgaaggagagaactggtagatggagggcatgcccatttatcttaggtaatgagtgctgtgagcggttggcctattatggaatctccacaaaccttgttacatacttgacaaagaaactgcatgatggtaatgcttctgctgctagcaatgtgactgcatggcagggaacttgctacttaactccccttattggagctatactggctgatgcatactggggaaggtattggactattgcaacattctccacgatatacttcattgggatggctgtactgactctttcagcatcagttcctacattcatgcctccaccttgcgaagggtccttttgcccaccagcaaatccattgcagtatactgtcttttttcttggactttacctaattgctcttggtactggtggtattaagccctgtgtctcatcctttggagcagatcaatttgatgatacagacccagttgagcgaatccagaagggatctttctttaactggttctatttctcaataaacattggtgctctcatatcaagcagttttctggtttgggtgcaagacaatataggatggggaataggctttggcattccaacaattttcatggggctggccatcataagtttcttctctggaacatcactttatagattccaaaagccaggcggcagtcctattacacgagtatgccaggtggttggtgcctcctttcgcaagtggaacgtacatgttccagaggatagctctcgcttgtatgagttgcctgatggggcttcagcaattgaagggagtcggcaattggagcacaccgatgaactcagatgtctggacaaagctgctacaattactgatcttgatgtgaaagcagatagctttacaaacccatggcgaatatgcactgtgactcaggtggaagaactgaagatattggtaaggatgttccctgtctgggcaacgactattgtgttttctgctgtctatgctcagatgtccaccatgtttgttgagcaagggatgatgcttgatacatcagtaggtccattcaagattcctccagcatctctatctacctttgatgtggtaagtgtcattatatgggtccccctctatgatagtatcttggttccaatagctaggaggttcactggcaacccgaggggctttacagagttacagaggatggggattggtttggtaatctcaatcttttcgatggcggcagctgcagttcttgagattaaaaggttggacattgcaagggctgaacatttggtggatcaaaatgttccagtaccactgaacatctgctggcaaattcctcaatatttcttggttggtgcctcagaggtcttcacatttgtcgggtcacttgagttcttctatgatcaatcaccggatgccatgaggagcctctgcagcgcactgcagcttgtcacaacagctcttgggaattatctcagtgcattcattttgacattggttgcgtacttcacaacaagaggaggaaatcctggatggattcctgataacttgaatcaaggtcacctagattatttcttctggcttcttgctgggctcagttttctgaactttgtgatatatgtcatctgcgcaaacaaatacaaaagcaagaaagcagcttgagctaatcaggagttaaaagactgtcgtcatgggaatttcacttcaaaattctgtatatatgtgcacaaagtacatgttgaagcagcgaccgtaacaagagaactttaaccatcctgtactctgtatttgatgctactatacattttatactttttgttctgtagatattaatttattgaagctacttgtggaatgtagctttgcttccaatgcgtctccttaatctggtacacctgatt

SEQ ID NO: 614 - DNA, 1743 bp, Oryza sativa
atgggagaggttgcagaagacatctacacccaagatggcaccgtggacgtcaagggcaacccggccaccaagaagaacaccggcaactggcgtgcctgcccctacatcctcgctaacgagtgctgcgagaggctggcctactatggcatgagcaccaacctcgtgaactacatgaagacgcggctcgggcaggagagcgccattgccgccaacaatgtcaccaactggtcggggacttgctacatcaccccccttctcggtgccttcttggctgatgcctacatgggcaggttctggaccattgccagcttcatgatcatctacatcctgggtttggcgttgctgacaatggcgtcgtcggtgaaggggctggtgccggcgtgcgacggaggagcgtgtcacccgacggaggcgcagacgggggtggtgttcttggcgctgtacctgatagcgctgggcaccggcgggatcaagccgtgcgtgtcgtcgtttggcgcggaccagttcgacgagaacgacgagggggagaagcggagcaagagcagcttcttcaactggttctacttctccatcaacatcggcgcgctggtggcgtcgtcggtgctggtgtacgtgcagacgcacgtcgggtgggggtgggggttcggcatcccggccgtcgtcatggccgtcgccgtcgccagcttcttcgtcggcacgccgctgtacaggcaccagcggcccgggggcagcccgctgacgaggatcgcgcaggtgctcgtcgcgtcggcgaggaagtggggcgtcgaggtccccgccgacgggtcgcggctgcacgagacgctcgacagggagtccggcatcgagggcagccgcaagctggagcacaccgggcagttcgcgtgcctcgacagggcggcggtggagacgccggaggacaggtcggcggcgaacgcgtcggcgtggcggctgtgcacggtgacgcaggtggaggagctgaagagcgtggtgcggctgctgccgatctgggcgagcgggatcgtgttcgcgacggtgtacgggcagatgagcaccatgttcgtcctccaggggaacacgctcgacgccagcatggggccgcacttctccatcccggcggcgtcgctctccatcttcgacaccctcagcgtcatcgtctgggtgccggtgtacgaccgcctcatcgtgccggcggtgcgcgccgtgacggggcgcccacgcgggttcacccagctgcagcggatgggcatcggcctcgtcatctccgtcttctccatgctcgccgccggcgtgctcgacgtcgtcaggctgcgcgccatcgctcgccacgggctctacggcgacaaggacgtcgtgcccatctccatcttctggcaggtgccgcagtacttcatcatcggcgccgccgaggtgttcacgttcgtcgggcagctggagttcttctacgaccaggctcccgacgccatgcgcagcatgtgctcggcgctgtcgctcaccaccgtcgcgctaggcaactacctcagcacgctgctcgtgaccatcgttacccatgtcaccacccggaacggcgccgtcgggtggatcccggacaacctcaaccgcggccacctcgactacttcttctggctgctcgccgtgctcagcctcatcaacttcggcgtctacctcgtcatcgccagctggtacacctacaagaagacggcggattcaccggacgacaaggccgagcacgccggagcaaactga

SEQ ID NO: 615 - protein, 141 aa, Arabidopsis thaliana
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 616 - protein, 223 aa, Zea mays
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQQQQGELPRGAANAAGYAGYGAPGSGGMMMMMMGQPMYGGSQPQQQPPQPQPPQQQQQQHQQHHMAMGGRGGFGQQGGGGGSSSSSGLGRQDRA

SEQ ID NO: 617 - protein, 185 aa, Zea mays
MAEAPASPGGGGGSHESGSPRGGGGGGSVREQDRFLPIANISRIMKKAIPANGKTIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 618 - protein, 166 aa, Zea mays
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQVIYRTVIC

SEQ ID NO: 619 - protein, 608 aa, Arabidopsis thaliana
METNSSGEDLVIKTRKPYTITKQRERWTEEEHNRFIEALRLYGRAWQKIEEHVATKTAVQIRSHAQKFFSKVEKEAEAKGVAMGQALDIAIPPPRPKRKPNNPYPRKTGSGTILMSKTGVNDGKESLGSEKVSHPEMANEDRQQSKPEEKTLQEDNCSDCFTHQYLSAASSMNKSCIETSNASTFREFLPSREEGSQNNRVRKESNSDLNAKSLENGNEQGPQTYPMHIPVLVPLGSSITSSLSHPPSEPDSHPHTVAGDYQSFPNHIMSTLLQTPALYTAATFASSFWPPDSSGGSPVPGNSPPNLAAMAAATVAAASAWWAANGLLPLCAPLSSGGFTSHPPSTFGPSCDVEYTKASTLQHGSVQSREQEHSEASKARSSLDSEDVENKSKPVCHEQPSATPESDAKGSDGAGDRKQVDRSSCGSNTPSSSDDVEADASERQEDGTNGEVKETNEDTNKPQTSESNARRSRISSNITDPWKSVSDEGRIAFQALFSREVLPQSFTYREEHREEEQQQQEQRYPMALDLNFTAQLTPVDDQEEKRNTGFLGIGLDASKLMSRGRTGFKPYKRCSMEAKESRILNNNPIIHVEQKDPKRMRLETQAST

SEQ ID NO: 620 - protein, 191 aa, Zea mays
MGFSEAQEELVLRSWKAMKSDSESTALKFFLRIFEIAPGAKQMFSFLRDAGDAPLEKHPKLKAHAVTVFVMACESATQLRSTGDVKVREATLKRLGATHARAGVADAHFEVVKTALLDTIRDAVPDMWTPEMKAAWEEAYDQLAAVIKEEMKNAAAAEEQTKNAATAEEEIKNAAAAEEETTNAAAAVDGS

SEQ ID NO: 621 - protein, 2513 aa, Arabidopsis thaliana
MSTSSQSFVAGRPASMASPSQSHRFCGPSATASGGGSFDTLNRVIADLCSRGNPKEGAPLAFRKHVEEAVRDLSGEASSRFMEQLYDRIANLIESTDVAENMGALRAIDELTEIGFGENATKVSRFAGYMRTVFELKRDPEILVLASRVLGHLARAGGAMTSDEVEFQMKTAFDWLRVDRVEYRRFAAVLILKEMAENASTVFNVHVPEFVDAIWVALRDPQLQVRERAVEALRACLRVIEKRETRWRVQWYYRMFEATQDGLGRNAPVHSIHGSLLAVGELLRVYSLMLEFVCRNTGEFMMSRYREVAEIVLRYLEHRDRLVRLSITSLLPRIAHFLRDRFVTNYLTICMNHILTVLRIPAERASGFIALGEMAGALDGELIHYLPTIMSHLRDAIAPRKGRPLLEAVACVGNIAKAMGSTVETHVRDLLDVMFSSSLSSTLVDALDQITISIPSLLPTVQDRLLDCISLVLSKSHYSQAKPPVTIVRGSTVGMAPQSSDPSCSAQVQLALQTLARFNFKGHDLLEFARESVVVYLDDEDAATRKDAALCCCRLIANSLSGITQFGSSRSTRAGGRRRRLVEEIVEKLLRTAVADADVTVRKSIFVALFGNQCFDDYLAQADSLTAIFASLNDEDLDVREYAISVAGRLSEKNPAYVLPALRRHLIQLLTYLELSSADNKCREESAKLLGCLVRNCERLILPYVAPVQKALVARLSEGTGVNANNNIVTGVLVTVGDLARVGGLAMRQYIPELMPLIVEALMDGAAVAKREVAVSTLGQVVQSTGYVVTPYKEYPLLLGLLLKLLKGDLVWSTRREVLKVLGIMGALDPHVHKRNQQSLSGSHGEVPRGTGDSGQPIPSIDELPVELRPSFATSEDYYSTVAINSLMRILRDASLLSYHKRVVRSLMIIFKVLPELFHTVRTSDENLKDFITWGLGTLVSIVRQHIRKYLPELLSLVSELWSSFTLPGPIRPSRGLPISYGEYFASLTDNQVLHLLEHLCLALNDEFRTYLPVILPCFIQVLGDAERFNDYTYVPDILHTLEVFGGTLDEHMHLLLPALIRLFKVDAPVAIRRDAIKTLTRVIPCVQVTGHISALVHHLKLVLDGKNDELRKDAVDALCCLAHALGEDFTIFIESIHKLLLKHRLRHKEFEEIHARWRRREPLIVATTATQQLSRRLPVEVIRDPVIENEIDPFEEGTDRNHQVNDGRLRTAGEASQRSTKEDWEEWMRHFSIELLKESPSPALRTCAKLAQLQPFVGRELFAAGFVSCWAQLNESSQKQLVRSLEMAFSSPNIPPEILATLLNLAEFMEHDEKPLPIDIRLLGALAEKCRVFAKALHYKEMEFEGPRSKRMDANPVAVVEALIHINNQLHQHEAAVGILTYAQQHLDVQLKESWYEKLQRWDDALKAYTLKASQTTNPHLVLEATLGQMRCLAALARWEELNNLCKEYWSPAEPSARLEMAPMAAQAAWNMGEWDQMAEYVSRLDDGDETKLRGLASPVSSGDGSSNGTFFRAVLLVRRAKYDEAREYVERARKCLATELAALVLESYERAYSNMVRVQQLSELEEVIEYYTLPVGNTIAEERRALIRNMWTQRIQGSKRNVEVWQALLAVRALVLPPTEDVETWLKFASLCRKSGRISQAKSTLLKLLPFDPEVSPENMQYHGPPQVMLGYLKYQWSLGEERKRKEAFTKLQILTRELSSVPHSQSDILASMVSSKGANVPLLARVNLKLGTWQWALSSGLNDGSIQEIRDAFDKSTCYAPKWAKAWHTWALFNTAVMSHYISRGQIASQYVVSAVTGYFYSIACAANAKGVDDSLQDILRLLTLWFNHGATADVQTALKTGFSHVNINTWLVVLPQIIARIHSNNRAVRELIQSLLIRIGENHPQALMYPLLVACKSISNLRRAAAQEVVDKVRQHSGALVDQAQLVSHELIRVAILWHEMWHEALEEASRLYFGEHNIEGMLKVLEPLHDMLDEGVKKDSTTIQERAFIEVGNFNPGFLAYRHELKEAHECCCNYKITGKDAELTQAWDLYYHVFKRIDKQLASLTTLDLESVSPELLLCRDLELAVPGTYRADAPVVTISSFSRQLVVITSKQRPRKLTIHGNDGEDYAFLLKGHEDLRQDERVMQLFGLVNTLLENSRKTAEKDLSIQRYSVIPLSPNSGLIGWVPNCDTLHHLIREHRDARKIILNQENKHMLSFAPDYDNLPLIAKVEVFEYALENTEGNDLSRVLWLKSRSSEVWLERRTNYTRSLAVMSMVGYILGLGDRHPSNLMLHRYSGKILHIDFGDCFEASMNREKFPEKVPFRLTRMLVKAMEVSGIEGNFRSTCENVMQVLRTNKDSVMAMMEAFVHDPLINWRLFNFNEVPQLALLGNNNPNAPADVEPDEEDEDPADIDLPQPQRSTREKEILQAVNMLGDANEVLNERAVVVMARMSHKLTGRDFSSSAIPSNPIADHNNLLGGDSHEVEHGLSVKVQVQKLINQATSHENLCQNYVGYVPLHFYTPKPRLL

SEQ ID NO: 622 - protein, 112 aa, Escherichia coli
MKKIDAIIKPFKLDDVREALAEVGITGMTVTEVKGFGRQKGHTELYRGAEYMVDFLPKVKIEIVVPDDIVDTCVDTIIRTAQTGKIGDGKIFVFDVARVIRIRTGEEDDAAI

SEQ ID NO: 623 - protein, 266 aa, Arabidopsis thaliana
MTADSQSDYAFLESIRRHLLGESEPILSESTASSVTQSCVTGQSIKPVYGRNPSFSKLYPCFTESWGDLPLKENDSEDMLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDRLLVL

SEQ ID NO: 624 - protein, 241 aa, Arabidopsis thaliana
MASSSSSSYRFQSGSYPLSSSPSLGNFVERIKDACHFLVSAVLGTIISAILTFFFALVGTLLGALTGALIGQETESGFIRGAAIGAISGAVFSIEVFESSLDLWKSDESGFGCFLYLIDVIVSLLSGRLVRERIGPAMLSAVQSQMGAVDTAFDDHTSLFDTGGSKGLTGDLVEKIPKMTITGNNNTDASENTDSCSVCLQDFQLGETVRSLPHCHHMFHLPCIDNWLLRHGSCPMCRRDI

SEQ ID NO: 625 - protein, 207 aa, Arabidopsis thaliana
MRGVSELEVGKSNLPAESELELGLGLSLGGGAWKERGRILTAKDFPSVGSKRSAESSSHQGASPPRSSQVVGWPPIGLHRMNSLVNNQAMKAARAEEGDGEKKVVKNGELKDVSMKVNPKVQGLGFVKVNMDGVGIGRKVDMRAHSSYENLAQTLEEMFFGMTGTTCRETVKPLRLLDGSSDFVLTYEDKGIGCLLEMFHGECLSTR

SEQ ID NO: 626 - protein, 931 aa, Zea mays
MEAEAAAAVVASSASASASAGRSRPSSSAAQVTSNSAVRAGEENAASLYVLSVIDSLKKRITADRLTYIKNRIGENKTNISSYTQRTYNLSKNRQISTSKGTDSASNLLTKRQDDALCTLHSLDIIPVDKDGGTFQDESPFSSSNVMFGGNLGPKNAIIRPIKLPEVPKLPPYTTWIFLDRNQRMTEDQSVLGRRRIYYDTSCGEALICSDSEDEAIEDEEEKKEFKHSEDHIIRMTVQECGMSDAVLQTLARHMERAADDIKARYEILHGEKTKDSCKKGTEHNVKVEDLYCDKDLDAALDSFDNLFCRRCLVFDCKLHGCSQDLVFPTEKQPAWSGVDDSVPCGIHCHKLASEPDSAAGADHMLFDVEEPTHSSDNVMNQPGSNRKKNGSSGRKTKSQQSESSSTARVISESSDSEVHPISNKSPQHSPSPSKVKIGPKGGIRKITNRRIAERILMSVKKGQREMASSDSNFVSGYLLARDMKLRSDTRNGNKELIVSSQQSSPSTRSSKKKSTPQIGNSSAFAEAHNDSTEEANNRHSATDGYDSSRKEEFVNENLCKQEVYLRSWKAIEQGLLVKGLEIFGRNSCLIARNLLGGMKTCKDVFQYMNYIENNSASGALSGVDSLVKGYIKGTELRTRSRYFRRRGKVRRLKYTWKSAGYNFKRITERKDQPCRQYNPCGCQSTCGKQCPCLSNGTCCEKYCGCPKICKNRFRGCHCAKSQCRSRQCPCFAADRECDPDVCRNCWVGCGDGTLGVPNQRGDNYECRNMKLLLKQQQRVLLGRSDVSGWGAFLKNSVSKHEYLGEYTGELISHKEADKRGKIYDRENSSFLFNLNNEYVLDAYRMGDKLKFANHAPDPNCYAKVIMVTGDHRVGIFAKERILAGEELFYDYRYEPDRAPAWARKPEASGAKDDGQPFNGRAKKLAQNNRG

SEQ ID NO: 627 - protein, 898 aa, Zea mays
  unsure (1)..(898): unsure at all Xaa locations
MEAEAAAAVVASSASASASAGRSRPSSSAAQVTSNSAVRAGEENAASLYVLSVIDSLKKRITADRLTYIKNRIGENKTNISSYTQRTYNLSKNRQISTSKGTDSASNLLTKRQDDALCTLHSLDIIPVDKDGGTFQDESPFSSSNVMFGGNLGPKNAIIRPIKLPEVPKLPPYTTWIFLDRNQRMTEDQSVLGRRRIYYDTSCGEALICSDSEDEAIEDEEEKKEFKHSEDHIIRMTVQECGMSDAVLQTLARHMERAADDIKARTCVLMDISAHXDADXVFDCKLHGCSQDLVFPTEKQPAWSGVDDSVPCGIHCHKLASEPDAAAGADHMLFDVEEPTHSSDNVMNQPGSNRKKNGSSGRKTKSQQSESSSTARVISESSDSEVHPISNKSPQHSPSPSKVKIGPKGGIRKITNRRIAERILMSVKKGQREMASSDSNFVSGYLLARDMKLRSDTRNGNKELIVSSQQSSPSTRSSKKKSTPQIGNSSAFAEAHNDSTEEANNRHSATDGYDSSRKEEFVNENLCKQEVYLRSWKAIEQGLLVKGLEIFGRNSCLIARNLLGGMKTCKDVFQYMNYIENNSASGALSGVDSLVKGYIKGTELRTRSRYFRRRGKVRRLKYTWKSAGYNFKRITERKDQPCRQYNPCGCQSTCGKQCPCLSNGTCCEKYCGCPKICKNRFRGCHCAKSQCRSRQCPCFAADRECDPDVCRNCWVGCGDGTLGVPNQRGDNYECRNMKLLLKQQQRVLLGRSDVSGWGAFLKNSVSKHEYLGEYTGELISHKEADKRGKIYDRENSSFLFNLNNEYVLDAYRMGDKLKFANHAPDPNCYAKVIMVTGDHRVGIFAKERILAGEELFYDYRYEPDRAPAWARKPEASGAKDDGQPFNGRAKKLAQNNRG

SEQ ID NO: 628 - protein, 333 aa, Zea mays
MSKAKVYTDVNVLRPKEYWDYEALTVQWGEQDDYEVVRKVGRGKYSEVFEGINVNNYEKCIIKILKPVKKKKIKREIKILQNLCGGPNIVKLLDIVRDQHSKTPSLIFEFVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYHIELDPQLEALVGRHSRKPWSKFMNADNQHLVSPEAIDFLDKLLRYDHQDRLTAREAMAHPYFLQVRAVENSRTRPQ

SEQ ID NO: 629 - protein, 485 aa, Zea mays
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 630 - protein, 636 aa, Zea mays
MMESCDCIDTQYPPDELLVKYQYISDVLIALAYFSIPVELIYFVQKSAFFPYRWVLMQFGAFIVLCGATHFINLWTFSPHSKSVAVVMTIAKVSCAIVSCATALMLVHIIPDLLSVKRRESILKNKAEELDREMGLILTQEETGRHVRMLTHEIRSTLDRHTILKTTLVELGRTLGLEECALWMPSRSGLNLQLSHTLTYHVQVGSTVQTNNPIVNEVFNSPQAMRIPPTCPLARIRPLVGRYVPPEVVAVRVPLLNLSNFQINDWPDISAKSYAIMVLILPTDSVRKWRDHELELVDVVADQVAVALSHAAILEESMRARDQLMEQNVALDLARREAEMAIHARNDFLAVMNHEMRTPMHAIIALSSLLLETELTPEQRVMIETVLKSSNVLATLINDVLDLSRLEDGSLELEMGKFNLHGVLGEIVELIKPIASVKKLPITLILSPDLPTHAIGDEKRLTQTLLNVVGNAVKFTKEGYVSVRVSVAKPESSQDWRPPEFYPASSDGHFYIRVQVKDSGCGILPQDIPHLFTKFAQSRSGPARPSSGAGLGLAICKRFVNLMGGHIWIESEGLDKGSTATFIVKLGICGNPDPSDHQAANRSQAYSGSGGLARFKPFITDENDTGFSTRRNQRSF

SEQ ID NO: 631 - protein, 157 aa, Zea mays
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGYGGGRRDGGYGGGGGYGGRREGGGGGYGGGGGYGGRREGGGGGYGGGGGGWRD

SEQ ID NO: 632 - protein, 443 aa, Zea mays
MVSPGSNRGGLSRVSTRGGVAGPGSPRASPAATAFAALRRRWRWAPPGSSTLERAARAFLLASAALVLSCALYLYVLRYVGRGGRAFAAAGFVGDAVLGLGGEPCDVFDGAWVPDDTGLRPLYNSSGCPFAERGFDCLANGRNDTGYLKWRWKPRRCGVPRFAARTALERLRGKRVVFVGDSMSRSQWESFICMLMAGVDDPRTVFEVNGNEITKTIRHLAVRFASHGLTVEFFRSVFLVQEHPAPRHAPKRVKSTLRLDRMDNFSRKWVNSDVLIFNTGHWWTPTKLFDTGCYFQAGRSLKLGTSIDAGFRMALETWASWVQKRVDLNRTHVFFRTYEPSHWGDTSQKVCEVTEQPSSEAKGNDKSEFGAILADVVTNMKVPITVLNVTLMGSFRSDAHVGTWSYPPTILDCSHWCLPGVPDAWNELVFSYLLTNGWRNMAG

SEQ ID NO: 633 - protein, 393 aa, Zea mays
MKVLVLAVLALVAAASAAGQGEEGGGPPLPFALGAAPAGCDVAQGEWVRDDDARPWYQEWECPYIQPQLTCQAHGRPDKAYQSWRWQPRGCSLPSFNATLMLEMLRGKRMLFVGDSLNRGQYVSLLCLLHRAIPDGAKSFETVDSLSVFRAKNYDATIEFYWAPMLAESNSDDAVVHSADDRLIRGAPMDRHYSFWKGADVLVFNSYLWWVAGDKIQILRGADNDPSKDIVEMKSEEAYRLVLHQVVRWLERNVDPGKSRVFFVTASPTHTDGRAWGDDDAEGSSNCYNQTSPISAASSYRGGTSREMLRATEEVLATSRVPVGLVNITRLSEYRRDAHTQTYKKQWVEPTAEQRADPRSYADCTHWCLPGVPDTWNELLYWKLFFPSNDQVL

SEQ ID NO: 634 - protein, 430 aa, Zea mays
MRSTMKAQHANGRGSRSPFLTSYALTLAFITFVSVLYFKDFSSTLHRPFLHRPRRHAAPDKSQAGRRAAAERLPFAVGAAPAGCDVGRGEWVYDDAARPWYQEEECPYIQPQLTCQAHGRPDRAYQHWRWQPRGCSLPSFNATLMLEMLRGKRMLFVGDSLNRGQYVSLVCLLHRIIPESSKSMETVDSLTVFKAKDYNATIEFYWAPFLAESNSDDAVVHRIADRIVRGTSIEKHAKFWKGADILVFNTYLWWMTGQKMKILRNSFEDKSKDIIEMETEEAYEMVLNAVLKWVESNMNPRTSRTFFVTMSPTHTRSRDWGDDTDGNCYNQTAPIEDLSYWGPDTSKGLMRVIGEVFSASKSRIPVGVVNITQLSEYRKDAHTQIYKKQWNPLTPEQVADPKSYADCTHWCLPGLQDTWNELLYSKLFFP

SEQ ID NO: 635 - protein, 406 aa, Zea mays
MKKLHWLVRFLFGPVPVYFSALAILIVLTNAQYFGLVGVGVAPRTAKLASSAPVVSVMKYCDIFRGEWVPDAEAPYYNHKTCHMIQEHQNCLKYGRPDLGFLKWRWRPSGCELPRFDPLQFLQFARGKSLAFVGDSLARNHMQSLLCLLSQVAYPKDLSANPSDQNKVYHYRAYNFTISMFWSPFLVRAREPDHDGPAHTGHWSLYLDEPDDKWVSQMPRFDYVLVSAANWFSRPSLFYERRRLVGCSFCSRQYGVPDLTLYYSQRRAWRVALRAINDLERLRGRVIVRMLSPMSHFENGTWDHGGDCRRTQPLRANQTAMEGRDLHFYTAQMEEFRAAEKAAAEKGRRLMLMDATAAMLMRPDGHPSRYGHWPNEKVQLYNDCIHWCLPGPIDIWNDMLFQMLLA

SEQ ID NO: 636 - protein, 249 aa, Arabidopsis thaliana
MAYGKRPFGGDESEEREEDENLFPVFSARSQHDMRVMVSALTQVIGNQQSKSHDNISSIDDNYPSVYNPQDPNQQVAPTHQDQGDLRRRHYRGVRQRPWGKWAAEIRDPKKAARVWLGTFETAESAALAYDEAALKFKGSKAKLNFPERVQLGSNSTYYSSNQIPQMEPQSIPNYNQYYHDASSGDMLSFNLGGGYGSGTGYSMSHDNSTTTAATTSSSSGGSSRQQEEQDYARFWRFGDSSSSPHSGY

SEQ ID NO: 637 - protein, 158 aa, Arabidopsis thaliana
MEVSNSCSSFSSSSVDSTKPSPSESSVNLSLSLTFPSTSPQREARQDWPPIKSRLRDTLKGRRLLRRGDDTSLFVKVYMEGVPIGRKLDLCVFSGYESLLENLSHMFDTSIICGNRDRKHHVLTYEDKDGDWMMVGDIPWDMFLETVRRLKITRPERY

SEQ ID NO: 638 - protein, 387 aa, Arabidopsis thaliana
MASSPLTANVQGTNASLRNRDEETADKQIQFNDQSFGGNDYAPKVRKPYTITKERERWTDEEHKKFVEALKLYGRAWRRIEEHVGSKTAVQIRSHAQKFFSKVAREATGGDGSSVEPIVIPPPRPKRKPAHPYPRKFGNEADQTSRSVSPSERDTQSPTSVLSTVGSEALCSLDSSSPNRSLSPVSSASPPAALTTTANAPEELETLKLELFPSERLLNRESSIKEPTKQSLKLFGKTVLVSDSGMSSSLTTSTYCKSPIQPLPRKLSSSKTLPIIRNSQEELLSCWIQVPLKQEDVENRCLDSGKAVQNEGSSTGSNTGSVDDTGHTEKTTEPETMLCQWEFKPSERSAFSELRRTNSESNSRGFGPYKKRKMVTEEEEHEIHLHL

SEQ ID NO: 639 - protein, 348 aa, Arabidopsis thaliana
MASEDWDLFAVVRSCSSSVSTTNSCAGHEDDIGNCKQQQDPPPPPLFQASSSCNELQDSCKPFLPVTTTTTTTWSPPPLLPPPKASSPSPNILLKQEQVLLESQDQKPPLSVRVFPPSTSSSVFVFRGQRDQLLQQQSQPPLRSRKRKNQQKRTICHVTQENLSSDLWAWRKYGQKPIKGSPYPRNYYRCSSSKGCLARKQVERSNLDPNIFIVTYTGEHTHPRPTHRNSLAGSTRNKSQPVNPVPKPDTSPLSDTVKEEIHLSPTTPLKGNDDVQETNGDEDMVGQEVNMEEEEEEEEVEEDDEEEEDDDDVDDLLIPNLAVRDRDDLFFAGSFPSWSAGSAGDGGG

SEQ ID NO: 640 - protein, 249 aa, Arabidopsis thaliana
MACGGAIISDYAPLVTKAKGRKLTAEELWSELDASAADDFWGFYSTSKLHPTNQVNVKEEAVKKEQATEPGKRRKRKNVYRGIRKRPWGKWAAEIRDPRKGVRVWLGTFNTAEEAAMAYDVAAKQIRGDKAKLNFPDLHHPPPPNYTPPPSSPRSTDQPPAKKVCVVSQSESELSQPSFPVECIGFGNGDEFQNLSYGFEPDYDLKQQISSLESFLELDGNTAEQPSQLDESVSEVDMWMLDDVIASYE

SEQ ID NO: 641 - protein, 398 aa, Arabidopsis thaliana
MDKEKSPAPPCGGLPPPSPSGRCSAFSEAGPIGHGSDANRMSHDISRMLDNPPKKIGHRRAHSEILTLPDDLSFDSDLGVVGNAADGASFSDETEEDLLSMYLDMDKFNSSATSSAQVGEPSGTAWKNETMMQTGTGSTSNPQNTVNSLGERPRIRHQHSQSMDGSMNINEMLMSGNEDDSAIDAKKSMSATKLAELALIDPKRAKRIWANRQSAARSKERKTRYIFELERKVQTLQTEATTLSAQLTLLQRDTNGLTVENNELKLRLQTMEQQVHLQDELNEALKEEIQHLKVLTGQVAPSALNYGSFGSNQQQFYSNNQSMQTILAAKQFQQLQIHSQKQQQQQQQQQQQHQQQQQQQQQYQFQQQQMQQLMQQRLQQQEQQNGVRLKPSQAQKEN

SEQ ID NO: 642 - protein, 212 aa, Arabidopsis thaliana
MVSALSRVIENPTDPPVKQELDKSDQHQPDQDQPRRRHYRGVRQRPWGKWAAEIRDPKKAARVWLGTFETAEEAALAYDRAALKFKGTKAKLNFPERVQGPTTTTTISHAPRGVSESMNSPPPRPGPPSTTTTSWPMTYNQDILQYAQLLTSNNEVDLSYYTSTLFSQPFSTPSSSSSSSQQTQQQQLQQQQQQREEEEKNYGYNYYNYPRE

SEQ ID NO: 643 - protein, 720 aa, Zea mays
MEMNSSGEETVVKVRKPYTITKQRERWTEAEHKRFLEALKLYGRAWQRIEEHVGTKTAVQIRSHAQKFFTKLEKEAMNNGTSPGQAHDIDIPPPRPKRKPNSPYPRKSCLSSETQTKELPNDKSTKPNMPLSNGHVKMVGDASLQNFQRKELSEKGSRSEVLNLFRDAPSASFSSVNKSSSNHGAPRRTEASKTESRDMSIMENNSFNPNTQEDVKVISDQEMERLNGIQIRSKCEHSHEGYLDISTQQMKLMPKSVETTYVDEQTARASHTLAESNGTASVPVTVPEGTHPDQTSDQVGINGSMNPCIHPMVSADPKFGSSATPQTFPHNYAAFAPMMQCNCNQDTYRSFTNMSSTFSSMLVSTLLSNPAIHAAARLAASYWPAAEGNTPIDPNQENPADGVQGRNIGSPPSMASIVAATVAAASAWWATQGLLPFFAPPVAFPFVPAPSAAFPTVDVPRPSEKDRDCPVENAQNECQEARKQVQFEGLRVAASSESDGSGKGEVSLHTELKLSPAQNADATPTTGAGTNDAFRNKKKQDRSSCGSNTPSSSDVDAGNVPEEDNANEKAKQASCSNSSAGDTNHRRFRSNGSTSDSWKEVSEEGRLAFDALFSREKLPQSFSPPQAVDSKEVAKEEEDEVTTVAVDLNKNATSIDHDDLDTMDEPRASFPNELSHLKLKSRRTGFKPYKRCSVEAKENRVPTSDMVGTKRIRLDSEAST

SEQ ID NO: 644 - protein, 302 aa, Zea mays
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKTRGLDKEYEGNVEATGEDFSVEPADERRPFRALLDVGLIRTTTGNRVFGALKGALDGGLDIPHSEKRFAGFKKDDKQLDADIHRKYIYGGHVADYMRNLAEEEPEKYQSHFSEYIKKGIEADDMEALYKKVHAAIRADPSVVKSTKQPPKEHKRYNPKKLTYEQRKASLIERLNQLNSSGGADDDDEDDE

SEQ ID NO: 645 - protein, 257 aa, Zea mays
MAANFWTSSHCKQLLDPEDVDLVPAADRERGITPEEFRLIKIHMSFHIWRLAQQVKVRQRVVATAIAYFRRVYTRKSMSDYDPRLVAPTCLYLASKVEESTVQARLLVFYIKKMCGSDDKYRFEIKDILEMEMKLLEALDYYLVVFHPYRPLLQLLQDAGITDLTQFAWGLVNDTYKMDLILIYPPYMIALACIYIASVLKDKDTTAWFEELRVDMNIVKNISMEILDFYDTYKIDPQRGIPEDKISPVMNKLPAKA

SEQ ID NO: 646 - protein, 531 aa, Arabidopsis thaliana
MDKFSYNSYPDSAESSPRSRDVEFENPSPWEDQQQQNYKVKLMCSYGGKIQPRPHDNQLTYVNGDTKIMSVDRGIRFPALVSKLSAVCSGGGDGGEISFKYQLPGEDLDALISVTNDEDLEHMMHEYDRLLRLSTKPARMRLFLFPSSPISGGFGSEGSTKSDRDTLNPIPSRPESEKSVTAPPNNADFLFGSEKVAPIPPSPVKVPQPVPEPVVLEPPQMFVDQRMLQPEHGVNPAEIQRQIQEFQMIQIRDQEQQMLHQNQLHQQQQQQEAIHQNQLHHQQEVIHQNQLLQQEAIHQNQMLQQQQQQEAMYRRKTEDEAGRYFPPTYTQNPAPVTNQQPPVGYWQGNTNNSNIQGNIYTTTSQNLPEQQQQQQQVYMIPAQSQAPGTLYQSVMRPTVQGNQGYYPSPVQRLHHPDAYMEQQNQPGYNVVQPQPTFSGGPQVMTSVGPQVMTSVGPPMGLQEPYSQMGKPVYYTVAGEGMMVQPPPAQPQQQQQQYQGMGQPVSGMTDLRTGPDGKVAVNMAAPQVSDSV

SEQ ID NO: 647 - protein, 421 aa, Glycine max
MTSHSHYPPDLDADSVTSSPRSDHFHDAPPRIRFMCSFGGKILPRPHDNQLRYVGGDTRIVAVNRSITFSALILKLSKLSGMSNITAKYQLPNEDLDALISVTTDEDVENMMDEYDRVAHNQNPRSARLRLFLFPEGEDSRASSISSLLNGSAKRENWFLDALNGGVSGLERGRSEASSMVSEVPDYLFGLDNSEEITNHQRDPRPKPGPIIQDNVSVSDPGSPAPVVSSPYCSTSSAPPVPSLPNLPYVKTKPLNLNPVPDTDSKENQTEPETEPHPNLNLNQNPNMYSNNPVVHYPPEAAYSAHSVNPVPVYYVSGPVRPGSVPVPMQTPYHYVQQSYHAVVPPQVPIGYHPLVPGSGQVYGAGVRHMTPLQPYSPSTTAVVHDGLKQHVYHAVPNSGPVPVHPVIPMTGLDEPQRGGA

SEQ ID NO: 648 - protein, 476 aa, Glycine max
MENYQYPASYPDSGESSPRSREIDFENPPPWDEQQNQNYKAKFMCSYGGKIQPRTHDNQLSYVGGDTKILAVDRSVKFSAFLSKLSALCDSPPQDLTFKYQLPGEDLDALISVTNDDDLEHMMHEYDRLYRPNLKPVRMRLFLFTLSNSNPNSSFSSERDRFVEALNSGPVPSQPDPIKTPPVTPSNVDYLFGLDKAVAPPNLPPNFAAVKFHDPVPEPVAPTPVEYQSRVSDRVVGSDPNVNSMEIQRQMQQEMQRLQIAENEYRRRSEDGFATGYAAAAGGDYYMQKVQEKVPPQNAAVPPPAAYWSEKQFSGEGYQTTVTTAAPGGGDQPMYVMAAPGTFYHHSPVMRPPAAAQGYYAVQRMGSDGYREQQAVYGGMAAPKAGFSTAGMVKGPAYSEGYSGGVVRPAGLPDNAAYAQVAYDSASGRQVYYTAQGGVVHAPPQYQGGPPQDVRPGGVSVGQDGKVVNKVNQGSV

SEQ ID NO: 649 - protein, 641 aa, Glycine max
MDPPPLSAATQKNHPESVESFSPCFRVAETWTDETLPAVPGAKLRLMCSYGGHIMPRPHDKSLSYIGGDTRIVVVDRHSSLKDLCSRLSRTILNGRPFTLKYQLPNEDLESLITVTTDEDLDNMVEEYDRIMAKGSASSRLRVFLFFTKPEATVSMGSLLDDAKSETWFVDALNNSGMISRVVSDSAAGDSFVNLDGVGVGGVSASGSSNNLESLPDANKVKNFPEVVQVQSTPGSPMMENSSSSPSFSPSLVNLPPIRVHVDDNGSRLQQENKVGLVVEEQFAQMTIASGVKPDDGLVNVVSSAVAVPVIPASVTMASAGVITTSDNVMNRVVCEDDRSDPGFQKPPLPLQLVQPRTSGGVGLPSPDSVASDSSIAAANSFSKTVYYQDQVQAALLDNKIVAMPNAKSEISDQMIQVQGQLQDSGYTLPPQLDPNKQHFQQQKPFVHASTHYIHHPAATGPVPVSSYYPVYAPPQPQQLHPPIGQQQYPVYVMPVGPTQVTQPYNMALQPNIADPNVVASSRSLMPQSIVTSAAYKDGTPPIYPTKSVSSTMASNSGYAPIPTNQFQPQYVGLHQFHHPPQSIAVAPSSTTTNNNYGYEYGGHVQDQAYYTQQTTTAPLLPQYQSMTPAAAAAALSDASK

SEQ ID NO: 650 - protein, 619 aa, Zea mays
MPKHYRPAGKKKEGNAAKYITRTKAVNYLQVSLAIFRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHEWQAYISRTHSLRKTFISVKGIYYQAEVQGQKITWLTPHALQQVLTDDVDFNVMLSFLEFYETLLGFVNFKLYHSINVNYPPILDPRLEALAAELYALCRYMSAGSRRMIGNSQTDEVMEDKDEKSKAEEVIKEEKVVKNKASSKADESELRLAQLQHQLPTNEPGALMNLVEESTADDADDDDTKDCKGLFKNLKFYLSREVPRESLLFIIPAFGGTVSWEGEGAPFKEIDEDITHQIVDRPTQSHVFLSRDYVQPQWVFDCVNARIILPTEGYLVGRVPPPHLSPFVDNDAEGYMPEYAETIKRLQAAARNEVLPLPGIGDEDLDNSLVAAMMDRTASNEAAEKKRKLEMLEKQYIDELKKEIDGVAFSSLSNKEADKSPNAKDDTQSDREEDASKQEEDDDDDIGTALMSRKQRGLYKAMKMGKEKKKEKVELLKKRKKNADSGASSKKRH

SEQ ID NO: 651 - protein, 605 aa, Saccharomyces cerevisiae
MRIKKKNTRGNARNFITRSQAVRKLQVSLADFRRLCIFKGIYPREPRNKKKANKGSTAPTTFYYAKDIQYLMHEPVLAKFREHKTFARKLTRALGRGEVSSAKRLEENRDSYTLDHIIKERYPSFPDAIRDIDDALNMLFLFSNLPSTNQVSSKIINDAQKICNQWLAYVAKERLVRKVFVSIKGVYYQANIKGEEVRWLVPFKFPENIPSDVDFRIMLTFLEFYSTLLHFVLYKLYTDSGLIYPPKLDLKKDKIISGLSSYILESRQEDSLLKLDPTEIEEDVKVESLDASTLKSALNADEANTDETEKEEEQEKKQEKEQEKEQNEETELDTFEDNNKNKGDILIQPSKYDSPVASLFSAFVFYVSREVPIDILEFLILSCGGNVISEAAMDQIENKKDIDMSKVTHQIVDRPVLKNKVAGRTYIQPQWIFDCINKGELVPANKYLPGEALPPHLSPWGDAIGYDPTAPVEEGEEEESESESESEDQVEEEDQEVVAGEEDDDDDEELQAQKELELEAQGIKYSETSEADKDVNKSKNKKRKVDEEEEEKKLKMIMMSNKQKKLYKKMKYSNAKKEEQAENLKKKKKQIAKQKAKLNKLDSKK

SEQ ID NO: 652 - protein, 333 aa, Zea mays
MVVLSQPALNQFFLLKTCKPTPLFAGIPVVDLTDPDAKTHIVNACRDFGFFKLVNHGVPLQFMANLENETLGFFKKPQSEKDRAGPPDPFGYGSKRIGPNGDVGWVEYLLLNTNPDVISPKSQFIFREGPQNFRAVVEEYIRAVKNMCYEVLELMAEGLGITQRNVLSRLLKDEKSDSCFRLNHYPPCPEVQALNGRNLVGFGEHTDPQIISVLRSNSTSGLQICLTDGTWVSVPPDQTSFFINVGDTLQVMTNGRFKSVKHRVLADPTKSRLSMIYFGGPPLCEKIAPLPSLMLKGEESFYKEFTWWEYKKAAYASRLADNRLGPFEKSAAD

SEQ ID NO: 653 - protein, 586 aa, Zea mays
MGSYAYKYCMCFTRKFRSPDAQPPPDVRAAHLSFASDAHALRRFVAGVQGESPADVDRILAMLSGGHSHGIARLVTRSPAASTPTLEDFFAFLFSPDLNPPIAHQVHQDMSAPFSHYFVFTGHNSYLTGNQLNSDSSDVPIVKALQRGVRVIELDMWPNPSKDNVDILHGGTLTAPVEMIKCLKSIKEYAFCASNYPLVITLEDHLTSDLQAKVATMLTETFGDLLFVPNPDPMKEFPSPASLMKRIIISTKPPQEYKEFLKAENNRSGSGNIAELPDQGSLRRIDSNADESDGKDELDEQDEEDSDEDDPKFQQDTACEYRKLITIQAGKPKGHLRDALKVDPDKVRRLSLSETQLAKATISHGAEVIRFTQKNILRVYPKGTRVNSSNYDPMNAWTHGAQMVAFNMQGHDKALRLMQGFFRANGGCGYVKKPDFLLRTGPNGEVFDPKASLPVKKTLKVKVYMGDGWRMDFSKTHFDAFSPPDFYTRVGIAGVKADSVMKKTRVIEDQWVPMWDEEFTFLLTVPELALLRVEVQEYDMSEKHDFGGQTVLPVWELKQGIRAVPLHDRKGVRYKSVRLLMRFDFV

SEQ ID NO: 654 - protein, 714 aa, Zea mays
MLHPSWVGVSAHVSEYWSVIIATVVFAFVGAVTIYYTVNQLNKNISLSLIRAIKARAKRYKKSKDKVPAASHIWRKEVVSRSKGLKCCVCLKSVSPPQYSGGTIHQCDICGAAAHPSCSGNAHKDCKCVSMAGLGHVLHQWAVQWIDSADHSEEDSFCCHCDESCNGAFLAGSPVWYCMWCQRLVHVDCHSSLAKETGDICDLGPLKRLILSPLCVKELHWTGAGILSSITNGANELASSVRETIRIRSKRYKRGSASADSDSSGAIELPSDAEGDSQEVNSKAKVRDDHANCKLNEVHQSSESEKDKQLVPDNAATTNMSDVQRENSHVQNNQKYEIINVPSDSRPLLVFINKRSGAQSGDSLRQRLQILLNPVQVFELSKQQGPDVGLALFRKVTHFRVLVCGGDGTAGWVLDAIEKQKFETPPPVAILPAGTGNDLARVLCWGGGLGVIEKRGGLFSVLQDVEHAAVTVLDRWKITIKDNQGKLMRPPKFMNNYFGVGCDAKVALDIHNLREENPERFYSQFMNKVLYAREGAKNIMDNTFDCFPWDVKLEIDGSKIDIPQDSEGILVANIRSYMGGVDLWKNEDDVSDTYLPQSMHDKKLEVVSFTGMLHLGKLQVGLSRAKRLAQGHHIKVEVSTTMPIQVDGEPWSQEPGTIEVSHHSQAFMLKRVSEEPLGHAASVMADILENAESSGIISALQKRTLLQEIASRLL

SEQ ID NO: 655 - protein, 578 aa, Zea mays
MSNHNAPCDIPKPASVDEFLAKNGKKKKSFMSGLFRKKGRGADKKLLSRRDIVFDLEGRSGDRMDLLETSAAVRKSFSDRHCTTRIENLTLSCLDSPRRPNVDTREYRVFVGTWNVGGKPPDSSVNLQEFLQIEGLPDIYVLGFQEIVPLNAGNVLVVEDNEPAGKWMDLIYQALNRPPPHQDGQSSGDELSPPPSTSSSHYPSRPQGAARDPSNAAAIPKTSSGGMLCAQKPPPPLKMVSKCYRVDNALVKTCTCMSDPSTMQLRAREMREFLCRVEAAAASPGRGADDDALASIEGGDQRGGGGGMNYCLVARKQMVGIFLSVWVRRELVQYVGHLRVDCIGRGIMGRLGNKGCIAMSMTLHHTSICFVCCHLASGEKEGDEVRRNSDVAEILKNAQFPRICKVPGQRVPEKIIDHDRIIWLGDLNYRVSLSYEETKTLLEDNEWDILLEKDQLAMERQAGRVFKGWKEGKIYFAPTYKYKQNSDSYLWETAKSKKKRRTPAWCDRILWHGQGIEQLQYIRGEFRLSDHRPVCSVFVIEADVDSGSKIRKGYSTLDARIHCESPEIPKRHSFYDDF

SEQ ID NO: 656 - protein, 249 aa, Anabaena
MKPFLFVTDLDHTLVGNDAALAELSQILTHHRQEYGTKIVYATGRSPILYKELQVEKNLIEPDGLVLSVGTEIYLDGSGNPDSDWSEILNDGWNRELVLSVTKKFPELMLQPDSEQRPFKVSFFLHQEASFKVIPQLETELAKCKLNIKLIYSSGIDLDIVPLNSDKGQAMQFLRQKWKFAAERTVVCGDSGNDIALFAVGNERGIIVGNARPELLQWHSEYPADHRYLAKNFCAGGIIEGLQFFGFLE

SEQ ID NO: 657 - protein, 423 aa, Zea mays
MDKLSGSARLMIVSDLDHTMVDHHDEENLSLLRFGALWESVYCEDSLLVFSTGRSPTLYKELRKEKPMLTPDITIMSVGTEITYGEAMVPDDGWEEYLNNKWDRNIVVAETVSFSELKLQPETEQRPHKVSFFVDKKNAQEVIKSVAERLDKCGLDAKIIYSGGQDLDILPQGAGKGQALAYLLEKLSSCGKPPNNTLVCGDSGNDAELFSIPGVHGVMVSNAQEELLQWYTENAKDNPKIIHSNERCAAGIIQAIGHFKLGPNISPRDLQFPYAKEASFKPTDAVVKFYVLYEKWRRAEVPKSDSVIKYFKNITHANGVTIHPAGLELSLHASIDALGSCYGDKQGRKYRAWVDRLFITQTGSDSWVGRFDLWESEGDVRVCSLSSLALILKAESPEGFVLTHIQKTWLNGYSSGVEQAFKL

SEQ ID NO: 658 - protein, 473 aa, Zea mays
MATAAVSVDEKLDKLRAEVAKLDQISENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTIIAKPGVKLEIPDGDVLENKDVNGPEDL

SEQ ID NO: 659 - protein, 661 aa, Glycine max
MEGENASKVIELVNEIASISEYRPPVKKQYCNLARRLKLLIPMFEEIRDMNKDALPEDTSNAVLAFKEALQSARELLRFGSEGSKLYLVLERDDIMNKFYEVTAQLEQSLGGISHDKLDISDEVKEQVELVLAQFRRAKGRVDEPDVRLYEDMLSVYNSSSDAATDPSVLSQLAEKLQLMGIADLTQESLALHEMVASSGGDPGARIEKMSMLLKKIKDFVQIENLVKDDNLGGKGIFSKVYGLGTNEKSHQAPVIPDDFRCPISLELMKDPVIVSTGQTYERTCIEKWLQAGHGTCPKTQQTLTSTVLTPNYVLRSLIAQWCEANGIEPPKRPSDSQPSKSASAYSPAEQSKIESLLQKLTSVSPEDQRSAAGEIRLLAKRNADNRVAIAEAGAIPLLVGLLSVPDSRTQEHAVTALLNLSIYENNKGSIVSSGAVPGIVHVLKKGSMEARENAAATLFSLSVIDENKVTIGSLGAIPPLVTLLSEGNQRGKKDAATALFNLCIYQGNKGKAVRAGVIPTLMRLLTEPSGGMVDEALAILAILASHPEGKATIRASEAVPVLVEFIGNGSPRNKENAAAVLVHLCSGDQQYLAQAQELGVMGPLLELAQNGTDRGKRKAGQLLERMSRLVEQQQEVPIQTETQAQNEDTQPPLITNPDDS

SEQ ID NO: 660 - protein, 431 aa, Glycine max
MVLSWSRRNVFRRAKKEKSQTQLEVEVVIPNHFHCPVSLELMTDPVTLSTGITYDRVSIEKWIEGGNRTCPVTNQVLTTFDIIPNHAIRRMIQDWCVENSSYGIDRIPTPRIPISAYEVSDTCTRILSACQRGDDKRCQELVGKIKVWSRESERNKRCIVGAGAGAVLAYAFDCFSSNSIEKHVVLLEEVLEVMTWMVPLGEEGVSKLSSGASLNSLVWFLEGKDLASRQSAALLLKEVCVQELAKVGEVVEALVKMVREPIGSTSTKACLATIFNLVSLAANREGIAQRFVELGLVSLLLEAIVDGEKGVCEKALGVLDCICDCEKGKEVVKSNALALPLVVRKLLRVSPLASGFAVSILRKICDKREEGILIEALQVGLFQKLLVLLQVGCDESPKENATGLLKLLNGYRNKAECTDSSLNFEHLKKPF

SEQ ID NO: 661 - protein, 676 aa, Glycine max
MTQRDRRTLSFPAVHPCEAISPPTLVTSLITLSQSICNFQPQSFPTQRRNARETIRQISIVLMFLQEIRLIPNSTILSLAELHFTLQKIHFLLQDCTLQGSRLLLLAKSQHVASLFPALLRSVATSLDVLPLHQLHLCPEVRELADLVTKQASKAKFQLDPSDARATKTLHTLLRQFSMGTEPDLTSMQGILHYLQIRTWTDCNTEIKFLEEEITLECRDREEKEVPLLSSLVGFLCYCRGVIFETNQSQGRCSTEMTSLNLTLLTSVNPDDFRCPISLELMTDPVTVSTGQTYDRASIQKWLKAGNTNVPKTGEKLTNTDLVPNTTLKRLIQQFCADNGISVANSCNRKTNTVSAGSPAAAHAIQFLAWFLTRRLAFGTQDQKHKAAQEIRFLARTSIFNRACLIEMGTVPPLIELLASASNDNKSTQETTISALLKLSKHPNGPKNIINSGGLTVILSVLKNGLSLEARQVAAATIFYLSSVKEFRKLIGENPDVIPALVELVKEGTTCGRKNAVVAIFGLLLLPRNHQRVIAAGAVPALLDIIASSNKDELVTESLAVLAALAENVDGAREILQGSALRLIVGMLRSATSREGKEHSASILLSLCVNVGAEVVAVLAKEPSLMPLLYSLLTDGTCHAAKKARFLIKVIQDFHETRSAGLKGSSLPQERSLHVW

SEQ ID NO: 662 - protein, 526 aa, Zea mays
MICAISGEVPDEPVVSKKSGLLFERRLIERYIEDHGKCPITKDELTMDDIVPVNTNKVVKPRPLQAASIPGLLGIFQNEWDALMLSNFALEQQLHTARQELSHALYQHDAACRVIARLKKERDEARALLAQAERQIPASVAGAAPAAVVSNGKRAMEDEIGPDGKKIRPGINPVMIDELTECNTMLSAQRKKRQVPPTLAPLDALERYTQISSHPLHKTNKPGILSMDVHPSKDVVATGGIDTNAVIFDRSSGQILCTLTGHSKKITTLKFVPRDQLFVTGSADKTVRIWQENENGNYNCVHTLKDHTAEVEAVTVHATQKYFVSASKDNSWCFYDISTGSCLTQVGEASGQEGYTSASFHPDGLILGTGTTDAVVKIWDVKTQSNVAKFEGHVGPVTAMSFSENGYFLATAAHDGVKLWDLRKLRNFRTFSPYDSDTPTNTVEFDFSGNYLAIGGSDIRVYQVANVKAEWNLIKTLPDLSGTGKVTSVKFGADAKYIAVGSMDRNLRIFGLPGDDQMEESTTAAE

SEQ ID NO: 663 - protein, 360 aa, Zea mays
MEAWPDDFRCPITLEVMTDPVILPSGHTFERRSIQSWLDGGHLTCPVTNLPLPPSPPLIPNHALRRLIAAVSPSAAASLVPAEGGAHARQEAVSAAAAAAVPARPASPVPALLRLAKSGAAGRKEVLESGSAAVLLRHAEAGDEAAARALLHLSLDGDDTRVGLVADGAVDALSAAVSRGGAAAASAATALTSLATVDVNKCTIGAHPSAIPALAGLLRRGGPRERREAATALYELCKLPENRRRAVREGAAPALADFAAAGSARAVEVLGLLARCREGRQELCRVPGVVSVLTGAAGSGNARAIEQALLVLNWICSESNELAVEAIKLQAFDLCEALVNDDNCKIAKNAVDLARTLEKA

SEQ ID NO: 664 - protein, 340 aa, Saccharomyces cerevisiae
MTAPLVVLGNPLLDFQADVTAEYLAKYSLKENDAILVDAKSGDAKMAIFDELLQMPETKLVAGGAAQNTARGAAYVLGAGQVVYFGSVGKDKFSERLLNENEKAGVKSMYQVQNDIGTGKCAALITGHNRSLVTDLGAANFFTPDHLDKHWDLVEAAKLFYIGGFHLTVSPDAIVKLGQHAKENSKPFVLNFSAPFIPHVFKDALARVLPYATVIIANESEAEAFCDAFQLDCANTDLEAIAQRIVKDSPVEKTVIFTHGVEPTVVVSSKGTSTYPVKPLDSSKIVDTNGAGDAFAGGFMAGLTKGEDLETSIDMGQWLAALSIQEVGPSYPSEKISYSK

SEQ ID NO: 665 - protein, 342 aa, Zea mays
MAASEGVLLGMGNPLLDISAVVDDAFLAKYDIKLNNAILAEEKHLPMYDELASNSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAATNNKVFLMNLSAPFICEFFCDAQEKVLPYADFIFGNETEAKIFAKVRGWETENVEEIALKISQLPLASGKQKRTAVITQGADPVVVAEDGKVKTFPVILLPKEKLVDTNGAGDAFVGGFLSRLVQGKSIEDCVTAGCYAANVIIQRPGCTYPEKPDFN

SEQ ID NO: 666 - protein, 341 aa, Glycine max
MELDGVLLGMCNPLLDISAVVDDAFLQKYGIKLNDAILAEDKHKPMYEELANNPNVEYIAGGATQNSIRVAQWMLQAPGATSYIGCIGKDKFGEEMKKKCTLDGVKVNYYEIDNTPTGTCAVCVVGGERSLVANLSAANCYKSEHLTRPENWALVEKAKYYYISGFFLTVSPDSIQLVAEHAAANNKIFMMNLSAPFICEFFKGALDKVLPYMDYVFGNETEARTFSKAQGWETDNVEEIALKISQLPKASEKHKRITVITQGADPVCVAEDGKVKLYPVILLPKEKLIDTNGAGDAFVGGFLSQLVKQKPIEECVRAGCYAANVIIQRPGCTYPEKPDFH

SEQ ID NO: 667 - protein, 333 aa, Synechocystis sp. PCC 6803
MGHKYDVYGMGNALVDMEFEVTPEQLASLGIDKGVMTLVEEARENELIAQLAQQRGKQSSGGSAANTLVSLAQLGGTGFYACKVGKDEAGAFYLQDLNDCGLDTNPHHETAGEGITGKCLVFVTPDADRTMNAFLGISGSLSVTEMDWSALKQSQYLYLEGYLVTSPSAKAACIEAKAIAEQSGVKTCLSLSDPNMAKFFQDGLKEMLGSGVDLLFANEAEALEMAGTSDLNQAIAYCKSIAKNFALTRGGAGSLIFDGENLLTIGTPKVQPIDTVGAGDMYAGGFLYGLTHGMDYEKAGQLASETAAKVVTCYGPRLDTEILQEILQSVQAV

SEQ ID NO: 668 - protein, 485 aa, Zea mays
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 669 - protein, 449 aa, Saccharomyces cerevisiae
MSAPAQNYKIADISLAAFGRKEIELAEHEMPGLMAIRKAYGDVQPLKGARIAGCLHMTIQTAVLIETLVALGAEVTWSSCNIYSTQDHAAAAIAASGVPVFAWKGETEEEYLWCIEQQLFAFKDNKKLNLILDDGGDLTTLVHEKHPEMLEDCFGLSEETTTGVHHLYRMVKEGKLKVPAINVNDSVTKSKFDNLYGCRESLVDGIKRATDVMLAGKVAVVAGYGDVGKGCAAALRGMGARVLVTEIDPINALQAAMEGYQVVTMEDASHIGQVFVTTTGCRDIINGEHFINMPEDAIVCNIGHFDIEIDVAWLKANAKECINIKPQVDRYLLSSGRHVILLANGRLVNLGCATGHSSFVMSCSFSNQVLAQIALFKSNDKSFREKHIEFQKTGPFEVGVHVLPKILDEAVAKFHLGNLGVRLTKLSKVQSEYLGIPEEGPFKADHYRY

SEQ ID NO: 670 - protein, 425 aa, Synechocystis sp. PCC 6803
MVATPVKQKYDIKDISLAPQGRQRIEWAAREMPVLKQIRERFAQEKPFAGIRLVACCHVTTETANLAIALHAGGADSLLIASNPLSTQDDVAACLVADYGIPVYAIKGEDNETYHRHVQIALDHRPNIIIDDGSDVVATLVQERQHQLSDIIGTTEETTTGIVRLRAMFNDGVLTFPAMNVNDADTKHFYDNRYGTGQSTLDGIIRATNILLAGKTIVVAGYGWCGKGVAMRAKGMGADVIVTEISPVPAIEAAMDGFRVMPMAEAAHQGDIFITVTGNKHVIRPEHFAVMKDGAIVCNSGHFDIEIDLKSLKEQAKEVKEVRNFTEQYILPNGKSIIVIGEGRLVNLAAAEGHPSAVMDMSFANQALACEHLVKNKGQLEPGMHSIPVEVDQEIARLKLQAMGIAIDSLTPEQVEYINSWASGT

SEQ ID NO: 671 - protein, 477 aa, Glycine max
MWSSTSSTAAIPSDEEPSESSSSSSFSTSLFNFSSGNPRIEETRGLMHLFPDDTPSTLPVGRKPLVCVVGVPNHMTYADFCQFCGSFIQHMLEMRIVRMDGMEDQYSVLVRFDDQDSTDSFYKHYNGRRFSSLEVEVCRVLFTLDVQYTGSIEHAQPSNATSTELPTCPVCLERLDQDTGGILTTICNHSFHCSCISKWADSSCPVCRYCQQQAEKSICFVCQTTENLWICVICGYVGCGRYKGGHAIIHWKETQHCYSLEVETKRVWDYVGDNYVHRLIQSKTDGKLIELNTQCAHADNGCGSCSCEDNAMNEAILNSKVEAIVNEYNELLATQLENQKLYFESLLQEVKEESERKISKAVQKAISLKQQKIQSKIDRCKKEKKFLDDLNENLVKNEDIWKTKILAIEEREKKTTRLMGDRVADLEMQLGDLMVCLEGGRTVEQLAASDEIKEGIILDKSIESSTTSGSDLVGRDA

SEQ ID NO: 672 - protein, 609 aa, Emericella nidulans
MYLSTVLFPLLALNLGLSHARFVRETLELTWEYGSPNGGTPREMVFTNGEYPGPDLIFDEDDDVEVLVINNLPFNTTVHWHGLEMRETPEADGVPGLTQTPIEPGATFTYRFRAYPAGTFWYHSHYKGLMQDGQVGAMYIRRKPDALRPYAVITEDPRELAEIQYAEDNPYLMLATDWTYLTSAEYHNIEVESGYNVFCVDSLLINGRGSVYCPGYQYLEEVSDTALLSVLEGTHLTEKGCLQPDLHNVQGDYGPWNLSAVPTEVVFNCTPSSVEPPVIYVDPEFNGWVSLNFIGGAAQKAITFSVDNHPMWVYEVDGQFVEPREVEMVGVYSGARYAVMIKLDQTPGDYAIRIAVNGADQVMSVYAILSYVNQDWIHRENVPKAAIGPHTDTVGYMNYGGGNTSADVRQLLFTENLPAFAVPPPPPSSEVSTTLRTGMIRVNNSYSWSLGNNVLYEPEMTSSTPLLFEPDPLAVIAPKYALTTENNTWVDIVLEITADPRDLIHPPHPIHKHGNRAYIIGNGVGKFRWENVSAAEAEVPDLFYVNETAALRDTFVTDFFDSRLMDGAWIVIRYFVQDKFPSILHCHIASHQMGGMALALLDGVDVWDS

SEQ ID NO: 673 - protein, 720 aa, Synechocystis sp. PCC 6803
MSYSSKYILLISVHGLIRGENLELGRDADTGGQTKYVLELARALVKNPQVARVDLLTRLIKDPKVDADYAQPRELIGDRAQIVRIECGPEEYIAKEMLWDYLDNFADHALDYLKEQPELPDVIHSHYADAGYVGTRLSHQLGIPLVHTGHSLGRSKRTRLLLSGIKADEIESRYNMARRINAEEETLGSAARVITSTHQEIAEQYAQYDYYQPDQMLVIPPGTDLEKFYPPKGNEWETPIVQELQRFLRHPRKPIILALSRPDPRKNIHKLIAAYGQSPQLQAQANLVIVAGNRDDITDLDQGPREVLTDLLLTIDRYDLYGKVAYPKQNQAEDVYALFRLTALSQGVFINPALTEPFGLTLIEAAACGVPIVATEDGGPVDIIKNCQNGYLINPLDEVDIADKLLKVLNDKQQWQFLSESGLEGVKRHYSWPSHVESYLEAINALTQQTSVLKRSDLKRRRTLYYNGALVTSLDQNLLGALQGGLPGDRQTLDELLEVLYQHRKNVGFCIATGRRLDSVLKILREYRIPQPDMLITSMGTEIYSSPDLIPDQSWRNHIDYLWNRNAIVRILGELPGLALQPKEELSAYKISYFYDAAIAPNLEEIRQLLHKGEQTVNTIISFGQFLDILPIRASKGYAVRWLSQQWNIPLEHVFTAGGSGADEDMMRGNTLSVVVANRHHEELSNLGEIEPIYFSEKRYAAGILDGLAHYRFFELLDPV

SEQ ID NO: 674 - protein, 562 aa, Saccharomyces cerevisiae
MTAVASTSGKQDADHNQSIECPRFSRGQKEILLDHEDAKGKDSIINSPVSGRQSISPTLSNATTTTTKSIMNATGTSGAVVSNTPEPGLKRVPAVTFSDLKQQQKQDSLTQLKNDSERTKSPNSNPAPVSNSIPGNHAVIPNHTNTSRTTQLSGSPLVNEMKDYDPKKKDSALKIVDTMKPDKIMATSTPISRENNKVTAKAPTSITLRKEDAQDQANNVSGQINVRSTPEETPVKQSVIPSIIPKRENSKNLDPRLPQDDGKLHVLFGATGSLSVFKIKPMIKKLEEIYGRDRISIQVILTQSATQFFEQRYTKKIIKSSEKLNKMSQYESTPATPVTPTPGQCNMAQVVELPPHIQLWTDQDEWDAWKQRTDPVLHIELRRWADILVVAPLTANTLSKIALGLCDNLLTSVIRAWNPSYPILLAPSMVSSTFNSMMTKKQLQTIKEEMSWVTVFKPSEKVMDINGDIGLGGMMDWNEIVNKIVMKLGGYPKNNEEEDDDEDEEEDDDEEEDTEDKNENNNDDDDDDDDDDDDDDDDDDDDDDDDEDEDEAETPGIIDKHQ

SEQ ID NO: 675 - protein, 229 aa, Saccharomyces cerevisiae
MGGILKNPLALSPEQLAQQDPETLEEFRRQVYENTQKNAKLTSHKRNIPGLDNTKEEGEIIGTSSTFLPKDTLSLKHEQDMLAKMTPEERVQWNQRNLAENEITKKQFQDIHIDEPKTPYQGAVDPHGEYYRVDDDEDEDNSDKKPCQVANDDIDDLSLGEPEFEIKENKQPDFETNDENDEDSPEARHKKFEEMRKKHYDVRAIFNKKSREALKDEDEDEDDSTTKEP

SEQ ID NO: 676 - protein, 212 aa, Zea mays
MAAHQDSAAAGGRPPRRPRVLLAASGSVAAIKFEVLCRSVAEWADVQAVATASALEFIDVASFPGGVPLYTDDQEWSSWKRVGDKVLHIELRRWADVLVIAPLSANTLAKVAGGLCDNLLTCVVRAWDYSKPVYVAPAMNTFMWDNPLPRATSPSCATSACPSSRRSMARWRSRRRSARPSCSSSVRNIFSSRQAPQFFAPLCMMRCVPCLT

SEQ ID NO: 677 - protein, 215 aa, Zea mays
MAAHQDSAASGSGPPRCPRVLLAASGSVAAIKFEVLCRSVAEWADVHAVATASALEFIDVASFPGGVPLYTDDQEWSSWKRVGDKVLHIELRRWADVLVIAPLSANTLAKVRRTHASWSSRSPSPVAADNSACCQVAGGLCDNLLTCVVRAWDYSKPVYVAPAMNTFMWGNPFTARHLAVLRDLGMSVVPPVNGAMAEPSEICKTLMLFFGPQHL

SEQ ID NO: 678 - protein, 165 aa, Zea mays
MSSHRVKWNEDNLYEIESNKPVRQKITEPKTPYHPMIDDDGSLSPTRPFDKCLDETVQAEAILTALNGVASSSISISKDDGWGSSDDDTDAIDQDADPEADTTRLSFKEHRRAHYDEYRKVKELMRTGSLTAEEADEDNRAATSSEDKGVGKGGPNDNMKPSPQT

SEQ ID NO: 679 - protein, 176 aa, Zea mays
MKGRVRWDEANIGEIEANKPVRQKITEPKTPYHPMIDDDSSLSPVRGSFDACIDNENRAEAIWSALNDVASSSRRGTGQSGGWTSSEDEPEAMEQDDDDSETDRNLSFKEHRKAHYDEFLKVKELQETGSLEDESDEDHNSQPSKAEKCESSSLSHSVKEMVIEGKKSSTPPANGS

SEQ ID NO: 680 - protein, 256 aa, Agrobacterium tumefaciens
MLQSGTLKCKVHNIKMNQGNGADYEIPVPFFLITHPAGHTVIDGGNAIEVATDPRGHWGGICDVYWPVLDKDQGCVDQIKALGFDPADVKYVVQSHLHLDHTGAIGRFPNATHIVQRSEYEYAFTPDWFAGGGYIRKDFDKPGLKWQFLNGAQDDYYDVYGDGTLTTIFTPGHAPGHQSFLVRLPNSKPLLLTIDAAYTLDHWEEKALPGFLASTVDTVRSVQKLRTYAEKHDATVVTGHDPDAWANFKKAPEFYA

SEQ ID NO: 681 - protein, 279 aa, Xylella fastidiosa
MITVTPFQTGTVRIKTAQQAGQDSKSGIGRKLDIFRDPNWTEVLPIFCFLIEHPEGRFLVDTGDTWRNSIPGYLPRWNPFLTKQVIVKVALHEEIGPQLLAKNIDPSRDVEAVILTHMHHDHAGGLDHFPHTRIIVTKENYDASRGFFGRVAGCLPQHWPIWLKPELIEPTGPAVGPFASSYPITRDGRIVLVPTPGHVKGHVSVLVRNDDLSIFIAGDATYAEDILRSGKVDGVTFDPVLSKDTLRRITEYATSTPTVIMPSHDPDGPARLVVRQTFI

SEQ ID NO: 682 - protein, 308 aa, Xanthomonas campestris
MSDDAVAMLARQARSVPMRVHHLNCISTCPLGGHLMDGRTHGVLERGHLSCHCLLVETNAGLVLIDTGFGLRDVAEPRARLSAFFLALVKPDLREDMTAIRQIQRLGFDPRDVRHIVLTHLDFDHAGGLDDFPHARVHLMTRERDAALAQHTWMDRQRFRPQQWSTRGQWRTYDSTSGAAWMGLECVHDLHGLPPEILLVPLPGHTFGHAAVAVRTPERWLLLAGDAYFYHREMDPQPYCTPGLRFYQWMLEKDRTARLHNQQRLRALRQQHGAEVEVFCSHDVVEFERVAGLPARLPAGALQHAPTA

SEQ ID NO: 683 - protein, 103 aa, Zea mays
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 684 - protein, 211 aa, Zea mays
MAAKMFALFALLALCATATSATHIPGHLSPLLMPLATMNPWMQYCMKQQGVANLLAWPTLMLQQLLALPLQPCQMPMMMPGMMPPMTMMPMPNMMPSMMVPTMMSPITIASMMPPMMMPNMVSPMMMPSMMPSTMTPSMMPPIMMPSMIPPMMMPSMVSSMIMPNMMTVPQCYSDSISHIIQQQQLPFMFSPTAMAISPMFLQQPFVGAAF

SEQ ID NO: 685 - protein, 473 aa, Zea mays
MAGEEAAEGSGTRRHMDLNLYLGLPPLPRPPVWLDPTLMPNLTGAAPESSITGEPEESLALGAAAYSPSNALSTPEEHPMLDPIVYSWLDGNRTDGEEDTDAPEPGPVDGANVSRSQLVVAATGLEGDDDLPLVRFVRPSQMVVAGGMETVNTSILQQSIQRAAAIEARTPELRFQRVIQISQQHRIVRPASVNRSQGAASTDADRLVWAIQRTHNSLEATRRQKLDDNNLCGNGSAKKDESCDCNSSFECNICLDPAKQPVVTPCGHLFCWPCLYQWLHAHSPHSECPVCKGEVLELNVTPIYGRGGEEGNSTNPDFPPRPRANRRESLRQQLQMTDTRGIATVVRQLIQNQGIISVLPSPTGIEMSVVPAGRQRARARRQQRQDNNASSSIHVVAQNMGNVAPESSNQIQLSHSNGDNAAQMVLAAPQQSSSVEQLSTSSTTAVILGEPGSSRRSRPSESPTIRRTRRRPQ

SEQ ID NO: 686 - protein, 374 aa, Zea mays
MSGGGVDGAPVAEFRQTVTHGGRFLQYNIFGNLFEITHKYQPPIMPIGRGAYGIVCSVMNSETKEMVAIKKIANAFDNHMDAKRTLREIKLLRHLDHENIIGIRDVIPPPVPQAFNDVYIGTELMDTDLHHIIRSNQELSEEHSQYFMYQILRGLKYIHSANVIHRDLKPSNLLVNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQFPRRPFVSLFPRMQPVALDLIERMLTFNPLQRITVEEALEHPYLERLHDVADEPICTDPFSFDFEQQALTEDQMKQLIFNEAIELNPNFRY

SEQ ID NO: 687 - protein, 397 aa, Zea mays
MDGGGQPPDTEMTDAGAGGGGQPSPPQQPAGGAGMMENIHATLSHGGRFIQYNIFGNVFEVTSKYKPPILPIGKGAYGIVCSALNSETAEQVAIKKIANAFDNKIDAKRTLREIKLLRHMDHENIVAIRDIIPPPLREAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEADLDFVNENARRYIRQLPCHARQSFPEKFPHVQPLAIDLVEKMLTFDPRQRITVEGALAHPYLASLHDISDEPVCSMPFSFDFEQHALSEEQMKDLIYQEALAFNPDYQ

SEQ ID NO: 688 - protein, 370 aa, Zea mays
MAMMVDPPNGIGNQGKHYYSMWQTLFEIDTKYVPIKPIGRGAYGIVCSSINRETNEKVAIKKIHNVFDNRVDALRTLRELKLLRHLRHENVIALKDIMMPIHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSEADLEFIDNPKARRYIKSLPYTPGVPLVSMYPHAHPLAIDLLQKMLIFDPTKRISVTEALEHPYMSPLYDPSANPPAQVPIDLDIDENISSEMIREMMWQEMLHYHPEVATAISMS

SEQ ID NO: 689 - protein, 588 aa, Zea mays
MQAPEQQPQQQQQRRKGSSEMDFFSEYGDANRYKIQEVIGKGSYGVVCSAVDQHTGDKVAIKKIHNIFEHLSDAARILREIKLLRLLRHPDIVEIKHIMLPPSRRDFKDIYVVFELMDTDLHQVIKANDDLTREHHQFFLYQMLRALKYIHTANVYHRDLKPKNILANANCKLKICDFGLARVAFNDTPTTVFWTDYVATRWYRAPELCGSFFSKYSPAIDIWSIGCIFAEILTGKPLFPGKNVVHQLDLMTDLLGTPSLDTVSRIRNEKARRYLSSMRKKQPVPFTEKFPKADPAALKLLQRLLAFDPKDRPTAEEALADPYFKGLAKVEREPSCQPITKMEFEFERKKATKEDVKELIFREILEYHPQLLKDYMNGTEKTNFLYPSAVDHFRRQFANLEENGGKSGAHAASSDRKHVSLPRTTTVHSNPIPPNGTSQVPQKIPTGRPGRVVGPVIPFENAAAVDPYSQRRVSRNPVLPPTTSNMSAYAYHRKSDNSDRELQQELEKDRMQYQPAQRFMDAKVVSQMSPDLRSSYYIPKGVPKADPADRTALHSSMIHGIAPFSGIAAVGGGYNKVNAVQYGVSRMY

SEQ ID NO: 690 - protein, 491 aa, Zea mays
MDFFTEYGEASQYQIQEVIGKGSYGVVAAAIDSHTGERVAIKKINDIFGNVSDAARILREIKLLRLLRHPNIVQIKHIMLPPTRREFKDIYVVFELMESDLHQVIKANDNLTPEHHRFFLYQLICALKYMHSAHVFHRDLKPRNILANSDSKLKICDFGLARASFNDSLSAIYWTDYVATRWYRAPELCGSFFSSYTPAIDIWSIGCIFAEVLTGTPLFPGRNVVHQLDLITDLLGTPSFRSLSQIHSDKAREYLLGMPRKRPIPFSHKFHNADPLALRLLERLLAFDPKDRPTAEEALADPYFSGLSKLELEPSAQPISKVDFEFEGRKLTKAGVREMIYREILEYHPQMLQEYIEGGDQIHFLYPSGVDRFQRQFAHLEENYRRGVASTPPRRQPTSLPRERVCSSEDGHSQDSDSEEQRAASYVARTTISPPRSQEEGGKLQPAYQSAAAAADSCAKSYLKGAASISSASRRTIKGDNGRKEKESPRL

SEQ ID NO: 691 - protein, 294 aa, Zea mays
MEQYEKVEKIGEGTYGVVYKALDKATNETIALKKIRLEQEDEGVPSTAIREISLLKEMNHGNIVRLHDVVHSEKRIYLVFEYLDLDLKKFMDSCPEFAKNPTLIKSYLYQILRGVAYCHSHRVLHRDLKPQNLLIDRRNNALKLADFGLARAFGIPVRTFTHEVVTLWYRAPEILLGARQYSTPVDVWSVGCIFAEMVNQKPLFPGDSEIDELFKIFRVLGTPNEQSWPGVSCLPDFKTAFPRWQSQDLAIIVPNLEPAGLDLLSKMLRYEPSKRITARQALEHEYFKDLEMVQ

SEQ ID NO: 692 - protein, 373 aa, Glycine max
MSAVESAEHNNIRGVPTHGGRYVQYNIYGNLFEVSRKYVPPIRPVGRGAYGIVCAAVNAETGEEVAIKKIGNAFDNRIDAKRTLREIKLLRHMDHANIMSIKDIIRPPQKENFNDVYLVSELMDTDLHQIIRSNQQLTDDHCRYFLYQLLRGLKYVHSANVLHRDLKPSNLLLNANCDLKIADFGLARTTSETDFMTEYVVTRWYRAPELLLNCSEYTAAIDIWSVGCILGEIITRQPLFPGKDYVHQLRLITELIGSPDDASLGFLRSDNARRYVKQLPQYPKQNFSARFPTMSPGAVDLLEKMLIFDPNRRITVDEALSHPYMSPLHDINEEPVCTRPFSFDFEQPSFTEEDIKELIWRESVKFNPATIYV

SEQ ID NO: 693 - protein, 371 aa, Glycine max
MATPVEPPNGIRTEGKHYYSMWQTLFEFDSKYVPIKPIGRGAYGIVCSSVNRETNEKVAIKKIQNAFENRVDALRTLRELKLLRHLHHENVIALKDIMMPVHRNSFKDVYLVYELMDTDLHQIIKSSQALSNDHCQYFLFQLLRGLKYLHSANILHRDLKPGNLLINANCDLKICDFGLARTNCSKNQFMTEYVVTRWYRAPELLLCCDNYGTSIDVWSVGCIFAELLGRKPIFPGSECLNQLKLIINILGSQREEDIEFIDNPKAKKYIKSLPYSPGSPFSRLYPNAHPLAIDLLAKMLVFDPTKRISVTEALQHPYMAPLYDPNCDPPAVIPIDLDIDEDLGEEMIREMMWKEMLHYHPESAMENAGLC

SEQ ID NO: 694 - protein, 362 aa, Zea mays
MDPWISSQPSLSLDLRVGLPPLSLHHQAPVAVALPRPKLLVEENFLLPPPKKEPEVRIYTLHSDPMCDASVAALETELQRMGEENRRLAEALAEVASKYEALRGQYTEMVAAAATACGNHPSSTSEGGSVSPSRKRKSESTDTAPPAQQLLHQHYPAVAPDQTECTSGEPCKRIREAECKPRVSKLHVHADPADLSLVVKDGYQWRKYGQKVTKDNPCPRAYFRCSFAPACPVKKKVQRSADDPTILVATYEGDHNHGQPPPQAQAPHDGSSPGASKKPPSPPRPVAAAPAPLHHQQVQQHQQQQAVGAVKCEPPVAAAASELIRRNLAEQMAMTLTRDPSFKAAFVTALSGRLFEMSPTKD

SEQ ID NO: 695 - protein, 311 aa, Glycine max
MDCSSWINTSLDLNINPRRVHEEVPKEVESELFSLGMTKFNVEEESTSDLEEELKRVTAENKKLAEMLSVVCENYNTLRNHLMECMRKNGEKEVSPTSKKRKSESSNNNSNLMGTNNGNSESSSTDEESCKKPREEIIKAKISRVYVRTEASDTSLIVKDGYQWRKYGQKVTRDNPCPRAYFKCSFAPSCPVKKKVQRSVDDQSVLVATYEGEHNHPQFSSQMEATSGSGRSVTLGSVPCTASLSTSTPTLVTLDLTKSQGSNDSKSTKPKGDSPKVPQVLVEQMATSLTTDPNFRAALVAAISGRLLHNN

SEQ ID NO: 696 - protein, 971 aa, Zea mays
MIVQPIELRAWTAFPGSAQEGIGRMAASVSRAICVQKPGSKCTRDREATSFARRSVAAPRPPHAKAAGVIRSDSGAGRGQHCSPLRAVVDAAPIQTTKKRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARGWGKCCVSGCSGIRVNDAEKLVTIGGHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKFATERGRKARPNLKVGICGEHGGEPSSVAFFAKAGLDYVSCSPFRVPIARLAAAQVLV

SEQ ID NO: 697 - protein, 539 aa, Saccharomyces cerevisiae
MPLNEKYERPPQPPPAYDPNHRPPSSSENSAAANVNDGQTPYHFRQDQYYNLNSKTSGAPIGSFDEAFPTENDNKPRWNDWPFTIFFLCTVGGFIAIAAITLRAWSQTYSSTGSGIYDGVNTGTLNTNAAILLVFVCIIALVFSVLGLTLCRIFPKQFIYCGMVINLVASLGTAIMYMSLRYWSAGIVFLVFTFMTAWCYWGMRSRIPLSVAVLKVVVDAMKKCPQIFFVSFVGALVASAFGFLFSAVIVATYIKYDPNSSNGGCDVSGGSCSHSKLIGVLVVVFFCGYYISEVIRNVIHCVISGVFGSWYYMSKSDQGMPRWPAFGALKRAMTYSFGSICFGSLLVALIDLLRQILQMIRHDVTSSGGGQIAIQILFMVFDWIIGFLKWLAEYFNHYAYSFIALYGKPYLRAAKETWYMLREKGMDALINDNLINIALGLFSMFASYMTALFTFLYLRFTSPQYNSNGAYNGALMAFSFVIALQICNIATEAIRSGTATFFVALGNDPEVFHHSYPHRFDEIFRAYPDVLRKLSHQNV

SEQ ID NO: 698 - protein, 563 aa, Saccharomyces cerevisiae
MSIRNDNASGGYMQPDQSSNASMHKRDLRVEEEIKPLDDMDSKGAVAADGEVHLRKSFSLWSILGVGFGLTNSWFGISTSMVAGISSGGPMMIVYGIIIVALISICIGTSLGELSSAYPHAGGQFWWSLKLAPPKYKRFAAYMCGSFAYAGSVFTSASTTLSVATEVVGMYALTHPEFIPKRWHIFVCFELLHLFLMFFNCYGKSLPIISSSSLYISLLSFFTITITVLACSHGKFNDAKFVFATFNNETGWKNGGIAFIVGLINPAWSFSCLDCATHMAFEVEKPERVIPIAIMGTVAIGFVTSFCYVIAMFFSIQDLDAVLSSTTGAPILDIYNQALGNKSGAIFLGCLILFTSFGCVIACHTWQARLCWSFARDNGLPLSRLWSQVNPHTGVPLNAHLMSCAWITLIGLLYLASSTAFQSLITGCIAFLLLSYIIPVICLLAKKRNIAHGPFWLGKFGFFSNIVLLGWTVFSVVFFSFPPVLPVTKDNMNYVCVVIVGYTAYSILYWKYKGKKEFHALEESENEQAEYSNNFDTIEDSREFSVAASDVELENEHVPWGKK

SEQ ID NO: 699 - protein, 258 aa, Xylella fastidiosa
MTQSRWRLDGRTALITGASTGIGLAVARELLGLGADVLLVARNADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDVYYYEQVIERTPMRRIGEPEEVAAAVAFLCLPASSYVTGECIAVDGGFMRYGF

SEQ ID NO: 700 - protein, 263 aa, Zea mays
MAPGGSGERWSLAGATALVTGGSKGIGQAVVEELARLGARVHTCARSAADLEECRRRWAEKGLRVTVSVCDVAVRADRERLVLDTVSAAFDGKLDILVNNAALLLLKPAAEWAAEDYARIMATNLESCLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGA

SEQ ID NO: 701 - protein, 269 aa, Glycine max
MAAEANFDSKSSRWSLQGMTALVTGGSKGIGYAIVEELAQLGATVHTCARNEAELNKSLNEWNTKGYRVTGSVRDVASRAERQDLIARVSNEFNGKLNILVNNVGTNIQKETLDFTEEDFTFLVNTNLESCFHLSQLAHPLLKASEAANIILISSIAGVVASNIVSVVYGATKGAMNQMTKHLACEWAKDNIRTNCVAPGPIRTPLGDKHFKEEKLNNSLIARTPLGRIGEAEEVSSLVAFLCLPAASYITGQTICVDGGFTVNGLYIS

SEQ ID NO: 702 - protein, 271 aa, Glycine max
MANPEGSSRGSRWSLKGTTALVTGGTRGIGHAVVEELAEFGATVYTCSRNEEELNACLKEWKEKGFSVSGLVCDASSPPHRENLIQQVASAFNGKLNILVNNVGTNVRKPTIEYTAEEYSKLMATNLDSTYHLCQLAYPLLKASGNGSIVSISSVASQTSVGSGAIYAATKAAIDQLTKYFACEWAKDNIRSNGVAPWYTITSLVEPLLANKQLVSEIISRTPIKRMAETHEVSSLVTFLCLPAASYITGQIVSVDGGFTANGFQPSMRIS

SEQ ID NO: 703 - protein, 262 aa, Emericella nidulans
MSDAYGGLSLRWTLRGKKALITGATKGIGLAVANEFLSLGAEVIIVARNSQDVDQQLIIWRELGLPAYGITADVATAEGRQAIFEQVGKTWDKLDILVNNVGTNISKKVLDYTAAEYQFIIQTNQISIFEMCRLFYPLLQNRENSSIVNISSVAGLVSNRTGAPYGMTKAAINQLTRSLSVEWACDQIRVNTVAPWAIRTPLTESVLDNQDFLKLVLSQTPMGRVGQPEEVAGLVAFLCMPAASFITGQCITVDGGFLAFGF

SEQ ID NO: 704 - protein, 80 aa, Zea mays
MARIGASHLLLVVLLLSAVLSSGSARVPRERPDAMLPAGQTAAMAEMTVPGEGQSSGPAFGVAAHESKRLSPGGPDPQHH

SEQ ID NO: 705 - protein, 78 aa, Zea mays
MKLVLCFCICVVLVIASSPVTLSDSRPAMGRRWLRDEVVIARGPEGNTTSAWSEEAPGMIPYDGSKRLSPGGPNPQHH

SEQ ID NO: 706 - protein, 96 aa, Zea mays
MVRNPLKARPTLVLISLLLMADLATVGYSRRVAELGALAVSDSGGGGGGSPPGKGCCLPNQSSSSASGRHLGDDCCKQMRIVSKRLVPQGPNPLHN

SEQ ID NO: 707 - protein, 446 aa, Zea mays
MMSRQCANRIFLTGGSSFLHGLKSRVASSRSHGTVRLNWRCVRTNLWRAERLGVKATPSEHIIAVLQASDIFSGIRKWSKLQLVAMTGVMACVVLVVPSSDAVDALKTCTCLLKECRIELAKCIANPSCAANVACLNTCNNRPDETECQIKCGDLFENSVVDEFNDCAVSRKKCVPKKSDVGEFPVPDPSSLVKSFNMADFNGKWYISSGLNPTFDTFDCQLHEFHVEGDKLIANITWRVRTPDSGFFTRSTVQRFVQDPSQPGILYNHDNEFLHYQDDWYIISSKVENKDDDYIFVYYRGRNDAWDGYGGSVLYTRSKTVPETIIPELERAAKSVGRDFSTFIMTDNTCGPEPPLVERIEKTVVEGEKTIVREVKEIEEEVEELEKEEASLFQKLAEGLMEVKQDFMNFLQGLSKEEMELLDQLNMEATEVEQVFSRALPLRKLR

SEQ ID NO: 708 - protein, 340 aa, Oryza sativa
MLVVVARKSSSSARVAAHQTRSHRAAMPAGQPHAHEPDGGGASHRRPQSPPSLPAEVVPAFAPPESEDEESWVWSQIKAEARRDADAEPALASFLYATVLSHPSLPRSISFHLANKLCSSTLLSTLLYDLFLASFTAHPSLRAAVVADLLAARSRDPACVGFSQCLLNFKGFLAIQAHRVSHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARNTAVGNPARLIGRKNGEVEKDEDMPGESMDHTSFIRQWSDYTI

SEQ ID NO: 709 - protein, 354 aa, Oryza sativa
MTSCGCLVLEKVEDHGGEAAGRGRGRLAQGGGGGGGGCGSCAGEWRSRSETMFPIYVMGSSRASSAAAARGIVDAAGDPIWEAVKSEAKSEAEKEPILSSFLYASVLSHDCLERALSFVLANRLEDPTLLATQLIDIFNDVMMNNKDIRRSIRLDAQAFKDRDPACAQYSWALLYLKGYHSVQSYRIAHVLWNQGRKVLALALQSRISEVFAVDIHPAARIGEGILLDHGTGLVIGETAIVGNWVSLMQGVTLGGTGKENGDRHPKIGQGALLGAGATILGNINVGEGAMIAAGSLVLKDVPPHSMAVGNPAKVVGYKDKEDPSLTMKHDARRDYFEHVAVSFSDDKANGSVVK

SEQ ID NO: 710 - protein, 580 aa, Zea mays
MEQRNVLALGEHVLKATVWKRKHKTAMEHPEGNDVMVFSQHDQRKHPVIFDDRAKCKKSKLISCGSGVILESYWNFKTSGLPVRVLFYQHGDWSDFPEDVVNLAQQDFQLKKPITTAVFQNKHILLDFIHMICIDYEMTIDKPLAWVDDNGKRFFPDLSAGLYTSKPSQHENGEADECDGTPTSVAESSSSVSVGEVVSHGKRINDIAEDNMRAHNILYEAVGENISGPSFHLNEYSSGTIQATGKPNDCRRIDSAVRNLLLKGLGQPFSEEDIIGIYRTPLLDQRGQVRCGLFQKEIEETRSRRGNANVRYAWLPCSRYTMEQMAMRGALEIAKPHKGSICGVGTCLAPANCTNSCARYSDFHEDGIIRMMLCRVIMGNVEVVLPGSKQFQPSNGSFDNGVDDLQNPQNYIVWDANVHKHIYAEYAVIVQAPLVTNECSGLKDSVPNISEIISSGSRDNLTKEDRFAPCGVEQEAPRLGRAPRAPSSPWMPFSMLFAAISTKVPRSDMELVIRYYEEFKRKRMSRSDLVVRMRQIVGDKILVSTIMRLHHQKKPPSMAAAAAGLARALARGEEGGGVAE

SEQ ID NO: 711 - protein, 333 aa, Triticum aestivum
MAAQNNKEVDALVEKITGLHAAIAKLPSLSPSPAVDALFTELVTACVPPSPVDVTKLGPEAQEMREGLIRLCSEAEGKLEAHYSDMLAAFDNPLDHLGMFPYYSNYINLSKLEYELLARYVPGGIAPARVAFIGSGPLPFSSFVLAARHLPDTMFDNYDLCGTANDRASKLFRADTDVGARMSFHTADVADLAGELAKYDVVFLAALVGMAAEDKAKVIAHLGAHMADGAALVVRSAHGARGFLYPIVDPQDITLGGFEVLAVCHPDDDVVNSVIIAQKSKDVHVSGLHSGRAVGGQSARGTVPVVSPPCRFGEMVAEVTQKREEFANAEVAF

SEQ ID NO: 712 - protein, 364 aa, Zea mays
MVVMGKEQQQHEEEEVQGKVVQEEVQVVQETVVPVPSEEDKEAEAALVHKISSLAAAIAKLPSLSPSPEVNALFTELVTACIPRSSVDVERLGPELQEMRGGLIRLCADAEALLEAHYSDLLASFDNPLEHLSLFPYINNYILLSQLEHGLLARHVPGPAPARVAFVGSGPLPLSSLVLAARHLPGASFDNYDICGEANDRARRLVRGDGALQARMAFRTSDVADVTRELASYDAVFLAALVGMAAEEKARVVAHLGRHMAPGAALVVRSAHGARGFLYPVVDPEEIRRGGFDVLAVHHPEGEVINSVIIARKPVAVDAHATGGVGHAHVHAHGAVLSRPCLCCEMEARAHQKMEEVAVEQLPS

SEQ ID NO: 713 - protein, 672 aa, Zea mays
MDQLRPEPAAGAHEIEKTAAPDVESEPAAAVPEPERVPPWREQVTARGMVAALLIGFVYTVIIMKLSLTTGLTPTMNVSAALLAFLALRGWTRALGRLGIACRPFTRQENTVVQTCVVACYTIGFGGGFGSFLLGLDKKTYELSGVSTPGNVPGSYREPAIGWMTGFLLAVSFVGLLTLLPLRKVLVIDYKLTYPSGTATAVLINGFHTPQGDKNAKIQVRGFLKYFGISFLWSFFQWFYTAGDHCGFAQFPTFGLQAFNQTFSFDFSLTYVGAGMICSHLVNLSLLFGAVVSWGVMWPLIGKQKGNWYPADASQNSMTGIYGYKAFLCIALLVGDGLYNFVKVIAITVKNIRERSRRKNLNRVADADTMALDDMQRDEVFNRDNIPTWLSYAGYAALSLIAVIAIPIMFREVRWYYVVVAYALAPALGFCNAYGTGLTDMNMGYNYGKVALFVLAAWAGKDSGVVAGLVGCGLVKQLVLVSADLMHDFKTGHLTLTSPRSMLVGQAVGTLMGCVLAPLTFMLFYRAFDVGEPDGYWKAPYALIYRNMAILGVEGFSALPRHCLQLCAGFFAFAVLANLARDLLPRRLARLVPLPMAMAVPFLVGASFAVDMCVGSLVVFAWHKLDGKKAALLVPAVASGLICGDGIWTFPSSLLALAKVKPPICMKFTPGS

SEQ ID NO: 714 - protein, 492 aa, Oryza sativa
MVLSHGVSGSDESVHSTFASRYVRTSLPRFRMPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLSDGYYVMDPAKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRSKEDLPEELIFHINYLGADQPTFTLNFSKGSSQVIAQYYQLIRLGFEGYKNIMENCQENAMVLKQGLEKTGRFNIVSKDNGVPLVAFSLKDSARHNEFEISDFLRRFGWIVPAYTMPPDAQHVTVLRVVIREDFSRTLAERLVLDVEKVLHELDALPARVVANGGDAAAASASEREMEKQREVISLWKRAVLAKKKTNGVC

SEQ ID NO: 715 - protein, 382 aa, Oryza sativa
MVVPSATTPARQETVVAAAPPAAAASGVVGGGGGVTIATVDMSAERGAVARQVATACAAHGFFRCVGHGVPAAAPVAARLDAATAAFFAMAPAEKQRAGPASPLGYGCRSIGFNGDVGELEYLLLHANPAAVAHRARTIDAMDPSRFSAIVNEYIEAMKKLACEILDLLGEGLGLKDPRYFSKLTTNADSDCLLRINHYPPSCNIHKLDHDDQCNIKSLVSTKASNGGNLMAGGRIGFGEHSDPQILSLLRANDVEGLQVFVPDHEGKEMWVQVPSDPSAIFVNVGDVLQALTNGRLISIRHRVIATACRPRLSTIYFASPPLHARISALPETITASSPRRYRSFTWAEYKTTMYSLRLSHSRLELFKIDDDDSDNASEGKA

SEQ ID NO: 716 - protein, 509 aa, Zea mays
MAAEQGRSLAETPTWSVATVTTLMVAACFLVERSLSRFAKWLRKTKRKAMLAALEKIREELMLLGVISLLLSQTARFISEICVPSSLFTSRFYICSESDYQDLLRNTDANQTALDKNMFGGQRLHVCGEGHEPFVSYEGLEQLHRFLFILGITHVLYSFVTVVLSMIKIYSWRKWETLAGPIAAEELKARRTKVMRRQSTFVFNNASHPWSKNKILIWMLCFLRQFKGSIIRSDYLALRLGFVTYHKLPHSYDFHKYMVRSMEDDYNGTIGISWPLWAYAIVCILINVHGINIYFWLSFVPVILVLLVGTELQHVIAQLALEVAEATAPYVGSQLKLRDDLFWFGKPRVLWWLIQFISFQNAFELATFLWSLWELSAQTCFMKHYYMVAIRLISGLLVQFWCSYSTLPLNVIISQMGSKFKKSLVSENVRESLHSWCKRVKDRSRHNPLFSRNGTLTTRSVCSLDTTYETDHETNTVCTLSRTASATSLDDQLTVVTVDDEPSCIEKDV

SEQ ID NO: 717 - protein, 370 aa, Zea mays
MSVLTCVIESMGSSCSRSHSFDEAEAAENAKSADIDRRILQETKAEQHIHKLLLLGAGESGKSTIFKQIKLLFQTGFDEAELRSYTSVIHANVYQTIKILYEGAKELAQVEPDSSKYVLSPDNQEIGEKLSEIGARLEYPSLNKERVQDVRKLWQDPAIQETYSRGSILQVPDCAQYFMENLDKLSEEDYVPTKEDVLHARVRTNGVVETQFSPLGESKRGGEVYRLYDVGGQRNERRKWIHLFEGVNAVIFCAAISEYDQMLFEDETKNRMMETKELFDWVLKQRCFEVPLSVCEWFKDYQPTAPGKQEVEHAYEFVKKKFEELYFQSSKPDRVDRVFKIYRTTALDQKLVKKTFKLIDESMRRSREGT

SEQ ID NO: 718 - protein, 334 aa, Zea mays
MAGAQESLSLVGTMRGHNGEVTAIATPIDNSPFIVSSSRDKSLLVWDLTNPVHSTPESGATADYGVPFRRLTGHSHFVQDVVLSSDGQFALSGSWDGELRLWDLSTGLTTRRFVGHEKDVLSVAFSVDNRQIVSASRDKTIKLWNTLGECKYTIGGDLGGGEGHNGWVSCVRFSPNTFQPTIVSGSWDRTVKVWNLTNCKLRCTLDGHGGYVNAVAVSPDGSLCASGGKDGVTLLWDLAEGKRLYSLDAGSIIHSLCFSPNRYWLCAATQDSVKIWDLESKHVVQDLKPDIQISKNQILYCTSLSWSADGSTLYTGYTDGSIRVWKISGYGYAG

SEQ ID NO: 719 - protein, 162 aa, Zea mays
MRGQANGVEDRRQRGDDHEADNDGEEAEEEEGDDEGRHRGQGPPQQRRHQAQRPNSGPQQQQQPRPPPPLARNVGYVGKHRLSAAIARLDQELQSLQEELDELETMESASAACQEVVTSTEGKPDPLLPVTSGPENSSWDRWFQRVRSRSNKWWASKGPDFS

SEQ ID NO: 720 - protein, 406 aa, Oryza sativa
MSFRSVIQEVKGEIGAISRRGFRSRPGRVRRVAAAAEEPPDESSAAALVMRESCWTQLPPELLREVLARVEESEGWWPRRRDVVACAGVCRSWRGIVREIVRTPEASGNLTFPISLKQPGPRDAPMKCFIVRNRTTQTYYLYIGLTDALTDDGKFLLAARKCRRTTCTEYLISLDMNDISKRTDSYVGKLRSNFLGTKFTIYDAHPPYAGDVISKGQSARVIGSNHLSPRIPAGNYPVSHISYELNVLGSRGPRRMHCAMDSIPVSAIEQGGTAPTQTEFPLSYHESFTSIPFFKSKSVRANNSTASLLTQNGSKLVLKNKSPRWHEHLQCWCLNFHGRVTVASVKNFQLVASDESNPTNQEHDDVILQFGKVGKDMFTMDYRYPISAFQAFAICLSSFDTKIACE

SEQ ID NO: 721 - protein, 358 aa, Zea mays
MPRDGAQAAPPPERGEMDEVVEADPDTEAEDQEERWARLLPELLSDVVRRVEASGGERWPARKDVVSCACVCRRWREAAVSVVRPPAESGKITFPSSLKQPGPRERPMQCFIKRNKNNSTFYLYLGFTSSPVDKGKFLMAARRFRRGPHTEYIISLDAEDLSQGSNAYMGKLRSDFWGTNFKIYDSKPPYDGAKASSSRSSRRFGSRRISPQVSAGNYEVGQVSYKYNLLKSRGPRRMYCTLECPSAQETWENSLKTKFRRPLGPTTLRNKAPRWHEHLQCWCLNFHGRVTVASVKNFQLVAAADPSEPTTNVDDETVLLQFGKVDSDMFTMDYRQPLSAFQAFAISLSSFGTKLACE

SEQ ID NO: 722 - protein, 448 aa, Zea mays
MPFRSIVRDVRDGFGSLSRRGFEVRFLSHRRGKSHGAVHELHDPVLVVQSSCWASLPPELLRDVIERLETSEDTWPSRKHVVACAAVCRTWREMCREIVKSPEFSGKITFPVSLKQPGPRDGTIQCFIKRDKSTQIYSLYLSFSSAVPVENGKFLLSAKRNCRATYTEYIISINSGDTSRCTSNNTYIGKLRSNFLGTKFVIYDTHPPYNGTSQTVAGKTSQRFYSKKGSTKVSCRWYSIAQISYELNVLGTRGPRRMNCVMHSIPASCLEAGGSVPCQPDSIAAHSVGGSFSSVSLSKSSTMDHSMHFTSSRLSDAITGDGIVNRGQALNDADDEECKDMPLILRNKAPRWHEQLQCWCLNFRGRVTVASVKNFQLVAATQPAAGALTPSQAAPQPAPPPPPDQEKVILQFGKVGKDIFTMDYCYPLSAFQAFAICLSSFDTKLACE

SEQ ID NO: 723 - protein, 367 aa, Zea mays
MVSWRRSASWLSSASRSSLGAAVGGEAKVTPEADPAAQHDEADEERWSRLLPELLTEIMRRVDAGAERWPPRRDVVVCACVCRRWRDAAVSVVRPPLECGRITFPSSLKQPGPRDAPMHCFIRRDKKISTFSLYLSLTQALTDKGKFLLAARRFRQGAHTEYIISYDYDDLHPRSSSYVGKLRSDFLGTKFIIYDTQAPYDGAKPSRTRSTRRFASKQISPQVSGGNFEVGQVTYRFNFMKSRGPRRMQCNIQCPVGQGSASDPSKEKTPSPSSLDLKNKAPRWHDHLQCWCLNFHGRVTVASVKNFQLVATAGSGGPWGVGDEETVILQFGKIEDDAFTMDYRQPLSAFQAFAICLTSFGTKLACE

SEQ ID NO: 724 - protein, 436 aa, Zea mays
MSLKSIVRELKEMRDGIGSMSRRGGSGSDGRAFHGRSGSRHSWPSLWAEQQQSHRQGQGLGPGPEGPHHQHQGRWANLPPELLLDVIQRVESSEATWPARRQVVACAAICRSWREVTKEVVKTLEECGRITFPISLKQPGPREMPVQCFVRRERATSTYLLYLGLSPSMNVEKDKLLLAARKVRRATRTYFVISLVSDDFSHSSSTYVGKLKPNFLGTKFTIFDSQPPPDAVVLPNNKTSKRQSKQVSPRLPLGNYNVATVTYELTVLRNRGPRRMQCTMHSIPAECIQEGGKAPTPTGAIQSLDEPVSSTLPSAKGKEVAVEFSSTSLSADLSGPACVNGTPLVLKNKAPRWHEQLQCWCLNFRGRVTVASVKNFQLVASVDPSLNIPAAEQEKVILQFGKIGKDIFTMDYRYPLSAFQAFAICLTSFDTKPACE

SEQ ID NO: 725 - protein, 401 aa, Zea mays
MSFRSLIQDMKDEFGSISRHSLRSRSHRSAGNAARAVAAGPSEAMDQSCWSQLPPELLREVLVRIEASESWWPARKDVVSGAGVCRTWRGIMKEAVRVPEVSGKLTFPISLKQPGPRDGTLKCFIRRNRTTQTYYLYIGLTEALADDGKFLLAARKCRKPTCTDYLISLDKVDMSKGSSTYIGKLRSNFLGTKFTVYDAHPPYDGAAVSKSRSARVVGLKQVSPRVPAGNYPVSHISYELNVLGSRGPRRMNCVMDSIPASAVKEGGKTPTQTEFPLSSLDSFPSFPFFRSKSARIDSSTSQSSSQREDRLVLKNKSPRWHEQLQCWCLNFRGRVTVASVKNFQLVASEDNGPESQESDKVILQFGKIGKDLFTMDYGYPISAFQAFAICLSSFDTKIACE

SEQ ID NO: 726 - protein, 456 aa, Zea mays
MSFRSIVRDVRESFGSLSRRSLEVRISGLPGLSGGHHRGKSVGSVSDLRDRPVVVDQSRWVGLPPELLRDVMRRLEEGESNWPSRKNVVACAAVCGTWREICKDIVLSPEFCGKLTFPVSLKQPGPRNGIIQCFIKRDKSTSTYYLYLCLSPVVLSEDGKFLLAAKRNRRTTYTEYIISVDPKSISRSSDGCVGKMRSNFLGTKFIVHDTRAPHNAGSLVSCERGSRRISSRRVSPKVPTASYPIARVNYELNLLGTRGPRRMNCTMHSIPASTLDPQGMVPEPGQPKQIFVPGSSSFEDSFRSANNTPSSSRFSVADRSLDWSSSRFSETSGLAQQDDDDSDQAKERPLVLCNKEPRWHEQLQCWCLNFHGRVTVASVKNFQLIAAPQLDSEPSQQAQQQTQPSNSSSASDHDKVILQFGKVANDMFTMDYRYPLSAFQAFAICLTSFDSKLACE

SEQ ID NO: 727 - protein, 595 aa, Oryza sativa
MGGEVPEPRRLNRALSFDDWVPDEALHLVMGHVEDPRDREAASRVCRRWHRIDALTRKHVTVAFCYAARPARLRERFPRLESLSLKGKPRAAMYGLIPDDWGAYAAPWIDELAAPLECLKALHLRRMTVTDADIAALVRARGHMLQELKLDKCIGFSTDALRLVARSCRSLRTLFLEECHITDKGGEWLHELAVNNSVLVTLNFYMTELKVAPADLELLAKNCKSLISLKMSECDLSDLISFFQTANALQDFAGGAFYEVGELTKYEKVKFPPRLCFLGLTYMGTNEMPVIFPFSMKLKKLDLQYTFLTTEDHCQIIAKCPNLLILEVRNVIGDRGLEVVGDTCKKLRRLRIERGDDDPGLQEEQGGVSQLGLTAVAVGCRELEYIAAYVSDITNGALESIGTFCKNLYDFRLVLLDRERQVTDLPLDNGVCALLRNCTKLRRFALYLRPGGLSDDGLSYIGQYSGNIQYMLLGNVGESDHGLIRFAVGCTNLQKLELRSCCFSERALSLAVLQMPSLRYIWVQGYRASQTGLDLLLMARPFWNIEFTPPSPESFNHMTEDGEPCVDSHAQVLAYYSLAGRRSDCPQWVIPLHPA

SEQ ID NO: 728 - protein, 590 aa, Zea mays
MGRGGARAAPAAAVPPWHALPDEVWEHAFSFLPADSDRGAAACACHAWLRFERRSRRRLAVANCYAASPRDAVERFPAVRAVEVKGKPHFADFGLVPPAWGADAAPWVAAAAAGWPLLEEISFKRMVVTDDCLEMIAASFRNFQVLRLVSCEGFSTAGLAAIAAACRNLRELDLQENEIEDCSIHWLSLFPVSFTSLVTLNFSCLEGDVNITVLEQLVTRCSNLKTLKLNNAIPLDKLANLLRKAPQIVELGTGRFSADYHPDLFSKLEAAFAGCKSLRRLSGAWDAVPEYLPAFYCVCEGLTSLNLSYATVRGPELIKFISRCKNLQLLWVMDLIEDHGLAVVASSCNKLQELRVFPSAPFEAAEQVSLTERGLVDVSASCPMLESVLYFCRRMTNEALITIAKNRPNFTCFRLCIIEPHTPDYITHQPLDAGFSAIVESCKGLRRLSVSGLLTDSVFKSIGAHADRLEMLSIAFAGNSDLGLHYILSGCKSLKKLEIRDCPFGDKPLLANAAKLETMRSLWMSTCSMTLGACRQLARKMPRLSVEVMNDPRRGFPLDSLTDESPVETLYVYRTISGPRSDTPACVQIL

SEQ ID NO: 729 - protein, 346 aa, Gossypium hirsutum
MAASSDPNPEGSDEQQKRSEIYTYEAPWHIYAMNWSVRRDKKYRLAIASLLEHYNNRLEIVQLDDSNGEIRSDPNLSFDHPYPPTKTIFIPDKECQKPDLLATSSDFLRIWRISDDHSRVDLKSLLNGNKNSEFCGPLTSFDWNEAEPKRIGTSSIDTTCTIWDIERETVDTQLIAHDKEVYDIAWGGVGVFASVSADGSVRVFDLRDKEHSTIIYESSEPDTPLVRLGWNKQDPRYMATIIMDSAKVVVLDIRFPTLPVVELQRHQASVNAIAWAPHSSCHICTAGDDSQALIWDLSSMSQPVEGGLDPILAYTAGAEIEQLQWSSSQPDWVAIAFSTKLQILRV

SEQ ID NO: 730 - protein, 461 aa, Zea mays
MTSSIPKLLLLLFFLSHRSPIARAGDDGSYKVLSMGSPRTDSVCSQSKAVPSSSAGAATVPLHHRHGPCSPLPTKKMPTLEETLHRDQLRAAYIQRKFSGGGGAGGDVQRSDATVPTALGTSLNTLEYLITVGLGSPATSQTMLIDTGSDVSWVQCKPCSQCHSQADPLFDPSSSSTYSPFSCGSADCAQLGQEGNGCSSSSQCQYIVTYGDGSSTTGTYSSDTLALGSSAVRSFQFGCSNVESGFNDQTDGLMGLGGGAQSLVSQTAGTLGRAFSYCLPPTPSSSGFLTLGAAGGSGTSGFVKTPMLRSSQVPTFYGVRLQAIRVGGRQLSIPASVFSAGTVMDSGTVITRLPPTAYSALSSAFKAGMKQYPPAQPSGILDTCFDFSGQSSVSIPSVALVFSGGAVVSLDASGIILSNCLAFAGNSDDSSLGIIGNVQQRTFEVLYDVGRGVVGFRAGAC

SEQ ID NO: 731 - protein, 469 aa, Oryza sativa
MEVLLPLLLACSLLFTIATPIRDITDVCASQISDFQHLNSSGLHLTLHHPQSPCSPAPLPSDLPFSAVVTHDDARIAHLASRLANNHPTSPSSSSLLHGHRKKKAGGVGGSQASSSSVPLTPGASVAVGNYVTRLGLGTPATSYVMVVDTGSSLTWLQCSPCSVSCHRQAGPVFDPRASGTYAAVQCSSSECGELQAATLNPSACSVSNVCIYQASYGDSSYSVGYLSKDTVSFGSGSFPGFYYGCGQDNEGLFGRSAGLIGLAKNKLSLLYQLAPSLGYAFSYCLPTSSAAAGYLSIGSYNPGQYSYTPMASSSLDASLYFVTLSGISVAGAPLAVPPSEYRSLPTIIDSGTVITRLPPNVYTALSRAVAAAMASAAPRAPTYSILDTCFRGSAAGLRVPRVDMAFAGGATLALSPGNVLIDVDDSTTCLAFAPTGGTAIIGNTQQQTFSVVYDVAQSRIGFAAGGCS

SEQ ID NO: 732 - protein, 182 aa, Oryza sativa
MELELGLAPPNSGHLVVDELSSSSSSGGGSGSAPVSASSAGKRGFREAFQETLLLFDDGSCCNTSDDDCRRRKKTVVGWPPVSSARRACGGANYVKVKKEGDAIGRKVDLALHSSYDELAATLARMFPTNDHQGEKKMANDDHGDAAGPVVTYEDGDGDWMLVGDVPWDDFARSVKRLKILG

SEQ ID NO: 733 - protein, 200 aa, Oryza sativa
MASHQDQASYRAGETKAHTEEKAGQVMGASKDKASEAKDRASEAAGHAAGKGQDTKEATKEKAQAAKERASETAQAAKDKTSSTSQAARDKAAESKDQTGGFLGEKTEQAKQKAAETAGAAKQKTAETAQYTKDSAIAGKDKTGSVLQQASEQVKSTVVGAKDAVMSTLGMTEDEAGTDDGANKDTSATAAATETTARDH

SEQ ID NO: 734 - protein, 215 aa, Oryza sativa
MASQQERASYHAGETKARAEEKTGRMMGTAQEKAREAKDTASDAAGRAMGRGHGAKEATKEKAYETKDATKEKAYEAKDAASDATGRAMDKGRGAAGATRDKAYDAKDRAADTAQSAADRARDGAGQTGSYIGQTAEAAKQKAAGAAQYAKETAIAGKDKTGAVLQQAGEQVKSVAVGAKDAVMYTLGMSGDNKNNAAAGKDTSTYKPGTGSDYQ

SEQ ID NO: 735 - protein, 305 aa, Zea mays
MSRLMAAMLLGGARVAGAAKLTGNGNAAGMQALPMPACFLPPRPQAATWTRLCLQAAPRSSQAYDNAPEDRREIGDKYKDAAEEAKDATGDAKEHAKRMAGETKSRAQDKAGRVADQASGMAERAKDQAKGVAEDAADTASRATERAKNETRDAAREAADRAGHVKERAKEAGHEAADRAQGAAKAAKDRTGEAAGRAMDRAGEAKDRAVEGTASYGEKVVEMTKEGAGKVAETAQAIGDMAKQAARSTWDAAKDTAHGVKERVVPDAEDVDAAVKERDRIARDVDRVERERNMREAREKGSGLP

SEQ ID NO: 736 - protein, 231 aa, Zea mays
MASRQQHPTSYHAGETKARAEEKTGQVMGATQEKGREAKHKASDASDRAMGMGHDAMEATREKARAAADRTMGMGHDAGEAAKDRAYRAKDAASGAAGRARDTASDAAGAAGDRARDGAQQTGSYVAQTAEAARQKAAGAALYAKDTVVAGKDKTGALLQQAGEKVMSTAVGAKDTVVSTAVGAKDTVVSTAVGAKDAMMNSLGMAGEDKDGTTTTDAGKDTSTRKPGRDY

SEQ ID NO: 737 - protein, 630 aa, Zea mays
MESGLVASHRLRVPPPSASAGHHHLIRHRHAHAPVAAAPLRLSLPRHLPRSTPLRLPAALPLRHCLPPLRAASAAAAAVPAPGDDASPKFLGVETKTIKKIVPLGLMFFCILFNYTILRDTKDVLVVTAKGSSAEIIPFLKTWVNLPMAVGFMLLYTKLADVLSKEALFYAVIFPFIAFFGAFAYVLYPMRDAIHPTALADRLLASLGPSFLGPVAILRVWSFCLFYVMAELWGSVVISVLFWGFANQITTVEEAKEFYPLFGLGANVALIFSGRTVKYFSNMRKNLGPGVDGWAISLKAMMSIVVVLGLVITGIYWGVNKFVIDNSSVPVVERKKKDKPKLSMGESMKVLLSSRYVRDLATLVVAYGISINLVEVTWKSKLKAQFPSPNEYSSFMGDFSTATGIATFTMMLLGRVILRKFGWGVAATITPAVLLLTGVGFFSLILFGEPLTPLMTKFGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDLQFSSLAKQELGREKLLKTQAVETVAEVVGTGNGSLQETLASEPSANGAATKQSQEPESTAPEKSGQQSQ

SEQ ID NO: 738 - protein, 441 aa, Xylella fastidiosa
MPGAAPTSPSRQPLLQRLAGVRPEEAPAVLWSMLYVVALFLAYYVLRPIRDELGVAGGVQNLPWLFTGTLLAMLVASPLFALAVRSLPRRQFIALAYRFFAANLVLFALLLHFADPQWQVWVGRAFFIWVSVFNLFVVSVFWSFMVDLFDSEQGKRLFGLFAAGATAGGLLGSAITSGLIEHLDRSWLMAIAIVFLELAVLASRRLSRIAPAFQHAARRDNPDQPLGGGIFAGMVHTLRSPYLGGLAIFILLYSVTSTFLYFQQASIAQASFPDRAARTAFFANIDLIVNAVTLVFQLFVTGRMMATVGIVATLCVLPLVSLLGFAALAASPSVAVIVAAQVARRVANFALARPAREILFTSSAREDRYKAKNFIDTVVYRGGDQIASWGYAGLMGLGLTLAQIPMIAVPLSAVWLGLSVWLGRTHQAQERQDAATAPSIH

SEQ ID NO: 739 - protein, 318 aa, Saccharomyces cerevisiae
MSSNAQVKTPLPPAPAPKKESNFLIDFLMGGVSAAVAKTAASPIERVKLLIQNQDEMLKQGTLDRKYAGILDCFKRTATQEGVISFWRGNTANVIRYFPTQALNFAFKDKIKAMFGFKKEEGYAKWFAGNLASGGAAGALSLLFVYSLDYARTRLAADSKSSKKGGARQFNGLIDVYKKTLKSDGVAGLYRGFLPSVVGIVVYRGLYFGMYDSLKPLLLTGSLEGSFLASFLLGWVVTTGASTCSYPLDTVRRRMMMTSGQAVKYDGAFDCLRKIVAAEGVGSLFKGCGANILRGVAGAGVISMYDQLQMILFGKKFK

SEQ ID NO: 740 - protein, 219 aa, Saccharomyces cerevisiae
MNQAIDFAQASIDSYKKHGILEDVIHDTSFQPSGILAVEYSSSAPVAMGNTLPTEKARSKPQFQFTFNKQMQKSVPQANAYVPQDDDLFTLVMTDPDAPSKTDHKWSEFCHLVECDLKLLNEATHETSGATEFFASEFNTKGSNTLIEYMGPAPPKGSGPHRYVFLLYKQPKGVDSSKFSKIKDRPNWGYGTPATGVGKWAKENNLQLVASNFFYAETK

SEQ ID NO: 741 - protein, 201 aa, Saccharomyces cerevisiae
MSSAIVAKLNKEDIIKDTVKDLAFEILGELSVSYVDSDDIKLGNPMPMEATQAAPTIKFTPFDKSQLSAEDKLALLMTDPDAPSRTEHKWSEVCHYIITDIPVEYGPGGDIAISGKGVVRNNYIGPGPPKNSGYHRYVFFLCKQPKGADSSTFTKVENIISWGYGTPGAGAYDYIKENNLQLVGANYYMVENTTVDFNYDM

SEQ ID NO: 742 - protein, 964 aa, Zea mays
MAGNDNWINSYLDAILDAGKAAIGGDRPSLLLRERGHFSPARYFVEEVITGYDETDLYKTWLRANAMRSPQERNTRLENMTWRIWNLARKKKEFEKEEACRMSKRQPETEKTRADATADMSEDLFEGEKGEDAGDPSVAYGDSTTGSSPKTSSIDKLYIVLISLHGLVRGENMELGRDSDTGGQIKYVVELAKALSSSPGVYRVDLLTRQILAPNFDRSYGEPKELLVSTSGKNYKQEKGENSGAYIIRIPFGPKDKYLAKEHLWPFIQEFVDGALSHIVRMSKAIGEETGRGHPVWPAVIHGHYASAGIAAALLSGALNLPMAFTGHFLGKDKLEGLLKQGRQTREQINMTYKIMCRIEAEELSLDASEIVIASTRQEIEEQWNLYDGFEVILARKLRARVKRGANCYGRFMPRMVIIPPGVEFGHIIHDFDMDGEEENPCPASEDPPIWSQIMRFFTNPRKPMILAVARPYPEKNITTLVKAFGECRPLRELANLTLIMGNREAISKMHNMSAAVLTSVLTLIDEYDLYGQVAYPKHHKHSEVPDIYRLAARTKGAFVNVAYFEQFGVTLIEAAMNGLPIIATKNGAPVEINQVLNNGLLVDPHDQNAIADALYKLLSDKHLWSRCRENGLTNIHQFSWPEHCKNYLSRILTLGPRSPAIGNREERSNTPISGRKNIIVISVDSVNKEGLVRIIRNAIEVIHKENMSGSTGFVLSTSLTISEIHSLLLSGGMLPTDFDAFICNSGSNIYYPSHSGETSNNSKITFALDQNHQSHIEYRWGGEGLRKYLVKWATSVVERKGRTERQIIFEDPEHSSAYCLAFRVVNPNHLPPLKELRKLMRIQSLRCNALYNHSATRLSVVPIHASRSQALRYLCIRLGIEVPNVAVLVGESGDSDYEELLGGLHRTVILKGEFNIAANRIHTVRRYPLQDVVALDSSNIIGVDGYTTDDLRSALQQMGILAR

SEQ ID NO: 743 - protein, 122 aa, Oryza sativa
MAGVWVFKDGIVRRVENPGSEESSSAGDGGGGGRRKVLVHVPSGEVVASYEVLERRLRELGWERYLTDPCLLQFHQRSTVHLISVPRDFSKFKLVHMYDIVVKTRNVFEVRDAAAPAVSPAT

SEQ ID NO: 744 - protein, 118 aa, Oryza sativa
MAGVWVFEDGMVRRADSEAPSRGRGVGGGGGGGKVLVHVPSSEVVTSYEVLERRLRELGWERYLNDPCLLQFHQRSTVHLISVPRDFSRLKLVHMYDVVVKTRNVFEVRDAATTASPP

SEQ ID NO: 745 - protein, 114 aa, Zea mays
MSGVWVFRNGVVRLVENPTSGNAAAAPGKRKALLHTPSGEVVTSYASLERKLAALGWERYYAGGGDGGGAGLLQYHKRTSVDLISLPKDFAHFGSVHMYDIVIKNRDAFRVIDA

SEQ ID NO: 746 - protein, 105 aa, Zea mays
MSGSGAGVWVFKNGVMQLEQPAAASRKALVYVPTNEVVRSVEALERRLGTLGWERYYENRSIVQLHKRDGGADLITIPRDFANLRSTHMYDVVVKNRDHFKVVDA

SEQ ID NO: 747 - protein, 232 aa, Zea mays
MVRGKTQMKRIENPTSRQVTFSKRRNGLLKKAFELSVLCDAEVALVVFSPRGKLYEFASGSAQKTIERYRTYTKDNVSNKTVQQDIERVKADADGLSKRLEALEAYKRKLLGERLEDCSIEELHSLEVKLEKSLHCIRGRKTELLEEQVRKLKQKEMSLRKSNEDLREKCKKQPPVPMASAPPRAPAVDNVEDGHREPKDDGMDVETELYIGLPGRDYRSSKDKAAVAVRSG

SEQ ID NO: 748 - protein, 224 aa, Zea mays
MVRGKTELKRIENATSRQVTFSKRRNGLLKKAFELSVLCDAEVGLVVFSPRGKLYEFASAASLQKTIDRYRTYTRENVNNKTVQQDIQQVKADAVSLASRLEALEKTKRMFLGENLEECSIEELHNLEVKLAKSLHVIRGKKTQLLEQQISKLKEKERTLLQDNKELRDKQRNLQSPPEAPPDLNRCVPPWPRSLPAPSNDMDVETELYIGLPGRERSSNRDSD

SEQ ID NO: 749 - protein, 493 aa, Zea mays
MAGAAAVETAAAAAAANGKACCHAAKGPGYATPLEAMEKGPREKLVYVTCVYNGTGINKPDYLATVDLDPSSPTYSQVIHRLPVTHIGDELHHSGWNSCSSCHGDPSAKRRFLILPSLLSGRVYVVDTATDPRAPSLHKVVESEDIAENTGLGFPHTSHCLASGDIMISCLGDKEGNAAGNGFLLLDSEFNVKGRWEKPGHSPLFGYDFWYQPRHKTMISSSWGAPAAFRTGFDLQHVQDGLYGRHLHVYDWPGGELKQTLDLGDTGLLPLEVRFLHDPSKDTGYVGCALTSNMVRFFKTADGSWSHEVAISVKPLKVRNWILPEMPGLITDFVISLDDRYLYFVNWLHGDIRQYNIEDPAKPFLAGQVWVGGLLQKGSDVVYVTDDGQEQQYNVPQVKGHRLRGGPQMIQLSLDGKRIYVTNSLFSRWDEQFFGDDLVKKGSHMLQIDVDTEKGGLAVNPNFFVDFGTEPDGPALAHEMRYPGGDCTSDIWI

SEQ ID NO: 750 - protein, 223 aa, Zea mays
MATPAVKVYGWAISPFVSRALLALEEAGVDYELVPMSRQDGDHRRPEHLARNPFGKVPVLEDGDLTLFESRAIARHVLRKHKPELLGGGRLEQTAMVDVWLEVEAHQLSPPAIAIVVECVFAPFLGRERNQAVVDENVEKLKKVLEVYEARLATCTYLAGDFLSLADLSPFTIMHCLMATEYAALVHALPHVSAWWQGLAARPAANKVAQFMPVGAGAPKEQE

SEQ ID NO: 751 - protein, 556 aa, Zea mays
MGNACGGALRSKYQHSFKHAASSQRRASSEYSASAVADDSPRKPTQPPATTDAHAPPPPPATAAAAMRRGGAGAPPDLGSVLGHPTPNLRDLYALGRKLGQGQFGTTFLCTELATGVDYACKSISKRKLITREDVDDVRREIQIMHHLSGHTNVVAIKGAYEDQLYVHIVMELCAGGELFDRIIQRGHYSERKAAELTRIIVGVVEACHSLGVMHRDLKPENFLLVNKDDDLSLKAIDFGLSVFFKPGQVFTDVVGSPYYVAPEVLLKNYGPAADVWTAGVILYILLSGVPPFWAETQQGIFDAVLKGVIDFDSDPWPVISDSAKDLIRRMLNPRSAKRLTAHEVLCHPWIRDHGVAPDRPLDPAVLSRIKQFSAMNKLKKMALRVIAESLSEEEIAGLKEMFQTMDTDNSGAITYDELKEGLRKYGSTLKDTEIRDLMDAADIDNNGTIDYIEFIAATLHLNKLEREEHLVAAFSYFDKDGSGYITVDELQQACKEHNMPDAFLDDVINEADQDNDGRIDYGEFVAMMTKGNMGVGRRTMRNSLNISMRDAPGAF

SEQ ID NO: 752 - protein, 272 aa, Zea mays
MYKQGGAGGGAGLDRKRINDALDKHLEKAVASPSTSRGSAGGGRDHHRLVVPSSVSSIPKGRCSEGESDSDSEASDVSGSDGEDTSWISWYCNLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQDIDGAYFGTTFPHLFLMTYEHLKPQKLSQRYVPRVFGFKLHKP

SEQ ID NO: 753 - protein, 234 aa, Zea mays
MAAKIFCLLMLLGISASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQQQLPFSQLPVAYPQQFLPFNQLAALNSPAYLQQQQLLPFSQLAGVSPATFLTQPQLLPFYQHAAPNAGTLLQLQQLLPFNQLALTNLAVFYQQPIIGGALF

SEQ ID NO: 754 - protein, 361 aa, Zea mays
MCGGAILAELREPAPRRLTERDIWQQKKKPKRGGAGGRRSFAAEDDEDFEADFEDFEADSGDSDLELGEGADDDVIEIKPFAAKSTFSRDGLSTMTTAGYDAPAARLAKRKRKNQYRGIRQRPWGKWAAEIRDPQKGVRVWLGTFNSPEEAARAYDAEARRIRGKKAKVNFPDAPAVGQKCRSSSASAKALKSCVEQKPIVKTDMNILANTNAPFYQSVNYASNNPFVPAMNSTVSFEDPIMNLHSDQGSNSLGCSDLGWENDTKTPDITSIAPIPTIAEGDESVFVNSNSNSSMVPPVLENNAVDLTDGLTDLESYMRFLMDGGASDSIDSLLNLDGSQDLGSNMDLWTFDDMPIAGDFF

SEQ ID NO: 755 - protein, 377 aa, Zea mays
MAQDEAVATQKTGNTTSPSKDYPTPSPYPDWSTMQAYYGPGVLPPTYFTPAIAPGHPPPYMWGPQPIMPPPFGTPYAAVYPHGGAYPHPLVPMMSTPMSVEPAKSANSKEKNSNKKLKEIDRTAVSAGSGNSKRTVSSIEDYSAEGSSDVNDQNVNETSRKRSSDGGPGAETTTGGNTECVLAPNHTLGNATILPQHCFSAPVIKPSATNVANSRAIGTALSPPPGVMVPVHNAVPSDLSVKDERELKREKRKQSNRESARRSRLRKQAETEELATQVESLAAENTSLRSEIGRLTESSEKLRLENSALMVKLKDTAEPSPSKAAASPSSPRASAENFLSMIDSANAPSVSRHTEHGGPRLRQLLDSSPATDVAAVS

SEQ ID NO: 756 - protein, 157 aa, Zea mays
MKGAKSKGAAKADAKLAVKSKGAEKPAKGRKGKAGKDPNKPKRAPSAFFVFMEEFRKEFKEKNPKNKSVAAVGKAAGDRWKSLSESDKAPYVAKANKLKLEYNKAIAAYNKGESTAAKKAPAKEEEEEDEEESDKSKSEVNDEDDEEGSEEDEDDDE

SEQ ID NO: 757 - protein, 141 aa, Zea mays
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGYGGRREGGGGGYGGGGGYGGRREGGGGGYGGGGGGGWRD

SEQ ID NO: 758 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 759 - protein, 203 aa, Zea mays
MGFPVGYSESEMLLPRVLLQVLLLLGHFHRFLLWAFHAVGLGDLIDLGCNYPPPPPSASTAHEMMEHQHQHQGRDDVASPLQHQRPEFRPVAAALIEEALPVVRFDELGGAPCGGGDCAVCLSGIGGGDEVRRLGNCRHAFHRACLDRWMAHDQRTCPLCRAPLIPWAADADYDMSYPSPLPPTPLRRPHELLLLLTGLGGFQ

SEQ ID NO: 760 - protein, 319 aa, Zea mays
MAIKRTKAEKKIAYDKKLCSLLDEYTKVLIALADNVGSKQLQDIRRGLRGDSVVLMGKNTLIRRCIKVYAEKTGNHTFDPLMDLLVGNVGLIFTKGDLKEVREEVAKYKVGAPARVGLVAPVDVVVPPGNTGLDPSQTSFFQVLNIPTKINKGTVEIITPVELIKKGEKVGSSESALLAKLGIRPFSYGLQVTSVYEDGSVFSPEVLDLSEEDLIEKFATGVSMVASLSLAISYPTLAAVPHMFINGYKNVLAVAVETDYSYPHADKIKEYLKDPSKFAVAAPVAAGDSGAAAAPKEEEKAAEPEEESDEEMGFSLFDD

SEQ ID NO: 761 - protein, 348 aa, Zea mays
MENGGAKGDVPDDANEHCPGTQSEEAGKADACAGCPNQQICATAPKGPDPDVVAIVERLATVKHKLLVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPVLGVVENMSGLRQPLSDLRFIKSDEAGKTDATEWALNYIKEKAPELLSVMACSEVFDSSKGGAEKMCHEMGVPFLGKVPMDPQLCKAAEEGRSCFADQKCSASAPALRNIVKKLIKAE

SEQ ID NO: 762 - protein, 196 aa, Arabidopsis thaliana
MGRRKIEIKRIENKSSRQVTFSKRRNGLIDKARQLSILCESSVAVVVVSASGKLYDSSSGDDISKIIDRYEIQHADELRALDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 763 - protein, 228 aa, Arabidopsis thaliana
MGRGKIVIQRIDDSTSRQVTFSKRRKGLIKKAKELAILCDAEVGLIIFSSTGKLYDFASSSMKSVIDRYNKSKIEQQQLLNPASEVKFWQREAAVLRQELHALQENHRQMMGEQLNGLSVNELNSLENQIEISLRGIRMRKEQLLTQEIQELSQKRNLIHQENLDLSRKVQRIHQENVELYKKAYMANTNGFTHREVAVADDESHTQIRLQLSQPEHSDYDTPPRANE

SEQ ID NO: 764 - protein, 174 aa, Arabidopsis thaliana
MEGKRSQGQGYMKKKSYLVEEDMETDTDEEEEVGRDRVRGSRGSINRGGSLRLCQVDRCTADMKEAKLYHRRHKVCEVHAKASSVFLSGLNQRFCQQCSRFHDLQEFDEAKRSCRRRLAGHNERRRKSSGESTYGEGSGRRGINGQVVMQNQERSRVEMTLPMPNSSFKRPQIR

SEQ ID NO: 765 - protein, 301 aa, Arabidopsis thaliana
MAKEGGLGENSRWSLGGMTALVTGGSKGIGEAVVEELAMLGAKVHTCARDETQLQERLREWQAKGFQVTTSVCDVSSRDQRVKLMETVSSLYQGKLNILVKYTYISFVLLGIGIHKNPIMLCFLLWIYTYVGQQCGNVNIKPTTEYTAEDFSFVMATNLESAFHLSQLAHPLLKASGSGSIVLISSAAGVVHVNVGSIYGATKGAMNQLARNLACEWASDNIRTNSVCPWYITTPLSNDFFDEEFKKEAVRTTPMGRVGEANEVSPLVAFLCLPSASYITGQTICVDGGATVNGFSFKTMP

SEQ ID NO: 766 - protein, 260 aa, Oryza sativa
MATASSINKRFSLAGATALVTGGSKGIGRAIVEELASFGATVHTCARNQAELSRCQEEWTAKGLAVTVSVCDVAVRADREALAGRVSAMFDGKLSILVNNAGTAYLKPAADLTPEETSRLMTTNFESCFHLSQLFYPLLKDSGRGSIVNISSVASVLAFHSLPIYSAAKGAMNQVTRNLACEWASDGIRVNSVAPGYIQTPLLTAFVAGNDFAQVEFNRLPLGRLGKPEDISSLVAFLCMPAASYITGQIICVDGGRMLS

SEQ ID NO: 767 - protein, 173 aa, Zea mays
MQRGDPLVVGRIIGDVVDPFVRRVPLRVAYAAREVSNGCELRPSAIADQPRVEVGGPDMRTFYTLVMVDPDAPSPSDPNLREYLHWLVTDIPATTGVSFGTEVVCYESPRPVLGIHRVVFLLFQQLGRQTVYAPGWRQNFSTRDFAELYNLGLPVAAVYFNCQRESGTGGRRM

SEQ ID NO: 768 - protein, 177 aa, Zea mays
MFNMSRDPLVVGNVVGDIVDPFITTASLRVFYNNKEMTNGSELKPSQVMNEPRVHVGGRDMRTLYTLVMVDPDAPSPSNPTKRENLHWLVTDIPETTDASFGNEIVPYESPRPIAGIHRFAFVLFRQSVRQTTYAPGWRSNFNTRDFAAIYGLGSPVAAVYFNCQRENGCGGRRYIR

SEQ ID NO: 769 - protein, 187 aa, Zea mays
MANDSLTRGHIIGDVLDPFTSSVSLSVLYDGRPVFDGMEFRASAVSVKPRVEIGGDDFRVAYTLVMVDPDAPNPSNPSLREYLHWMVTDIPASTDDSFGRELIPYESPSPTMGIHRLVLVLYQQLGRGTVFAPQVRQNFNLRNFARRFNLGKPVAATYFNCQRQTGTGGRRFTCVFDHVVQGEGRQA

SEQ ID NO: 770 - protein, 389 aa, Oryza sativa
MDPNDAFSAAHPFRWDLGPPAPAPVPPPPPPPPPPPPANVPRELEELVAGYGVRMSTVARISELGFTASTLLAMTERELDDMMAALAGLFRWDLLLGERFGLRAALRAERGRLMSLGGRHHGHQSGSTVDGASQEVLSDEHDMAGSGGMGDDDNGRRMVTGKKQAKKGSAARKGKKARRKKVDDLRLDMQEDEMDCCDEDGGGGSESTESSAGGGGGERQREHPFVVTEPGEVARAKKNGLDYLFHLYEQCRLFLLQVQSMAKLHGHKSPTKVTNQVFRYAKKVGASYINKPKMRHYVHCYALHCLDEEASDALRRAYKARGENVGAWRQACYAPLVDISARHGFDIDAVFAAHPRLAIWYVPTRLRQLCHQARSSHAAAAAALPPPLF

SEQ ID NO: 771 - protein, 278 aa, Zea mays
MGRSEGSTSPAAGGAACACAVCGGAAVVYCAADAAALCSPCDTAVHAANLLASRHERVPLSMVTAASGVYDDDLFAPDDIDAASSWASAPAQGQGSPQNGSSSASFTTGDSGAEGRGLFDLLSDVDFAACVTGGGGYLPDGVAPVVHHGAAPLWAQPGLAAAAWTATWSPAVVVPGAAVVAAAAAEREARVQRYREKRERRKFQKTIRYASRKAYAEARPRIKGRFVKRAAGTSSSSSSGAGTSDSIDAAAKFWLSFSDDARDGFFVDAGAYGVVPSF

SEQ ID NO: 772 - protein, 644 aa, Oryza sativa
MESLALLHAKPGGLPPRAGLRLPLPRARSARVSLPSSPAAPVSLQSPLLLASRSGPTSRDAVVGLGLGCGLLRRRSGASGGGGGGVSCGAQPAAAAAAGAVPAAQPEGKKFLGVEVKTLKKIVPLGLMFFCILFNYTILRDTKDVLVVTAKGSSAEIIPFLKTWVNLPMAIGFMLLYTKLSNVLSREALFYTVIFPFIAFFGAFAFVLYPLRNVIHPTALADKLLAALGPSFLGPVAILRIWSFCLFYVMAELWGSVVISVLFWGFANQITTVEEAKEFYPLFGLGANIALIFSGRTVKYFSNLRKTLGPGIDGWEVSLKGMMSLVVLLGLVITSIYWGVNKFVLNDPSLPKSDRKKKKDKPKLGMKESLKVLLSSRYVRDLATLVVAYGISINLVEVTWKSKLKAQQFPSPNEYSSFMGDFSTATGIATFTMMLLGRIILRKFGWGVAAMITPTVLLLTGVGFFSLILFGQPLTPMLATMGMTPLLAAVYVGALQNIFSKSAKYSLFDPCKEMAYIPLDEDMKVVKGKAAIDVVCNPLGKSGGALIQQFMILTFGSLANSTPYLGGILLVIVLAWLGAASSLDKQFSSLAKEDLKRDMSAKEKVDPSLLKAPEADVLVEHTNGTIESEATATESSPSNSSPSN

SEQ ID NO: 773 - protein, 304 aa, Oryza sativa
MGGFVKTQKTHAYFKRFQVKFKRRRQGKTDYRARIRLTNQDKNKYNTPKYRFVVRFTNKDITAQIVYATIAGDIVMAAAYSHELPRYGLEVGLTNYAAAYCTGLLLARRVLTLRGLDQEYEGNVEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMESLYKKVHAAIRADPTMAKSTKKEPATHKRYNLKKLTYEQRKASLVERLNALNSSAGADDDDEEEDDE

SEQ ID NO: 774 - protein, 302 aa, Zea mays; identical to SEQ ID NO: 644

SEQ ID NO: 775 - protein, 288 aa, Zea mays
MGFVKLIKTKAYFKRYQVKFRRRREGKTDYRQRTRLITQDKNKYNTPKYRLVVRKTNKNIIAQIIYATVQGDRVVNAAYSSELPKFGIKLGLTNYASAYATGLLVARRHLTKIGLASKYQGKVEADGNDYTVEPAEGPRPFKALLDIGLARTSTGARIFAVAKGALDGGINIPHSVKRFAGYNAETKKHNPEVLKKYIYGQHVAEYMKKLQKEEPQAYEKQFSRFVKAGVKAGDIEGIYKNAHKAIRADPTKKANEKKAVEHKRYNPKRLTHAQRAERVAKKKAILGL

SEQ ID NO: 776 - protein, 512 aa, Agrobacterium tumefaciens
MLPKVARAHVCPPSPRCGEDLGKVPGTNPSSRYSGQPGNARTYEATTVRAFLVLCRLSISRGTEEAHHHCLKCGRVIPSNRWQTKPNDALAGHRSHSRLERMLSILRLHRLIRMHISSVLCPPDSAGVGFIGNISMTTARILDFIKTRRPEGPCLVVDLDVVRDNFNAFRHSLPNSAIYYAVKANPAPEILKLLASLGSNFDCASVAEIQMALDAGATSDRISFGNTIKKERDVARAHALGIDLFAVDSHEEVEKVARAAPGARVFCRVLTDGEGAEWPLSRKFGCVPQMAVDVLVYAHQMGLESYGVSFHVGSQMMNLDAWDAALADAKRVFASLAKQGIHLQMVNMGGGFPTKYLRDVPAAEEYGQAIDTALRKHFGNQIPKTIIEPGRGMVGNAGVIKAEVVLVSKKSDNDNHRWVFLDIGKFGGLAETMDEAIRYPIRTERDQDEMQPCVLAGPTCDSADVLYEKNMYPLPVSLTIGDEVLIEGTGAYTTTYSAVAFNGFEPLKAYVI

SEQ ID NO: 777 - protein, 371 aa, Zea mays
MSARDRETAEALVRLAASLDGAVLGLGTAAVAVASWVKYLAVSGQLRLVASAATASIADARSLLSGDGAEPRIAAVRGYVRAHDKFFRAPFSGEAGVVTKHTQMCLFTEWRGIFGWTFDLHALLFRSWKEQIVTSFRSVPFVLVSTELGNPTGVVHINVDKADQPLPLTTVFHKLIPLETTPYTLFQTIIGNGYPIALLDEEKILPIGKKITAIGLCQAKDAESVEITSCPEIPFFLSELTKDEMQAQLASRARILFWGSIVLGTLSVCLVGHAIYRGWTRIKLRREARHARQMFEEAEDAIHRDDSSDDDEIGDGQLCVVCLRKRRRAAFIPCGHLVCCSECALTIERTPHPLCPMCRQDIRYMMRVYDS

SEQ ID NO: 778 - protein, 250 aa, Zea mays
MESLFGQSQRRRRAGGSGFESLKRLGHISPAVQSHLKHVYLTLCSALAFSALGAYLHILLNVGGALTTVGCVASIAFLISLPASRDQERNRLALLMSAALLQGASVGPLVDLVIDLDSRILVTAFVGTAVAFACFSGAAIIAKRREYLYLGGLLSSGLSILLWLQFATSIFGHTSATFMFELYFGLLVFLGYMVFDTQEIIERAHRGDMDYIKHALTLFTDFVAVLVRILVIMMKNAQEKSQDEKKRKKR

SEQ ID NO: 779 - protein, 195 aa, Zea mays
MDAFNSFFDSRNRWNYDTLKNFRQISPVVQNHLKQVYFTLCFAVVAAAVGAYLHVLLNIGGFLTTVACMGSSFWLLSTPPFEERKRVTLLMAASLFQGSSIGPLIDLAIHIDPSLIFSAFVGTALAFACFSGAALVARRREYLYLGGLVSSGLSILLWLHFASSIFGGSTALFKFELYFGLLVFRLHCSRHPRNS

SEQ ID NO: 780 - protein, 249 aa, Zea mays
MGKHGHGKCHDVEACYPPGAAGGGKYPYMTENPQLRWAFIRKVYVIVCLQLLLTVAVAATVNLVRAIGDFFLSRTMGAMFAIIGVIVAPILVMIPMIIYRKRHPVNLALLALFTVCISFAVGLSCLTANGPVILEAVVITMVVVLGLTFYTFWAAKRGYEFEFLGPFLVSACLILMLFSLLRIIFPLGRTGTMVYGCIAALVFSGFIIYDTDNLIRVYSYDEYVAAAIELYLDIINLFQAILAVLEGVD

SEQ ID NO: 781 - protein, 351 aa, Zea mays
MMMLIDCSGCRTPLQLPHGAPCIRCAICGAVTHIAPAPPAEPNRGAVQPAPGWAPPPPPVHGRKRAVVCGISYRYSRHELKGCINDAKCMRHLLMTRFNFPDDSIIMLNEEQTDPYKIPTKHNIRMAMYWLVQGCQPGDSLVFHYSGHGSQQRNYSGDEVDGFDETLCPLDFETQGMILDDEINTALVRPLPHGVKLHALIDACHSGTALDLPYLCRMNRSGQYVWEDHRPRSGVWKGTSGGEAISFSGCDDDQTSADTSALSKITSTGAMTFCFIQAIERGQGTTYGSILNSMRSTIRNTGDSAGVGGGAVTSLITMLLTGGSLSAGGLRQEPQLTACEPFDVYAKPFSL

SEQ ID NO: 782 - protein, 311 aa, Zea mays
MNFGGNGNATIRCKYCRASLSVIPGERAIQCAQCNCVTRIRRADRIPLARPAHVPPAFQRARGKKRAVLVGITYAGARRGCGDLRGPVNDVKCMRNLLCQRFGFPGECIIMLTDDQRDPFRLPTKENIRMAMHWLVQGCSYGDSLVFHFSGIGAQVADDDGDEADGYDEAICPLDAFQSGPILDDEINETIVRPLVHGARLHAVVDACYSATVLDLPYQCRMSRNGFWQWEDESPPSGAWKGTSGGHAVLISGYSEGKGNFAMVRDMIHTYILLIELCCLASIYIPNMHMLLLGRRAACRCPTPTRRSSGP

SEQ ID NO: 783 - protein, 356 aa, Zea mays
MNMGGRSPAATTIRCKYCSASLTVCAGERAIQCAQCCGVTRIRRSLSSRLPLPALTRPASVAGFPPCGGRGKKRAVLIGITYGGARRGCGELRGPINDVKCMRQLLCQRFAFPSDGIIMLTDDQKDPFRVPTKDNIRMAMQWLVQGCSSGDSLVFHFSGLGAQVADADCDEQDGYDEAICPVDSFQKGPILDDEINETIVRPLVPGAKLHAVVDACHSDSVLDLPFLCNMSRTGNWQWEDHRPPSGVCKGTSGGQAVLISGYSDGKSKFSMTPEACAAVGAMTHSFIKAVECEPQGVTYGRLLTSMKAIMTNAGGCNQQLQGACAPARKVVNFSGVQEPNLSCSEMFDVYRKPFAL

SEQ ID NO: 784 - protein, 453 aa, Saccharomyces cerevisiae
MKMSLEVYLNYHQRRPTRFTIMYPGSGRYTYNNAGGNNGYQRPMAPPPNQQYGQQYGQQYEQQYGQQYGQQNDQQFSQQYAPPPGPPPMAYNRPVYPPPQFQQEQAKAQLSNGYNNPNVNASNMYGPPQNMSLPPPQTQTIQGTDQPYQYSQCTGRRKALIIGINYIGSKNQLRGCINDAHNIFNFLTNGYGYSSDDIVILTDDQNDLVRVPTRANMIRAMQWLVKDAQPNDSLFLHYSGHGGQTEDLDGDEEDGMDDVIYPVDFETQGPIIDDEMHDIMVKPLQQGVRLTALFDSCHSGTVLDLPYTYSTKGIIKEPNIWKDVGQDGLQAAISYATGNRAALIGSLGSIFKTVKGGMGNNVDRERVRQIKFSAADVVMLSGSKDNQTSADAVEDGQNTGAMSHAFIKVMTLQPQQSYLSLLQNMRKELAGKYSQKPQLSSSHPIDVNLQFIM

SEQ ID NO: 785 - protein, 563 aa, Glycine max
MNLSLCNSSNLNTSRKPLMALPHSISALATTLTLSSPTTKPQKVNPFPFFSNQKTRFLTKQTRPRSRRSLSLTPARVAAPPSTVEADQSYPETENNETEEEFNDESSYSKFTWRDHWYPVSLIEDLNPLLPTPFQLLGREIVLWYDKSISQWVAFDDKCPHRLAPLSEGRIDEDGKLQCSYHGWSFDGCGSCVKIPQAASEGPEARAIGSPKACATRFPTMVSQGLLFVWPDENGWEKAKASKPPMLPDDFDKPEFATVNIQRDLFYGYDTLMENVSDPSHIEFAHHKVTGRRDRAKPLPFKMDSRGSWGFSGANEGNPQISAKFVAPCYMMNKIQIDTKLPVVGDQKWVVWICSFNVPMAPGKTRSIVCSARNFFQFSVPGPAWWQVVPRWYEHWTSNKVYDGDMIVLQGQEKIFLSETKEGGDINKQYTNITFTPTQADRFVLAFRNWLRRHGNGQPEWFGNSSDQPLPSTVLSKRQMLDRFEQHTLKCSSCKAAYEGFQTWQKVLIGTTVVFCATSGIPSDVQLRVLLAGLAIVSAAITFALNQLQKNFEFVDYVHAEID

SEQ ID NO: 786 - protein, 469 aa, Synechocystis sp. PCC 6803
MTSLLTSSAQAPVANAPFPAGGLDQSKFDCRAVWYPLAYEEDLDKRKPTRFTLLGEDLVIWWEANSQQWRVYADQCPHRLAPLSEGRINKAGQLECPYHGWTFAGSGQCQAIPQQHTGGQAHTSKRACVRSLPTQVAQGLLFAFPGETDQAEKVALPLVDVLDGDQSEWVCLNTFRDLPYDAFTLMENVLDSSHIPYTHHKTVGKRSNVSPVDLEIIHGDRQGFTGIWEEGPRKGTLGKQTTTFIAPGLMWHDLTSKQFGRTLTVVYATPIRPGECRLFARFPFKFPSKFPRLVIGFTPRWYSHLGQNRVLEDDQIFLHFQERFVQGKGGSPNYEKDCYLPTKADLFVAEFHRWIEQYQVKPFGDSPLPDRQSVEQLMDRYHSHTEHCHSCRNALANIEKIQTGSLAIAIICLVCLPVASLGLAPNFALGLGLTVLTGLGFALWAGLGKFKQSFYQGNPIPPRNILDKG

SEQ ID NO: 787 - protein, 271 aa, Arabidopsis thaliana
MGRGKIEIKRIENANSRQVTFSKRRSGLLKKARELSVLCDAEVAVIVFSKSGKLFEYSSTGMKQTLSRYGNHQSSSASKAENLQEDCAEVDILKDQLSKLQEKHLQLQGKGLNPLTFKELQSLEQQLYHALITVRERKERLLTNQLEESRLKEQRAELENETLRRQVQELRSFLPSFTHYVPSYIKCFAIDPKNALINHDSKCSLQNTDSDTTLQLGLPGEAHDRRTNEGERESPSSDSVTTNTSSETAERGDQSSLANSPPEAKRQRFSV

SEQ ID NO: 788 - protein, 133 aa, Saccharomyces cerevisiae
MTNMAKAPKANTPKVTSTSSAVLTDFQETFKTSKRAYFAQIEKYPKLKLIDTFCFFLVLLGVIQCTFIILIRDNFPFNAFLAGFIICVGQFVLLMSLRLQLCNSFPGISKNRAFAEFIVASLILHFVCLHFIN

SEQ ID NO: 789 - protein, 114 aa, Zea mays
MPRATSDAKLLIQSLGKAYAATPTNLKIIDLYVGFAVATALIQVAYMGLVGSFPFNSFLSGVLSCIGTAVLAVCLRIQVNKDNKEFKDLPPERAFADFVLCNLVLHLVIMNFLG

SEQ ID NO: 790 - protein, 375 aa, Zea mays
MSAATACMPLVLDPSPLHGSAAMADAVERRQPGGMETTKTGSEGTLGRVVRSQVFGNEDDDRAGHGDGDEVSKPRAVVHTLTCERKPLFEGFALWRSIGRPELPELDPILSFDEFEFSAPAGFLDHPHRGFENVTYMLEGGISYHDFSGHKGTINPGDVQWLTAGRGVVHAEMPAAGQGVQRGINIWINLSAADKMVEPRYQDLASHDIPAAAADAAGGVSVKVIAGECLGARSPLRPRTPALCLDVALRPGARLRQPVPRGWSACAYVIHGEAAFGTASGEGNGASTATARTLVVFGGDGDGVELRGDAAGQGARVMLVAARSHGEAVARDGPFVMNTREEVDQAREDYRHRRNGFEMADGWTSDHASAAEKHS

SEQ ID NO: 791 - protein, 505 aa, Zea mays
MASPAMVPLRQLFVDGEWRPPAQGRRLPVVNPTTEAHIGEIPAGTAEDVDAAVAAARAALKRNRGRDWARAPGAVRAKYLRAIAAKVIERKPELAKLEALDCGKPYDEAAWDMDDVAGCFEYFADQAEALDKRQNSPVSLPMETFKCHLRREPIGVVGLITPWNYPLLMATWKIAPALAAGCTAVLKPSELASVTCLELADICKEVGLPSGVLNIVTGLGPDAGAPLSAHPDVDKVAFTGSFETGKKIMASAAPMVKPVTLELGGKSPIVVFDDVDIDKAVEWTLFGCFWTNGQICSATSRLLIHTKIAKKFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTQYGLAGAVISGDRERCQRLSEEIDAGCIWVNCSQPCFCQAPWGGNKRSGFGRELGEGGIDNYLSVKQVTEYISDEPWGWYQSPSKL

SEQ ID NO: 792 - protein, 506 aa, Oryza sativa
MAPPQTIPRRGLFIGGAWREPCLGRRLPVVNPATEATIGDIPAGTAEDVEIAVAAARDAFSRDGGRHWSRAPGAVRANFLRAIAAKIKDRKSELALLETLDSGKPLDEASGDMDDVAACFEYYADLAEALDGKQQSPISLPMENFKSYVLKEPIGVVGLITPWNYPLLMATWKVAPALAAGCTTILKPSELASVSCLELGAICMEIGLPPGVLNIITGLGPEAGAPLSSHSHVDKVAFTGSTETGKRIMISAAQMVKPVSLELGGKSPLIVFDDIGDIDKAVEWTMFGIFANAGQVCSATSRLLLHEKIAKKFLDRLVAWAKNIKVSDPLEEGCRLGSVISEGQYEKIKKFISTARSEGATILYGGGRPQHLRRGFFLEPTIITDVSTSMQIWQEEVFGPVICVKEFRTESEAVELANDTHYGLAGAVISNDQERCERISKALHSGIIWINCSQPCFVQAPWGGNKRSGFGRELGEWGLDNYLTVKQVTKYCSDEPWGWYQPPSKL

SEQ ID NO: 793 - protein, 869 aa, Saccharomyces cerevisiae
MSSCKTTLSEMVGSVTKDRGTINVEARTRSSNVTFKPPVTHDMVRSLFDPTLKKSLLEKCIALAIISNFFICYWVFQRFGLQFTKYFFLVQYLFWRIAYNLGIGLVLHYQSHYETLTNCAKTHAIFSKIPQNKDANSNFSTNSNSFSEKFWNFIRKFCQYEIRSKMPKEYDLFAYPEEINVWLIFRQFVDLILMQDFVTYIIYVYLSIPYSWVQIFNWRSLLGVILILFNIWVKLDAHRVVKDYAWYWGDFFFLEESELIFDGVFNISPHPMYSIGYLGYYGLSLICNDYKVLLVSVFGHYSQFLFLKYVENPHIERTYGDGTDSDSQMNSRIDDLISKENYDYSRPLINMGLSFNNFNKLRFTDYFTIGTVAALMLGTIMNARFINLNYLFITVFVTKLVSWLFISTILYKQSQSKWFTRLFLENGYTQVYSYEQWQFIYNYYLVLTYTLMIIHTGLQIWSNFSNINNSQLIFGLILVALQTWCDKETRLAISDFGWFYGDFFLSNYISTRKLTSQGIYRYLNHPEAVLGVVGVWGTVLMTNFAVTNIILAVLWTLTNFILVKFIETPHVNKIYGKTKRVSGVGKTLLGLKPLRQVSDIVNRIENIIIKSLVDESKNSNGGAELLPKNYQDNKEWNILIQEAMDSVATRLSPYCELKIENEQVETNFVLPTPVTLNWKMPIELYNGDDWIGLYKVIDTRADREKTRVGSGGHWSATSKDSYMNHGLRHKESVTEIKATEKYVQGKVTFDTSLLYFENGIYEFRYHSGNSHKVLLISTPFEISLPVLNTTTPELFEKDLTEFLTKVNVLKDGKFRPLGNKFFGMDSLKQLIKNSIGVELSSEYMRRVNGDAHVISHRAWDIKQTLDSLA

SEQ ID NO: 794 - protein, 206 aa, Saccharomyces cerevisiae
MKESVQEIIQQLIHSVDLQSSKFQLAIVCTMFNPIFWNIVARMEYHKHSLTKMCGGARKGCYMLAATIFSLGIVRDMVYESALREQPTCSLITGENWTKLGVALFGLGQVLVLSSMYKLGITGTYLGDYFGILMDERVTGFPFNVSNNPMYQGSTLSFLGIALYKGKPAGLVVSAVVYFMYKIALRWEEPFTAMIYANRDKAKKNM

SEQ ID NO: 795 - protein, 501 aa, Zea mays
MDTVSVPVVAVANGIGEVERKVQKSYWEEHSKCLTVESMMLDSRAADLDKEERPEILSLLPSYKGKSVLELGAGIGRFTGDLAKEAGHVLALDFIESVIKKNQSINGHHKNITFRCADVTSNDLKIEDNSVDLIFSNWLLMYLSDEEVQKLVGKMVKWLKVGGHIFFRESCFHQSGDSKRKVNPTHYREPRFYTKVFKEGHSFDQDGGSFELSLVTCKCIGAYVKNKKNQNQICWLWEKVKSTEDRDFQRFLDNVQYKTSGILRYERVFGEGFVSTGGIETTKEFVGMLDLKPGQKVLDVGCGIGGGDFYMAANYDVHVLGIDLSVNMVSFAIERAIGRKCSVEFEVADCTTKDYPENSFDVIYSRDTILHIQDKPALFRSFFKWLKPGGKVLISDYCKNPGKPSEEFAAYIKQRGYDLHDVKAYGQMLKDAGFHNVIAEDRTEQFLNVLQRELGEVEKNKDAFLADFTQEDYDDIVNGWNAKLKRSSAGEQRWGLFIATK

SEQ ID NO: 796 - protein, 677 aa, Escherichia coli
MTDLSHSREKDKINPVVFYTSAGLILLFSLTTILFRDFSALWIGRTLDWVSKTFGWYYLLAATLYIVFVVCIACSRFGSVKLGPEQSKPEFSLLSWAAMLFAAGIGIDLMFFSVAEPVTQYMQPPEGAGQTIEAARQAMVWTLFHYGLTGWSMYALMGMALGYFSYRYNLPLTIRSALYPIFGKRINGPIGHSVDIAAVIGTIFGIATTLGIGVVQLNYGLSVLFDIPDSMAAKAALIALSVIIATISVTSGVDKGIRVLSELNVALALGLILFVLFMGDTSFLLNALVLNVGDYVNRFMGMTLNSFAFDRPVEWMNNWTLFFWAWWVAWSPFVGLFLARISRGRTIRQFVLGTLIIPFTFTLLWLSVFGNSALYEIIHGGAAFAEEAMVHPERGFYSLLAQYPAFTFSASVATITGLLFYVTSADSGALVLGNFTSQLKDINSDAPGWLRVFWSVAIGLLTLGMLMTNGISALQNTTVIMGLPFSFVIFFVMAGLYKSLKVEDYRRESANRDTAPRPLGLQDRLSWKKRLSRLMNYPGTRYTKQMMETVCYPAMEEVAQELRLRGAYVELKSLPPEEGQQLGHLDLLVHMGEEQNFVYQIWPQQYSVPGFTYRARSGKSTYYRLETFLLEGSQGNDLMDYSKEQVITDILDQYERHLNFIHLHREAPGHSVMFPDA

SEQ ID NO: 797 - protein, 680 aa, Xenorhabdus sp.
MNIGDSPKNTQKDSLNSVVFFTSAALIILFSLFTLFFTDATSIWIKNTLNWVSKTFGWYYLLAATLYIVFVIFVAASRFGAIKLGPEQSKPEFSLLSWAAMLFAAGIGIDLMFFSVAEPITQYMRPPTGEGETIEAARQAMVWTLFHYGLTGWSMYALMGIALGYFSYRYNLPLTIRSALYPIFGNRIKGPIGHTVDIAAVIGTIFGIATTLGIGVVQLNYGLKVLFGLPQGLGVQGGLILLSVIVATISVTSGVNKGIRFLSELNVLLALGLVLFILFVGDTEFLLNGLVQNVGDYISRFMGMTLNSFAFERPTEWMNSWTLFFWAWWVAWSPFVGLFLARISRGRTIRQFVMGTLIIPFVFTLIWLSVFGNSALYEIIHGNHELAETVLVHPERGFYNLLALYPAFTLSASVATITGLLFYVTSADSGSLVLGNFTSNLSDINNDAPNWLRIFWSVAIGVLTLGILMTDGISALQNMTVIMGLPFSFVIFFIMAGLYKSLRVEDFRKASALQNTSPTLVHDNGSLNWKQRLSRMMHFPGTKSTQRMLDMVCRPAMQEVAKELELRGASVQFNMLPSEEDKRLTPIELIVDLGDEQNFIYQIWPQRYSVPGFTYRARLGKSYYFRLETFLIEGTQGNDLMGYTKEQIISDILDHYEKHLNFIHLNRESPGQTLIFPNGV

SEQ ID NO: 798 - protein, 546 aa, Zea mays
MGLGAAVALALGDPPADYASIAAVGLFVALMCVCIVVGHLLEENRWMNESITALFIGLGTGAVILFASSGKHSRVLVFSEDLFFIYLLPPIIFNAGFQVKKKQFFRNFITITLFGAVGTLISFTVISLGALGLISRLNIGALELGDYLALGAIFSATDSVCTLQVLSQDETPFLYSLVFGEGVVNDATSVVLFNAIQNFDPGNISSAKLLNFIGSFLYLFGSSTILGVASGLLSAYTIKKLYFGRHSTDREVSIMMLMAYLSYMLAELLDLSGILTVFFCGIVMSHYTWHNVTESSRVTTKHAFATLSFISETFLFLYVGMDALDIEKWKIVGQTYSPVKSIALSSTILALVLVSRAAFVFPLSFVSNLTKKTPNGKISFRQQVIVWWAGLMRGAVSIALAYNKFTRSGHTQQPSNAIMITSTISVVLFSTIVFGLLTKPLIRLLIPSRHLSREPSALSEPSSPKSFFEQLAANSPGHPDLENGISLRRPASLRFLLVSPARSVHHYWRKFDDSFMRPVFGGRGFVPFVPGSPTESSLPLLPGNEN

SEQ ID NO: 799 - protein, 535 aa, Oryza sativa
MGMEVAAARLGALYTTSDYASVVSINLFVALLCACIVLGHLLEENRWVNESITALIIGLCTGVVILLMTKGKSSHLFVFSEDLFFIYLLPPIIFNAGFQVKKKQFFRNFMTITLFGAVGTMISFFTISIAAIAIFSRMNIGTLDVGDFLAIGAIFSATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDRPGKSIGISSILLGLVLIGRAAFVFPLSFLSNLTKKAPNEKITWRQQVVIWWAGLMRGAVSIALAYNKFTRSGHTQLHGNAIMITSTITVVLFSTMVFGMMTKPLIRLLLPASGHPVTSEPSSPKSLHSPLLTSMQGSDLESTTNIVRPSSLRMLLTKPTHTVHYYWRKFDDALMRPMFGGRGFVPFSPGSPTEQSHGGR

SEQ ID NO: 800 - protein, 762 aa, Zea mays
MAILSALATEVFIPVAAVIGIAFAVVQWVLVSRVKLSPAAAASGGSKNGYGDYLIEEEEGLNDHNVVVKCAEIQTAISEGATSFLFTEYQYVGIFMSIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLITTLFATDFFEVKAVKEIEPALKKQLIISTVLMTVGIAVISWLALPAKFTIFNFGTQKDVSNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATHGGLLFKYL

SEQ ID NO: 801 - protein, 766 aa, Zea mays
MAAAAILPELATQVLIPVAAAVGIAFAVVQWVLVSKVRVTPERRADGGAVKSGPSDYLIEEEEGLNDHNVVVKCAEIQTAISEGATSFLFTEYKYVGLFMGIFAILIFLFLGSVEGFSTKSQPCHYIKDQTCKPALANAIFSTIAFVLGAVTSLVSGFLGMKIATYANARTTLEARKGVGKAFITAFRAGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVDEIEPALKKQLIISTIVMTIGIALISWLGLPYTFTIFNFGVQKTVQSWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNNIPGLMEGTTKPDYATCVKISTDASIKEMIPPGALVMLTPLIVGILFGVETLSGVLAGALVSGVQIAISASNTGGAWDNAKKYIEAGVSEHARTLGPKGSDPHKAAVIGDTIGDPLKDTSGPSLNILIKLMAVESLVFAPFFAAHGGILFKWL

SEQ ID NO: 802 - protein, 765 aa, Zea mays
MAVLGTAAVEVLIPVAALVGIAFALLQWYVVARVPVPSHAGEDGGGGGNKNVREEEEHVEEDGMDYLLVEARCAEIQRAISVGATSFLLTEYKYLAVFTAAFAVVIFVFLGSAQRFSARPGPCAYDPSRECRPALANAAFSAVAFLLGAATSVLSGYLGMRVATFANARTALEARHGVGRAFAAAFRSGAAMGFLLASSALLVLYAAVNLFGLYYGDDWGGLYESITGYGLGGSSVALFGRVGGGIYTKAADVGADLVGKVERNIPEDDPRNPAVIADNVGDNVGDIAGMGSDLFGSYAESSCAALFVASISSFGAEHNLTAMMYPLLISAVGLLVCAITTVVATDVTEVKGSDEVGPALKRQILISTVLMTAGIAAVTFLGLPPSFTLFDFGNDKHVKNWHLFICVSAGLWAGLVIGYVTEYFTSNAYGPVQAVARSCRTGAATNVIFGLAVGYKSVIVPIMAIAAAIYASFRLAAMYGIALAALGMLSTIATGLAIDAYGPISDNAGGIAEMAGMPHRVRERTDALDAAGNTTAAIGKGFAIGSAALVSLALFGAYVSRAGITAVDVLSPRVFVGLLLGAMLPYWFSAMTMRSVGSAALRMVEEVRRQFDTIPGLAEGLAVPDYATCVRISTDASLKKMMAPGALVMFSPLVAGTLFGVETLAGLLAGALVSGVQVAISASNSGGAWDNAKKYIEAGLSEEARSLGPKGSEAHKAAVIGDTIGDPLKDTSGPSLNILIKLMAVESLVFAPFFAAHGGIIFDHL

SEQ ID NO: 803 - protein, 285 aa, Glycine max
MTVEKEDLGLSLSLSFPQNPPTHLHLNLVSSSPSSHNPQKPSWNDPFTSSAGSSFLRGIDVNRLPSVVDCEEEAGVSSPNSTVSSVSGKRSEREEANGEENDTDRACSRGIISDEEDAETSRKKLRLSKDQSIILEESFKEHNTLNPKQKLALAKQLGLRARQVEVWFQNRRARTKLKQTEVDCEFLKRCCENLTVENRRLQKEVQELRALKLSPQFYMHMTPPTTLTMCPSCERVAVPPSSAVDPAMRHHHVPPTQPRAFPIGPWATAAATIPHRPFDALRRRS

SEQ ID NO: 804 - protein, 175 aa, Glycine max
MKREREVDSLTMANCLMLLSRGSEFEATYSSTSMSNRVFECKTCNRQFPSFQALGGHRASHKKPRLMAGDIEGQLLHDSPPKPKTHECSICGLEFAIGQALGGHMRRHRAANLNGNVHNSTATSSSSGGSSFDSSPKKKADNKRVLVLDLNLTPFENDLEFLKIGKPTTFVDYLY

SEQ ID NO: 805 - protein, 324 aa, Glycine max
MERSGGMVTGSHERNELVRVRHGSDSRSKPLKNLNGQSCQICGDTIGLTATGDVFVACHECGFPLCHSCYEYELKHMSQSCPQCKTAFTSHQEGAEVEGDDDDEDDADDLDNEINYGQGNSSKAGMLWEEDADLSSSSGHDSQIPNPHLANGQPMSGEFPCATSDAQSMQTTSIGQSEKVHSLSYADPKQPGPESDEEIRRVPEIGGESAGTSASQPDAGSNAGTERVQGTGEGQKKRGRSPADKESKRLKRLLRNRVSAQQARERKKAYLIDLETRVKDLEKKNSELKERLSTLQNENQMLRQILKNTTASRRGSNNGTNNAE

SEQ ID NO: 806 - protein, 206 aa, Zea mays
MRTICDVCESAPAVLFCAADEAALCRPCDEKVHMCNKLASRHVRVGLADPNKLVRCDICENSPAFFYCEIDGTSLCLSCDMTVHVGGKRTHGRYLLLRQRVEFPGDKPGHMDDVPMEIQDPENQRDQKKPPKEQTANHHNGDDPATDGNCDDQGNIDSKMIDLNMRPVRTHGQESNSQTQGVGLSVNNHDSPGVVPTSNSERDTSK

SEQ ID NO: 807 - protein, 234 aa, Glycine max
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVAETTTATAQGVFYMEEEEQVLDMPELLRNMVLMSPTHCLGYEYEDADLDAQDAEVSLWNFSI

SEQ ID NO: 808 - protein, 678 aa, Glycine max
MQATQGEQSNNASAVHWERFLPRMVLRVLLVEADDSTRQIIAALLRKCGYKVVAFCDGLKAWETLKNKAFDLDLILTEVDLPSISGFSLLTLIMEHDICKNIPVIMMSSHDSVSMVFKCMLKGAADFLIKPVRKNELRNLWQHVWRRHAISRPPQNLTLPEIELGFAAENHAASNDSSGSVASTPKDDECSEKTSEAHSTCPSPFLEAESTYMENMQDILQLKSSSNLSNIDTVKHENSTKCERESDKHNDEAGEKSLFILEDARCNKTFKPTGLRLGQSYECHETRNQDEVLRIELIKSNPEINTDIHRCSDELVDPSTGAIDLIATFKNLPKSTDEKCSFSSGNTAKFDFDTQLELSLRRDFPGSSCKAAFKERQILNHSNASAFSRYSNSKLLQPLFPTPSTISAKLTNASQNSHESLKLSKNTSTSHQYSEKSQNQEEKIITSVIGQSGQVDPKLPNSQLGLFPATGVTSDHKSKGNGNVFPSKLYAKSGVHPISTPKSVCQKESSPFPTSTSSQSNPQSHNSERHHWLEDATHASDQNVNDQSNLECETHDSPAASQSAGPSFFHDTANHNSSGVYRSDGNATSAKVAKESHEIFIDSGQRSYDGFIGTDSHRTSQREAALTKFRLKRKDRCYEKKVRYQSRKRLAEQRPRVKGQFVRQVHDDHPVADVGGGS

SEQ ID NO: 809 - protein, 374 aa, Glycine max
MGIERGGFKGFRSAWSVPPKPCDSCKLASAALFCRPDSAFLCIACDSNIHCSNKLASRHERVWMCEVCEQAPAAVTCKADAAALCVTCDSDIHSANPLAQRHERVPVEPFFDSAESIVKASAAATFGFIVPSDDGGASDAFAPDDSDAAAWLIPNPNFGSKLMDAPEIKSKEIFFSEMDPFLDFDYSNSFQNNNSAGNDSVVPVQKPSLAPPLINNHHHHQSETCFDVDFCRSKLSSFNYPSNSLSQSVSSSSLDVGVVPDGNTVSDMSYSFGRNSSDSSGIVVVSGNSVGQGATQLCGMDREARVLRYREKRKNRKFEKTIRYASRKAYAETRPRIKGRFAKRTEIDSDVERLYSPGPAVLMLDTPYGVVPSF

SEQ ID NO: 810 - protein, 580 aa, Glycine max
MATPNPTRFSLAMERTGQWVFSPEIPTDVIVAVGQTNFSLHKFILAAKSNYVRKVIMESEESDLTRIEISDIPGGSEAFEKAAKFCYGVNFEITVHNVAALHCAAVFLQMTDEYCDGNLAGRTEDFLSQVGLSTLHSAVAVLKSCQKILPFAAEVNVVDRCVEVISCKACNEANFPSQSPPNWWTEELAVLDVDSFAKVIAAMKQRGAKYLTVAGALITYTERALRELVRDHSGGGRGIRSPESGDSDSESKRSEQRELLQAIVPLFPTEKAAFPINFLCCLLRCAIYLRASSACKRELEKRVTEILEHVTVDDLLVLTFSYDGERLLDLDSVRRIISGFVEREKGTTVFNAGVNFNEDFSAAMQRVAKTVDSYLAEIAAYAELSISKFNGIAILIPKGARKSDDDLYRAVDIYLKVHPNLDEIEKEKVCSVLDTLKLSYEARVHASKNKRLPLQIVLHALYYDQLQIRSGTAADKQAVVAAAEKKQLQADVSLVRENEELRSELMKMKMFISDLQKNVHGTSSSGRENIGPTKKPTFFSSMSKKLSKLNPFKNGSKDTSHIDDAPVDLTKPRKRRFSIS

SEQ ID NO: 811 - protein, 356 aa, Zea mays
MGRSPCCEKIGLKKGPWTPEEDQKLLAYIQEHGHGSWRALPVKAGLQRCGKSCRLRWTNYLRPDIKRGKFSLQEEQTIIQLHALLGNRWSAIATHLPNRTDNEIKNYWNTHLKKRLAKMGIDPVTHKSISGTRIGTTNDKSTKAAASLSHMAQWESARLEAEARLARESKIRTATPTPTALHAQPTILPASAASPCLDVLHAWQGAKIDLESPTSTLTFTGSNSGTLPTPRTNRLDVSESNCAVWHQRSDDLEDEENDWQIFSKHQLLELDSKEREEDFIGCEEPWFSEMAGVGAGFTGMLLGVSNEHDASECWGESNNGQTERSNQASDEEDKNYWNGVLDMVNSELTPKSPPFV

SEQ ID NO: 812 - protein, 248 aa, Arabidopsis thaliana
MKIQCDVCEKAPATVICCADEAALCPQCDIEIHAANKLASKHQRLHLNSLSTKFPRCDICQEKAAFIFCVEDRALLCRDCDESIHVANSRSANHQRFLATGIKVALTSTICSKEIEKNQPEPSNNQQKANQIPAKSTSQQQQQPSSATPLPWAVDDFFHFSDIESTDKKGQLDLGAGELDWFSDMGFFGDQINDKALPAAEVPELSVSHLGHVHSYKPMKSNVSHKKPRFETRYDDDDEEHFIVPDLG

SEQ ID NO: 813 - protein, 486 aa, Glycine max
MLDLNLNAEWTDSFSNGESPLPLEKFPDGLRNQMAESGTSNSSVVNADGSSNGGGDEDSDSTRAADDVYTTFNFDILKVEGANGFVTKELFPVMSEGAKGHATSSFSGTNGFVDLSFDGDGGNTSEMKMLQPQNQNQTQTRTQTQQPAKKSRRGPRSRSSQYRGVTFYRRTGRWESHIWDCGKQVYLGGFDTAHAAARAYDRAAIKFRGVDADINFNLSDYEDDLKQMQNLSKEEFVHILRRQSTGFSRGSSKYRGVTLHKCGRWEARMGQFLGKKYIYLGLFDSEVEAARAYDKAAIKCNGREAVTNFEPSTYEGELKSAAINEGGSQNLDLNLGIATPGPPKENWGQLQFPSFPYNTHGGRSSMMETNVSSGIGNPSLKRMVATEDRPSLWNGMSPNFFPNGERAERIGVDPSNGLPNWAWQTHGQVNATPVPTFSAAASSGFSISATFPSAAIFPTSSMNSIPQSLCFTSSSMPTRNASEYYY

SEQ ID NO: 814 - protein, 750 aa, Glycine max
MDAYSSGEEVVVKTRKPYTITKQRERWTEEEHNRFLEALKLHGRAWQRIEEHIGTKTAVQIRSHAQKFFTKLEKEALVKGVPIGQALDIDIPPPRPKRKPNNPYPRKTRIGTTSLHSGAKDGKLNLVESSHVNQALDLKKEPLPEKHDLDEGLTTVKENKDENHAKVFTLLQEVPCSSVSSANESSITMSVPLGNPCAFKEITPSVKEVIARDEKTESFVTVEPENGKLEINDGKQTNGTSKDSRLEDSDALHMKLVQNEKPDGLDCELTIDGMQGNQNYPRHVTVHVVDGNLGTNTQNPSQDMLFRDSMFQPIGGVNGQRNVFTNTAPSNTSESQNNTARSSVHQSFLPYPPFTQHNQDDYQSFLHMSSTFSNLIVSTLMQNPAAHAAASFAATFWPYANPETSANSPRCSQGGFTNRQIGSPPSVAAIAAATVAAATAWWAAHGLLPLCAPLHTSFACPASVTTVPSMNTGEAPALKAEQEKTTLQNPPLQDQMLDPEYSEAQQAQHSASKSPAAILSDSESGDAKLNTSSKVTDHETNKTISEHLDSNKTKGRKPVDRSSCGSNTASSSDVETDALEKGEKGKEEPEIPDANQLAIEFSNRRRSVSNLTDSWKEVSEEGRLAFQALFSREVLPQSFSPPHALKNTDHQMDNANDNKQNIDDKDEDLDGSKKCSSNYEAMQKNLLFVENNEGLLTIGLGQGKLKTHRTGFKPYKRCSMEAKENRVGASSNQGEEQGCKRIRLEGETST

SEQ ID NO: 815 - protein, 426 aa, Glycine max
MEFDAAIPVSREHLPQDAMWQINLRSSETMESEPYPEHPGEPDCSYYIRTGLCRFGATCRFNHPPNRKLAIAAARMKGEFPERIGQPECQYYLKTGTCKFGATCRFHHPRDKAGIAGRVALNILGYPLRPNEPECGYYLRTGQCKFGNTCKFHHPQPNNMVLSMRSSPVYPTVHSPTTPGHQSYATGITNWSSSSYIPSPRWQGPSSYAPLILPQGMVSVSGWSAYSGQMGSDSPQQTMANGQSYGTSRQSEPANSGSQGAYSQFRSGSVPVGFYALQRENIFPERPDQPECQFYMKTGDCKFGAVCRFHHPHERMIPAPDCVLSPIGLPLRPGEPLCVFYSRYGICKFGPSCKFDHPMGVFTYNMSASPLADAPGRRMLGSSSGTSALNLSSEGLVESGSENPRRLSLSETRQIPSGDDNIDEEG

SEQ ID NO: 816 - protein, 564 aa, Glycine max
MVSSVSWVRGKCVGKGAFGVVNVAVSKRDNRVFAVKSVDCGRGLSGQVEALENEIGILKRVTSPHVVAYIGDDVTCEGTASFRNLHLEYMPGGTVADLDRADVDERLVRRYAWCLATALRDVHAQGFVHCDVKGRNVLLSGDGEMAKLADFGAAVEIESSPAMLLFPRGSPMWMAPEVVRRERQGPESDVWSLGCTVIEIAIGKPAWEDRGVDTLSRIGYSDELPEFPIQLSELGKDFLEKCLRREPSERWSCDQLLQHPYLLPYYALVESSPRCVLDRVDSELNSESDYNDRDHQEEVFSIFTNIEENSVIKNRISKLATESRVNWETHGWVVVREVESNGEPTTTGTEEEGACTCERDGVGSNKEGVNWEFHNVAETGMVYSDSVGANRRIRKFGGSNTAGGGVGCCCRYGCGWEKLGRNRGIISIYSLYCKNFMSYNLIFLMYINILCFSIKKKKKKKKKKKKKKKKKKKKKKKKKKKKKKKKKKKKKKKKKGGPPPFRAFPPRKLIWARPLGGTHFFFKEGLKKLGEKREKIFSWGKIFSVKNPQKIKPRKIKGKNPGGL

SEQ ID NO: 817 - protein, 593 aa, Glycine max
MAVDSEVPRAERSAKALQFIEEVTKNTDSVQERVLTEILTQNAETEYLKRFGLNGATDRDTFKSKVPVVTYEDLQPDIQRIANGDSSPILCSHPISEFLTSSGTSAGERKLMPTIHEEMDRRQLLYSLLMPVMNQYVSDLDKGKALHFLFIKAEAKTPGGLVARPVLTSYYKSEQFRKRPFDPYNVLTSPNEAILCPDSFQSMYTQMLCGLIMRHEVLRVGAVFASGLLRAIRFLQLNWEQLSHDILTGTLNPKITEPSIKERMSKILKPDPQLAAFIKNECSVENWERIIVRIWPNTKYLDVIVTGAMAQYIPTLDYYSGGLPKPCTMYASSECFFGLNLKPMSEPSDVSYTILPNMGYFEFLPHDDSSPVTLSKDSPPRLVELADVELGKYYELIITTYSGLCRYRVGDILQVTGFHNSDPQFRFVRRKNVLLSIDSDKTDEAELQKAIENASELLKEFNTSVVEYTSFADTKSIPGHYVIYWELMMKDSSHPPTNQVLNQCCLVMEESLNSVYRQGRVADNSIGPLEIRVVKNGTFEELMDYAISRGASINQYKVPRCVSFTPIMELLDSRVVSFHFSPAAPHWTPERRR

SEQ ID NO: 818 - protein, 215 aa, Zea mays
MAHPRSVAAAAPLLLLLAAAAAAAAGLVSAASPAASDFVRKSCRTTQYPSVCEQSLASYGGSPPPRSPRELARAALSVSADRARAASAYVGRLCGASNGKGAKKGSGSASASASAGPVRDCLDNLADSVGHLRDAAQEMGGAGMGRAGTPAFRWHLSNVQTWCSAALTDEDTCLDGLSSRAVDAGTRAAIRGKVVEVAQVTSNALALVNKVGPGY

SEQ ID NO: 819 - protein, 308 aa, Zea mays
MAKLWTLLLAAVVVLSLLVSPIACTRKLNKPKPKPGSYRRPVKPKPKPVTGSYKPAPVAARRNHTATPTPSPTVYGPGGWLSGAGATYYGATNGDGSDGGACGYQTAVGKKPFDSMIAAGSTPLYRGGEGCGACYEVKCTTNAACSGQPVTIVITDQSPGGLFPGEVEHFDMSGTAMGAMARPGMADKLRAGGVLRILYRRVPCKYTGVNIAFKVDQGANPYYFDVLIEFEDDDGDLSAVDLMEAGSGVWTPMAHNWGATWRLNNGRKLKAPFGLRLTSDSRRVLVANNAIPAAWKPGKTYRSLVNYP

SEQ ID NO: 820 - protein, 129 aa, Zea mays
MEGDSFSGGAMANGGGGGGGGSGQVVDGKLIHTFHRSFVQVQSLLDQNRMLISEINQNHESRAPDNLTRNVGLIRELNNNIRRVVGLYADLSASFARTMDHASSEGDSSGTGNNGRAGAGAGHKRVRPA

SEQ ID NO: 821 - protein, 214 aa, Zea mays
MAKSSSYGLGLACFFAIAAAVAGGTQFMVGGANGWSVPTAGAEPFNTWAERTRFQIGDSLVFVYPKDQDSVLLVEPADYNACDTSSYVRKFDDGDTVVTLDRSGPLFFISGVEANCRANEKLIVMVLAARSNGNGTGGGARAPSTAPQPASPAASPPPASSTPPPPSSPAPKGASPPPASAPTTSPGTTPPPAPSASSPAPAGSETRTRRRGTR

SEQ ID NO: 822 - protein, 110 aa, Zea mays
MAATKLQALWNHPAGPKTIHFWAPTFKWGISIANIADFAKPPEKISYPQQVAVACTGLIWSRYSLVITPRNWNLFSVNVAMAGTGLYQLSRKIRQDYLSDEKDAASQLEA

SEQ ID NO: 823 - protein, 458 aa, Zea mays
MGSAGGGGESKLESPLLGASSTGHGEAVIFSGHLGTLELAAASLGNTGIQVFAYGLMLGMGSAVETLCGQAYGAHKYDMLGIYLQRSTVLLMATGVPLAALYAFSRPVLLLLGESPEIASAAAVFVYGLVPQIFAYAANFPIQKFMQAQSIMGPSAYISAAALAAHLALSYLVVYRLGLGLLGASLTLSASWWAIVAAQFAYIVTSSRCRLTWRGFSWQAFSGLPSFFRLSLASAVMLCLETWYFQILVLIAGLLKDPELALASLSVCMTISGWVFMISVGFNAAASVRVSNELGAGNPRAAAFSVVVVTLLSFVLSVLVSAVILLCRDYISYIFTEGEDVSQAVSRLTPLLAFTLILNGIQPVLSGVAVGCGWQAFVAYVNVGCYYIVGIPLGCLLGFYFDLGAAGIWSGMIGGTLMQTLILIWVTFRTNWNKEVEEAQKRINKWDDGKAPLLSAQE

SEQ ID NO: 824 - protein, 435 aa, Glycine max
MLSIKRVPTVVSNYQKEETGEAAAGGCGRNCLKSCCIQGARLPLYAFKKVDKVCGNELPLLGCKEQHPVAFLDSLVLGEWEDRMQRGLFRYDVTACETKVIPGEYGFIAQLNEGRHLKKRPTEFRVDKVLQPFDENKFNFTKVGQEEVLFQLEASNDGEAQFFPNAPIDVENSPSFVAINVSPIEYGHVLLIPRIFKCLPQRIDHASFLLALQMAVEARNPYFRLGYNSLGAFATINHLHFQAYYLALPFPIEKAPTKKIAKLSGGVIISKLLNYPVRGLVFEGGHTLEDLANAVSEACICLQHNNIPYNVLISDCGRQIFLLPQCYAEKQALGEVSPELLETQVNPAVWEISGHMVLKRKKDYEEASEANAWRLLAEVSLSEERLLEVTALVFQAITSSVEMNVKPQRLEEVDAVSPNAQHAMVAGSHECLVLQ

SEQ ID NO: 825 - protein, 768 aa, Zea mays
MASLGDIGLAAGLNVLTAVAFLLAFAFLRLQPINDRVYFPKWYLRGMRDNPIVSGAAVQKFVNLDARSYLKFLNWMPAALKMPQDELINHAGLDSVVYLRIYVTGLKIFVPITVLAFLVLVPVNWTNDTLGRINVVYSPIDKLSISNVPNGSKRFIAHLGMAYAITFWTCYVLLKEYEIISNMRLRFLASEKRRPDQFTVLVRNIPPDPDESISELVEHFFLVNHPDHYLQHQVVYNANKLADLVEKKKKMRNWLDYYLLKYERNSSLRPTTKTGFLGCFGSKVDAIDYYKSEIEKIGKQEAEERKNVMKDPKSVVPAAFVSFRSRWGAAVCAQTQQTSNPTLWLTEWAPEPRDVYWNNLSIPFVSLTIRRLIVAVAFFFLNFFYVIPITFVQSLANLEGIEKALPFLKPLIDLPFIKSFIQGFLPGIALKIFLIVLPTILMFMSKFEGLISQSSLERRSASKYYIFLFFNVFLGSVIAGSALEQLKTYLHTSANDIPRIIGDSIPMKATFFITYVMVDGWTGIAGEILRLKPLIFFHLKNFFLVKTEKDREEAMDPGSICFDSTEPRIQLYFLLGLVYAAVTPFLLPFILVFFGFAYVVFRHQIINVYNQQYESAAQFWPSVHGRIITALIVSQLLLLGLMSTNDFEQTTPVLLVLPVLTFGFYKYCKNRFEPAFVRNPLQEAMKKDTLERAREPNLDLKAYLANSYLHPVFKGDEGDDRYSVMDDDGWMEEEVIVPTKRHSRRTTPAQSKHEGSDSLSVLESSLQR

SEQ ID NO: 826 - protein, 540 aa, Oryza sativa
MTTVASLSLLPHLLIKPSFRCCSRKGVGRYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAQMETLVNDRLLQDGGSSASTAECTSLAPSTSSASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVLNEDLRVVLGQQDGCQWRKCLELASIICKLGIRYRLWRDAIERGVDRLPFSNQSESGS

SEQ ID NO: 827 - protein, 367 aa, Arabidopsis thaliana
MYPPPPSSIYAPPMLVNCSGCRTPLQLPSGARSIRCALCQAVTHIADPRTAPPPQPSSAPSPPPQIHAPPGQLPHPHGRKRAVICGISYRFSRHELKGCINDAKCMRHLLINKFKFSPDSILMLTEEETDPYRIPTKQNMRMALYWLVQGCTAGDSLVFHYSGHGSRQRNYNGDEVDGYDETLCPLDFETQGMIVDDEINATIVRPLPHGVKLHSIIDACHSGTVLDLPFLCRMNRAGQYVWEDHRPRSGLWKGTAGGEAISISGCDDDQTSADTSALSKITSTGAMTFCFIQAIERSAQGTTYGSLLNSMRTTIRNTGNDGGGSGGVVTTVLSMLLTGGSAIGGLRQEPQLTACQTFDVYAKPFTL

SEQ ID NO: 828 - protein, 298 aa, Arabidopsis thaliana
MGKEVMVSDYGDDDGEDAGGGDEYRIPEWEIGLPNGDDLTPLSQYLVPSILALAFSMIPERSRTIHDVNRASQITLSSLRSSTNASSVMEEVVDRVESSVPGSDPKKQKKSDGGEAAAVEDSTAEEGDSGPEDASGKTSKRPRLVWTPQLHKRFVDVVAHLGIKNAVPKTIMQLMNVEGLTRENVASHLQKYRLYLKRIQGLTTEEDPYSSSDQLFSSTPVPPQSFQDGGGSNGKLGVPVPVPSMVPIPGYGNQMGMQGYYQQYSNHGNESNQYMMQQNKFGTMVTYPSVGGGDVNDK

SEQ ID NO: 829 - protein, 258 aa, Zea mays
MGEEAVDDYELHMVCYGGGGGGSEDERVMEWESGLPGADELTPLSQPLVPAGLAAAFRIPPEAGRTLLDVHRASAATVSRLRRAPPPSSSGSGGSSSFAPFHPAARGDEGADSSAAGGGAAATTNGNNNMSSSSKRPRLVWTPQLHKRFVDVVAHLGMKNAVPKTIMQLMNVEGLTRENVASHLQKYRLYVKRMQGLSDEGPSPSDHIFASTPVPQSLVHEVPMYGTMASGGQAYHNHNGMGGGGYQYQYHHYHHAHK

SEQ ID NO: 830 - protein, 335 aa, Arabidopsis thaliana
MLEGLVSQESLSLNSMDMSVLERLKWVQQQQQQLQQVVSHSSNNSPELLQILQFHGSNNDELLESSFSQFQMLGSGFGPNYNMGFGPPHESISRTSSCHMEPVDTMEVLLKTGEETRAVALKNKRKPEVKTREEQKTEKKIKVEAETESSMKGKSNMGNTEASSDTSKETSKGASENQKLDYIHVRARRGQATDRHSLAERARREKISKKMKYLQDIVPGCNKVTGKAGMLDEIINYVQCLQRQVEFLSMKLAVLNPELELAVEDVSVKQAYFTNVVASKQSIMVDVPLFPLDQQGSLDLSAINPNQTTSIEAPSGSWETQSQSLYNTSSLGFHY

SEQ ID NO: 831 - protein, 1059 aa, Zea mays
MAGNDWINSYLEAILDAGGAAGDLSAAAGSGDGRDGTAVEKRDKSSLMLRERGRFSPARYFVEEVISGFDETDLYKTWVRTSAMRSPQERNTRLENMSWRIWNLARKKKQIEGEEASRLSKQRMEFEKARQYAADLSEDLSEGEKGETNNEPSIHDESMRTRMPRIGSTDAIDTWANQHKDKKLYIVLISIHGLIRGENMELGRDSDTGGQVKYVVELARALGSTPGVYRVDLLTRQISAPDVDWSYGEPTEMLSPISSENFGLELGESSGAYIVRIPFGPRDKYIPKEHLWPHIQEFVDGALVHIMQMSKVLGEQIGSGQPVWPVVIHGHYADAGDSAALLSGALNVPMVFTGHSLGRDKLDQILKQGRQTRDEINATYKIMRRIEAEELCLDTSEIIITSTRQEIEQQWGLYDGFDLTMARKLRARIRRGVSCFGRYMPRMIAIPPGMEFSHIAPHDVDLDSEEGNGDGSGSPDPPIWADIMRFFSNPRKPMILALARPDPKKNITTLVKAFGEHRELRNLANLTLIMGNRDVIDEMSSTNAAVLTSALKLIDKYDLYGQVAYPKHHKQSEVPDIYRLAARTKGVFINCALVEPFGLTLIEAAAYGLPMVATRNGGPVDIHRVLDNGILVDPHNQNEIAEALYKLVSDKHLWSQCRQNGLKNIHKFSWPEHCQNYLARVVTLKPRHPRWQKNDVAAEISEADSPEDSLRDIHDISLNLKLSLDSEKSGSKEGNSNALRRHFEDAAQKLSGVNDIKKDVPGENGKWSSLRRRKHIIVIAVDSVQDADFVQVIKNIFEASRNERSSGAVGFVLSTARAISELHTLLISGGIEASDFDAFICNSGSDLCYPSSSSEDMLNPAELPFMIDLDYHSQIEYRWGGEGLRKTLIRWAAEKNKESGQKIFIEDEECSSTYCISFKVSNTAAAPPVKEIRRTMRIQALRCHVLYSHDGSKLNVIPVLASRSQALRYLYIRWGVELSNITVIVGECGDTDYEGLLGGVHKTIILKGSFNTAPNQVHANRSYSSQDVVSFDKQGIASIEGYGPDNLKSALRQFGILKD

SEQ ID NO: 832 - protein, 972 aa, Zea mays
MYGNDNWINSYLDAILDAGKGAGPARGRGGGGGDRPSLLLRERGHFSPARYFVEEVITGYDETDLYKTWLRANAMRSPQEKNTRLENMTWRIWNLARKKKEFEKEEANRLSKRRLEAEKPQNDATADMSEDLFEGVKGEDVGDPSVAYGDSTAGNTPRISSFDKLYIVLISLHGLIRGENMELGRDSDTGGQVKYVVELAKALSSCPGVYRVDLLTRQIIAPNFDRGYGEPDEMLALTSFKNFKCERGENSGAHIIRIPFGPKEKHLAKENIWPFIQEFVDGALGHIVRMSKTLGEETGSVCPVWPAVIHGHYASAGVAAALLSGALNVPMVFTGHFLGKDKLEGLLKQGRQTREQINVTYKIMRRIEAEELSLDASEIVIASTRQEIEEQWNLYDGFEVMLARKLRALVKRGANCYGRYMPRMVIIPPGVEFGQLIHDFDIYGDEDNPSPASEDPSIWFEIMRFFTNPRKPMILAIARPYAEKNIATLVKAFGECHPLRELANLTLIMGNREAISKMNKISAAVLTSVLTLIDEYDLYGQVAYPKHHKHSEVPDIYRLAARTKGAFINVAYFEQFGVTLIEAAMHGLPVIATKNGAPVEIHQVLENGLLVDPHDQHAIADALYKMLSEKQFWSRCRENGLKNIHQFSWPEHCKNYLSRILTLGPRHPAFACKEDHKVPVKCRKHIFVIAVDSVNKEDLIQIIRNSVEATRSGTMSDLTGFVLSTSLTIAELQSVIVRTGMLPTDFDAFICNSGSDIYYPSQSSDVPSNSRVTFASDHNYRSHIEYRWGGEGLRKYLVKWVSSVVERRGRTEKQVIFEDSEHSSTYCLAFKVINPSHLPPLKELQKLMRIQSLRCHALYNHGATRLSVIPIHASRSQALRYLSICWGIELPDAVVIVGETGDSDYEELFGGLHKTVILKGGFNTPANRIHTVRRYPLQDVVALDSSNIIAIEGFSTGDIRSAMQQQLGIPTR

SEQ ID NO: 833 - protein, 448 aa, Zea mays
MALLVRRARRAATKAAVSLAGRTGSVELAIPAHFRCPISLDLMRDPVTAPAGITYDRESIEAWLDTGRATCPVTHAPLRHEDLVPNHAIRRVIQDWCVANRSRGVERIPTPKIPVTPVQASELLFDLAGSARRRDAAARCAEVVTKIKVLARDSERNRRCFASIGTGRVLAAAFESLAAAAAADAAAPAGRVLEDILAALVCMMPLDEEAARTLALPTSLGSLVAIAENGSLAGRLNAVLAIKEVVSCDGAVTDLSGKADEIVDALAKIIKSPICPQATKAGMVATYHLALYDERVAARLAAAGLVPVLVEVLVDADKSMSEKALAVLDAVLASEEGRASARAHALAVPMLIKKMFRVSDLATQLAVSAMWRLGKAHSDGEDDGAVTRCLVEALGVGAFQKLLLLLQVGCRDATKEKATELLKLLNKYKSVGECVDAVDFRGLNKLSS

SEQ ID NO: 834 - protein, 431 aa, Glycine max; identical to SEQ ID NO: 660

SEQ ID NO: 835 - protein, 396 aa, Escherichia coli [sequence omitted]

SEQ ID NO: 836 - protein, 112 aa, Nostoc sp. PCC 7120
MKKVEAIIRPFKLDEVKIALVNAGIVGMTVSEVRGFGRQKGQTERYRGSEYTVEFLQKLKVEIVVEDNQVDMVVDKIIAAARTGEIGDGKIFISPVEQVIRIRTGEKNTEAV

SEQ ID NO: 837 - protein, 197 aa, Brassica napus
MAASIAKPISATSLRFYSDRKNNISFSDCISISSGFRHSPPSSLDLVAKPPPTKARVSHLVRAQSSYDYIPDSKFYKVEAIVRPWRIQHVSSALLKIGIRGVTVSDVRGFGAQGGSKERHGGSEFSEDKFVAKVKMEIVVKKEQVESVINTIIDGARTGEIGDGKIFVLPVSDVIRVRTGERGEQAEKMTGDMLSSS

SEQ ID NO: 838 - protein, 487 aa, Arabidopsis thaliana
MQPWRRKFPLFETGVTMKQRKNSNLSIFVVVFSVFLFGIFMYNEDVKSIAEFPFSTSKPHDVHDEATPITEITTLPVQESIKNSDPIQESIKNADSVQDSVKDVAEPVQEEVSKTEEVKKIELFAATEDEEDVELPPEECDLFTGEWVFDNETHPLYKEDQCEFLTAQVTCMRNGRRDSLYQNWRWQPRDCSLPKFKAKLLLEKLRNKRMMFVGDSLNRNQWESMVCLVQSVVPPGRKSLNKTGSLSVFRVEDYNATVEFYWAPFLVESNSDDPNMHSILNRIIMPESIEKHGVNWKGVDFLVFNTYIWWMNTFAMKVLRGSFDKGDTEYEEIERPVAYRRVMRTWGDWVERNIDPLRTTVFFASMSPLHIKSLDWENPDGIKCALETTPILNMSMPFSVGTDYRLFSVAENVTHSLNVPVYFLNITKLSEYRKDAHTSVHTIRQGKMLTPEQQADPNTYADCIHWCLPGLPDTWNEFLYTRIISRS

SEQ ID NO: 839 - protein, 475 aa, Glycine max
MMALNISSPAEVKSIFFADYFKSNCITAKFTGGFAFKRKERGAASGGRVCCSVLAPPPPPAWPGRAVPEQGSKTWDGPKPISIVGCTGSIGTQTLDIVAENPDKFKVVALAAGSNVTVLADQVKRFKPQLVAVRNESLIAELKEALHDVEEKPEIIPGEQGIIEVARHPDAVSVVTGIVGCAGLKPTVAAIEAGKYIALANKETLIAGGPFVLPLAQKHNVKILPADSEHSAIFQCIQGLPEGALRRVILTASGGAFRDWPVDKLKDVKVADALKHPNWNMGKKITVDSATLFNKGLEVIEAHYLFGADYDHIEIVIHPQSIIHSMIETQDSSVLAQLGWPDMRLPILYTLSWPDRIYCSEDTWPCLDLCKIGSLTFKTPDNVKYPSMNLAYAAGRAGGTMTGVLSAANEKAVEMFIDEKISYLDIFKVVELTCEKHQNELLSSPSLEEIIHYDLWAREFAASLQDSSSFTPILA

SEQ ID NO: 840 - protein, 394 aa, Synechocystis sp. PCC 6803
MVKRISILGSTGSIGTQTLDIVTHHPDAFQVVGLAAGGNVALLAQQVAEFRPEIVAIRQAEKLEDLKAAVAELTDYQPMYVVGEEGVVEVARYGDAESVVTGIVGCAGLLPTMAAIAAGKDIALANKETLIAGAPVVLPLVEKMGVKLLPADSEHSAIFQCLQGVPEGGLRRIILTASGGAFRDLPVERLPFVTVQDALKHPNWSMGQKITIDSATLMNKGLEVIEAHYLFGLDYDHIDIVIHPQSIIHSLIEVQDTSVLAQLGWPDMRLPLLYALSWPERIYTDWEPLDLVKAGSLSFREPDHDKYPCMQLAYGAGRAGGAMPAVLNAANEQAVALFLQEKISFLDIPRLIEKTCDLYVGQNTASPDLETILAADQWARRTVLENSACVATRP

SEQ ID NO: 841 - protein, 397 aa, Agrobacterium tumefaciens
MTNASEMPRKLTILGSTGSIGTNTLDVVRQLGGRDGFEIMALTGAGNIALLAEQAREFGAQLAVTADDDKYEALKSALAGTGIKVAAGMAGLEEAASMDAGWVMAAIAGTPGLAPTLTAARRGADIALANKECLVSAGDVFLRTVKQGGGRLIPVDSEHSAIFQCLTGEYKQAVERIVLTASGGPFRTWSRDEMSNVTADIARAHPNWSMGLKVSIGSASMFNKGLEMIEAKYLFDLRPDQVDVIVHPQSIIHSMVGYTDGSYIAQLGSPDMRTAISYALTYPERGNLSVERLDFAKLARLDFEAPDEARFPALRLARMALERGGLQGAALNAAEETAFHAFVAGGIGFLDMAEIVETVMDRMHDGRTAETMDDVFSADEEARRHALELIATKEKAA

SEQ ID NO: 842 - protein, 719 aa, Zea mays
MALSTFSVPRGFLGVPAQDSHFASAVELHVNKLLQARPINLKPRRRPACVSASLSSEREAEYYSQRPPTPLLDTINYPVHMKNLSVKELRQLADELRSDVIFHVSKTGGHLGSSLGVVELTVALHYVFNAPQDRILWDVGHQSYPHKILTGRRDKMPTMRQTNGLAGFTKRAESEYDSFGTGHSSTTISAALGMAVGRDLKGGKNNVVAVIGDGAMTAGQAYEAMNNAGYLDSDMIVILNDNKQVSLPTATLDGPVPPVGALSSALSKLQSSRPLRELREVAKGVTKQIGGSVHELAAKVDEYARGMISGPGSSLFEELGLYYIGPVDGHNIDDLITILNDVKSTKTTGPVLIHVVTEKGRGYPYAERAADKYHGVAKFDPATGKQFKSPAKTLSYTNYFAEALIAEAEQDSKIVAIHAAMGGGTGLNYFLRRFPSRCFDVGIAEQHAVTFAAGLACEGLKPFCAIYSSFLQRGYDQVVHDVDLQKLPVRFAMDRAGLVGADGPTHCGAFDVAYMACLPNMVVMAPSDEAELCHMVATAAAIDDRPSCFRYPRGNGVGVPLPPNYKGTPLEVGKGRILLEGDRVALLGYGSAVQYCLTAASLVQRHGLKVTVADARFCKPLDHALIRSLAKSHEVLITVEEGSIGGFGSHVAQFMALDGLLDGKLKWRPLVLPDRYIDHGSPADQLAEAGLTPSHIAASVFNILGQNREALAIMAVPNA

SEQ ID NO: 843 - protein, 639 aa, Agrobacterium tumefaciens
MTGMPQTPLLDRVNFPSDLKEIDDRDLPELARELRDEMIDAVSKTGGHLGAGLGVVELTIAIHKVFNTPEDRLIFDVGHQCYPHKILTGRRDRIRTLRQEDGLSGFTRRAESEYDDFGAGHSSTSISAGLGMAVAAGLDGSDRKVIAVIGDGSMSAGMAFEALNNAGALDARLIVILNDNDMSIAPPTGAMSAYLARLASGRTYMGFRDFGKKLTAYLGKTIDRAITRAVTHARGYVTGGTLFEELGFYHIGPIDGHSFDHLLPVLRNVRDNQKGPVLIHVVTQKGKGYAPAEAAADKYHGVNKFDVITGAQAKAKPNAPSYTSVFAEALIQEATLDEKIIGVTAAMPNGTGLDKMAELFPSRTFDVGIAEQHAVTFAAGLAADGYKPFCALYSTFLQRGYDQLVHDVAIQSLPVRFPIDRAGFVGADGPTHAGSFDTTFLATLPGMVVMAAADEAELKHMVRTAAAYDEGPISFRYPRGEGVGVEMPARGEILQIGKGRIIKEGTKVALLSFGTRLAECLAAAEDLDAAGLSTTVADARFAKPLDLDLIRQLAAHHEVLVTIEEGSVGGFGAHVLHFMASAGLLDHGPKVRTLTLPDQWVEQAKPETMYANAGLDRAGIVSTVFNALGQRQAGVGFAG

SEQ ID NO: 844 - protein, 670 aa, Xylella fastidiosa
MRIRSVINVIFMLHRIACSGPLWGGQWCFRCNAKTMIDSTCYPRLSRIQIPEDLRTFQESELRAVADELRNYLIESVGLSGGHFAAGLGVVELTIALHYLYCTPIDHLVWDVGHQTYPHKILTGRRDKISTVKHQGGLAPFPKREESIYDTFGVGHSSTSISAALGMAIVAQRHGDERKVVAIIGDGAMTAGMAYEALNHAGGMSPAPNLLVILNDNRMSISEAVGGLTKMLGRATGSKALNAIREGGKRIFGDKKTNATARFLRRWEEHWKGMFVPSTLFEEMGFHYTGPIDGHDLPALLGALKTLRTLKGPQLLHVITTKGKGYELAEGDQIGYHAVAPFDPQKGLIKAGAKKQTYTDVFSEWLCDMAAVEPRLLAITPAMREGSGLVRFSQEYPQRYFDVAIAEQHAITLAAGMATQGAKPVVAIYSTFLQRGYDQLVHDVALQKLDVLFAVDRGGVVGPDGATHAGNLDLSFLRCVPNMMLMAPADEAECRKMLSTGFHYSGPVAVRYPRGTGPGVVPSAELDVLPVGVAQLRHSGTRIALLGFGVCVAPAEQVGRRLGLTVVNMRFIKPLDRTLLLELARTHEGFVTIEDNVVAGGAGSGVAELLNAEGIVLPIVHLGLPDAFQQHASREDLLAEAGIDAAGVYAALLSRWPDLAVQNHPLSAVS

SEQ ID NO: 845 - protein, 323 aa, Zea mays
MGVLEDLVARAGGCAVIDGGFATQLEALGADINDPLWSAACLITRPHLVKEVHMQYLEAGADVIISSSYQATIPGFIARGMSVAEAEDLLRTSVKLANEARDEFWKSTLRKSKPIYNRALVAASIGSYGAYLADGSEYSGSYGADITAEKLKDFHRRRLQVLASAGPDLIAFEAIPNQMEAQALVELLEEEKVQIPSWICFSSVDGKNLCSGESFADCLKILNASEKVAVVGVNCTPPQFIEGIICEFRKQTKKAIAVYPNSGEVWDGRAKRWLPVECLGHKSFDALAKRWQEAGASLIGGCCRTTPSTIRAVSKILKGRTGH

SEQ ID NO: 846 - protein, 338 aa, Zea mays
MVGTAEGGAERAVRRWVDAAGGRLVLDGGLATELEANGADLNDPLWSAKCLLSSPHLIRKVHMDYLEAGANIIITASYQATIQGFESKGFSKEQSENLLTKSVQIALEAREMFLKEHLEKSTPIQHPILVAAALGSYGAYLADGSEYSGDYGEAGTKEFLKDFHRRRLQVLAEAGPDLIAFETIPNKLEAQAYVELLEECNINIPSWLSFNSKDGVHVVSGDSLIECATIADKCAKVGAVGINCTPPRFIHGLILSIRKVTDKPILIYPNSGERYDGEKKEWVESTGVSDGDFVSYVNEWCKDGAALIGGCCRTTPNTIRAIHRTLNQGCHKHQLPVA

SEQ ID NO: 847 - protein, 310 aa, Escherichia coli
MSQNNPLRALLDKQDILLLDGAMATELEARGCNLADSLWSAKVLVENPELIREVHLDYYRAGAQCAITASYQATPAGFAARGLDEAQSKALIGKSVELARKAREAYLAENPQAGTLLVAGSVGPYGAYLADGSEYRGDYHCSVEAFQAFHRPRVEALLDAGADLLACETLPNFSEIEALAELLTAYPRARAWFSFTLRDSEHLSDGTPLRDVVALLAGYPQVVALGINCIALENTTAALQHLHGLTVLPLVVYPNSGEHYDAVSKTWHHHGEHCAQLADYLPQWQAAGARLIGGCCRTTPADIAALKARS

SEQ ID NO: 848 - protein, 324 aa, Saccharomyces cerevisiae
MKRIPIKELIVEHPGKVLILDGGQGTELENRGININSPVWSAAPFTSESFWEPSSQERKVVEEMYRDFMIAGANILMTITYQANFQSISENTSIKTLAAYKRFLDKIVSFTREFIGEERYLIGSIGPWAAHVSCEYTGDYGPHPENIDYYGFFKPQLENFNQNRDIDLIGFETIPNFHELKAILSWDEDIISKPFYIGLSVDDNSLLRDGTTLEEISVHIKGLGNKINKNLLLMGVNCVSFNQSALILKMLHEHLPGMPLLVYPNSGEIYNPKEKTWHRPTNKLDDWETTVKKFVDNGARIIGGCCRTSPKDIAEIASAVDKYS

SEQ ID NO: 849 - protein, 138 aa, Zea mays
MAGKGGKGLLAAKTTAAKSTDKDKDRKKAPVSRSSRAGLQFPVGRIHRQLKSRASAHGRVGATAAVYSAAILEYLTAEVLELAGNASKDLKVKRITPRHLQLAIRGDEELDTLIKGTIAGGGVIPHIHKSLINKTAKE

SEQ ID NO: 850 - protein, 134 aa, Zea mays
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNIHQHLLPKKAASSKASVDDDDN

SEQ ID NO: 851 - protein, 157 aa, Zea mays
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASGGSKEPKSPKKGAKSPKKA

SEQ ID NO: 852 - protein, 160 aa, Zea mays
MDAGAKVVKKAAAGRRGGGGPKKKPVSRSVKAGLQFPVGRIGRYLKQGRYSQRVGTGAPVYLAAVLEYLAAGLLELAGNAARDNKKNRIIPRHVLLAIRNDEELGKLLAGVTIAHGGVLPNINPVLLPKKTAVAAAKEGKEKKSPKKAAAAKSPKKVAAS

SEQ ID NO: 853 - protein, 540 aa, Zea mays
  unsure (1)..(540): unsure at all Xaa locations
MXQRRKSVFASAPFAMKQAALGAGVAARKNGAPLSLAAVVFALFVFATFLYNEDIKSITDFQFSSGAIRAKSPDLHLLQEAEAAAHAAVNTLAKRGEEVIVRVLEVEAPPVVNTSSVLAAAAKASAKANAVDVGQEKERDVTLPTVTGGRGGADEARRRADEEVAEKAASAKAAAATAALRGVVSVPQTCDLYRGSWVYDEVSAPVYKEGECEFLTEQVTCMRNGRRDDSYQKWRWQPAGCDLPRFDARLLLERLRNKRLMFVGDSLNRNQWESMVCLVQSVIPDRGQKTLTKFVNGGSSNVFYAHEYNATVEFYWAPFLVESNSDNPKVHSVPDRVIQWHAIAKHARNWIGVDYLVFNTYIWWLNTLDIKVLKQGSSFDDQGSTDYVEVDRPVAYKEVLTTWAKWVDRNIDPNRTTVFFMGMSPNHITPEAWGNKGGIKCAMETLPIASNRSAALDVGTDWRLYAGAREVLPTLRRVPVHFVDITALSELRKDAHTSVHTLRQGKLLTPEQQADPKTYADCIHWCLPGLPDTWNQFLYA

SEQ ID NO: 854 - protein, 256 aa, Zea mays
MSEGKKYLIVLAHHEPKSLNHSFAQRAQQVLTAAGNEVKLIDLHAVNFNPVSDRRNFKTTANPEFLKQQIEERHATEHDGFADDIKESLEAVDWCDVLILQFPFWWFSMPAILKGWIDKVWASGRVYGPNKKFTAGVWKGKKAFLSITTGSSEPTYAGPDSRMGDINSLLFPINHGILAFVGFTVLPPFIAYSASHATEDQRKQFLDEYEQRLLNLENLTPISYPPNEAFDSTGILKADWKAAQAHQNSNPAPREG

SEQ ID NO: 855 - protein, 910 aa, Oryza sativa
MSAGWRTLLLRIGDRCPEYGGSVDHKEHIETCYGVLCREYEHSKDAMFEFLLQCADQLPHKIPFFGVLIGLINLENEDFSKGIVDTTHANLQDALHNENRDRIRILLRFLCGLMCSKVVLPNSIIETFEALLSSAATILDEETGNPSWQPRADFYVYCILASLPWGGSELFEQVPDEFERVLVGIQSYISIRRHFDDIAFSVFETDEGNSPNKKDFIEDLWERIQVLSRNGWKVKSVPKPHLSFEAQLVAGVSHRFSPISCPHLLSRNASSEIVKGQEKHEADLKYPQRLRRLHIFPTNKAENMQPVDRFVVEECILDVLLFFNGCRKECAFYLVSLPVPFRYEYLMAETIFSQLLLLPNPPFRPIYYTLVIIDLCKALPGAFPSVVVGAVHALFDRISNMDMECRTRLILWFSHHLSNFQFIWPWQEWAYVKDLPKWAPQRVFVQEVLEREIRLSYFDKIKQSIEDAVELEELLPPKAGPNFRYHSDEGKESTDGHRLSKELVAMVRGRKTQGDIISWVDEKIIPVNGAKFALDVVSQTLLDIGSKSFTHLITVLERYGQIISKLCPNEEMQLLLMDEVSAYWKNSTQMIAIAIDRMMGYRLLSNLAIVKWVFSPANVDQFHVSDRPWEILRNAVSKTYNRIFDLRKEIQTLRKGLQAAKEASEKAARELEEAKSIIEIVDGQPVPSENPGRLRRLQARADKAKEGEVTTEESLEAKEALLARGLEESKELLRLLFKSFVEVLTERLPPISADGDVPNLRAGDPNVNSSARDPEATTMEIDNENGGDNDSQLNGQNKKISHNVGELEQWCLCTLGYLKSFSRQYATEIWSHIAMLDQEIFVGNIHPLIRKAASPVCADLPVKGLTFDFDPSSELEFTCIIRDKFFIMLSLTGHAQKYSDVYSGTPSILL

SEQ ID NO: 856 - protein, 858 aa, Saccharomyces cerevisiae
MILPLDFDEDENYRDFRPRMPKRQRIPPVVQLCKEMMPDIRTIGESVKAFEDDIKFLSEAIMNEYGHEDYFNNALLSTLNAVVVEQPQKQAAIALLTMVVNSKNNVAGKSIINYFFEELQKWCKQTYNDEFKSTSNETGPWNKIKLILRFLSILSPMFLVDELINIYKSLFELSIELNNLDPGNRVPLSEAIYTNTLLNIPYLFFFNRNNDGLRTKVEELLAYVEQNYLVKTTDINLLREYNGEPPYEMVELVRVVLPNVKKALINNLEQLNELFPDWNHLLTPQTGDEGFNDALTLPSVDDLKSFVRLNKNFGSVDSMWKTPRYAFHVYLPNSAGNFETVVPISTYAGQLFNDIIIDLVESLEFNRKEVARQVITLDLFFKAGIFTEPGESIAQLIATYEENPLAPTFKIEDLAIETILGLIFKLPSVSQPFAYFYTLLVDICQNSPKAIAPVFGRAFRFFYSHLDSLDFELKLRYLDWFSIQMSNFNFSWKWNEWEDDSIKFGKYFYNPKVNFAKNLIQKELRLTSNFSEVEDSLPQEFTKYLDTSYIPRDQLINYYQSLFTGYTVEEDSVRKNDLYFRQEGVPMENTVRKILDYTHKANNSREVTELESILGELKNEYGSIISDFNRFVIILLVQAVTDSGSRSLSHANKYINDLKEDLKTIFAKIELDIETKEYIIIEAVLTFWNANPQTGFLVADAFKYAGLLTSRTIFTFIFNETGLKNNGLIEATAIEAVFRNLSQQISEENESGNNFEFVFERLCTIANSTIDLLDVNADEDIEIPKVNGEMDIDDIEDDKLDLKWKYFTVIGFIKSILRRYSHEYRELADKFIANIDNAIPHESTRRTISNWIQETKEV

SEQ ID NO: 857 - protein, 243 aa, Zea mays
MASLFKDPSKLSAYRDRRFKGTQEEYEATLHASTTLYIGNMSFYTTEEQAYELFSRAGEIKKIIMGLDKNSKTPCGFCFVLYYSREDAEDAVKYISGTMLDDRPIRVDFDWGFEEGRQWGRGRSGGQVRDEYRTDYDPGRGGYGKMVQRELEAQRELVDYGGSFQPNAPPPYERGERKRGYGDSHRNARGDYQRKRYRSSDDRSAPEESKRAPDSDPADKNPRFREKGDSDEEDDDYDKRRRR

SEQ ID NO: 858 - protein, 208 aa, Saccharomyces cerevisiae
MSLEEFDEVKYDHSTKRLDTPSRYLLRKARRNPNGLQELRESMKSSTIYVGNLSFYTSEEQIYELFSKCGTIKRIIMGLDRFKFTPCGFCFIIYSCPDEALNALKYLSDTKLDEKTITIDLDPGFEDGRQFGRGKSGGQVSDELRFDFDASRGGFAIPFAERVGVPHSRFDNSSSQSNTNNYIPPPDAMGTFRPGFDEEREDDNYVPQ

SEQ ID NO: 859 - protein, 424 aa, Oryza sativa
MVLLNSEEVSCNDHHQVDVVAAAGLQCSGDMLGDKQLVSQVILEGLEIEEPPADEMEAAEKKAGISRLMAGYVQHLQHRSAYHLGYPLNFDYDFSPLAPFLNFSLNNAGDPFAKVNNSVHSRQFEVAVLNWFANFWDVQRDQFWGYITSGGTEGNLYGLLVGRELFPDGILYASNDSHYSVFKAAKMYRVKCIRIATTVSGEMNYADLKSKLQHNTNSPAIINANIGTTFKGAVDDIDQIISTLEKCGFQNRYYIHCDSALSGMMTPFMKQAPKVSFKKPIGSISVSGHKFLGCPMPCGVVITRLEHAEVLSTDIEYIASRDSTITGSRNGHAPIFLWWQLACEGNLAHIVVMPNVTFEKLTVFVEELAEKRKDWYQDKGFDIPCLAILPKSLWGHLTLTLYCSSTPTTTSAMETTRGGGSGFL

SEQ ID NO: 860 - protein, 452 aa, Zea mays
MELDPSEALVAAAVEAKGEEAANGRREFVMGRNVHTSCFAVKEPDADDEETGEREATMASVLALYRRSLVERTKHHLGYPYNLDFDYGALTQLQHFSINNLGDPFIESNYGVHSRQFEVGVLDWFARLWELEKDEYWGYITNCGTEGNLHGILVGREVFPDGILYASRESHYSVFKAARMYRMDCVKVDTLMSGEIDCADFQRKLLQNRDKPAIINVNIGTTVKGAVDDLDLVIKTLEENGFKDRFYIHCDGALFGLMIPFVKKAPQVTFKKPIGSVSVSGHKFVGCPMPCGVQITRLEHINALSSNVEYLASRDATIMGSRNGHAPIFLWYTLNRKGYRGFQKEVQKCLRNAHYLKDRLKEAGIGAMLNELSSTVVFERPKDEEFVRRWQLACEGNIAHVVVMPSVNIDKLDYFLNELVEKRATWYQDGISQPPCIARDVGVENCLCGLHK

SEQ ID NO: 861 - protein, 483 aa, Glycine max
MVVDALNEDLRINGAVEPLPEDFDATAVIIDPVPLAVVDNGIVKEEAQIIKGKEKREIVLGRNIHTSCLEVTEPEADDEVTGDREAHMASVLARYKRALTERTKHHLGYPYNLDFDYGALTQLQHFSINNLGDPFIESNYGVHSRQFEVGVLDWFARLWELEKNEYWGYITNCGTEGNLHGILVGREVFPDGILYASRESHYSVFKAARMYRMECEKVDTLWSGEIDCDDFKAKLLSHQDKPAIINVNIGTTVKGAVDDLDLVIKKLEEAGFSHDRFYIHCDGALFGLMMPFVKRAPKVTFKKPVGSVSVSGHKFVGCPMPCGVQITRLEYVNALARDVEYLASRDATIMGSRNGHAPIFLWYTLNRKGYRGFQKEVQKCLRNAHYFKGRLVEAGIGAMLNELSSTVVFERPHDEEFIRKWQLACKGNIAHVVVMPNITIEKLDDFLNELLEKRATWFQDGKDQPYCISSDVGEKNCLCALHK

SEQ ID NO: 862 - protein, 572 aa, Saccharomyces cerevisiae
MLSKSEKNVDYMAGNMSNLSFDGHGTPGGTGLFPNQNITKRRTRPAGINDSPSPVKPSFFPYEDTSNMDIDEVSQPDMDVSNSPKKLPPKFYERATSNKTQRVVSVCKMYFLEYYCDMFDYVISRRQRTKQVLEYLQQQSQLPNSDQIKLNEEWSSYLQREHQVLRKRRLKPKNRDFEMITQVGQGGYGQVYLARKKDTKEVCALKILNKKLLFKLNETKHVLTERDILTTTRSEWLVKLLYAFQELQSLYLAMEFVPGGDFRTLLINTRCLKSGHARFYISEMFCAVNALHDLGYTHRDLKPENFLIDAKGHIKLTDFGLAAGTISNERIESMKIRLEKIKDLEFPAFTEKSIEDRRKMYNQLREKEINYANSMVGSPDYMALEVLEGKKYDFTVDYWSLGCMLFESLVGYTPFSGSSTNETYDNLRRWKQTLRRPRQSDGRAAFSDRTWDLITRLIADPINRLRSFEHVKRMSYFADINFSTLRSMIPPFTPQLDSETDAGYFDDFTSEADMAKYADVFKRQDKLTAMVDDSAVSSKLVGFTFRHRNGKQGSSGILFNGLEHSDPFSTFY

SEQ ID NO: 863 - protein, 564 aa, Saccharomyces cerevisiae
MFSRSDREVDDLAGNMSHLGFYDLNIPKPTSPQAQYRPARKSENGRLTPGLPRSYKPCDSDDQDTFKNRISLNHSPKKLPKDFHERASQSKTQRVVNVCQLYFLDYYCDMFDYVISRRQRTKQVLRYLEQQRSVKNVSNKVLNEEWALYLQREHEVLRKRRLKPKHKDFQILTQVGQGGYGQVYLAKKKDSDEICALKILNKKLLFKLNETNHVLTERDILTTTRSDWLVKLLYAFQDPESLYLAMEFVPGGDFRTLLINTRILKSGHARFYISEMFCAVNALHELGYTHRDLKPENFLIDATGHIKLTDFGLAAGTVSNERIESMKIRLEEVKNLQFPAFTERSIEDRSKIYHNMRKTEINYANSMVGSPDYMALEVLEGKKYDFTVDYWSLGCMLFESLVGYTPFSGSSTNETYENLRYWKKTLRRPRTEDRRAAFSDRTWDLITRLIADPINRVRSFEQVRKMSYFAEINFETLRTSSPPFIPQLDDETDAGYFDDFTNEEDMAKYADVFKRQNKLSAMVDDSAVDSKLVGFTFRHRDGKQGSSGILYNGSEHSDPFSTFY

SEQ ID NO: 864 - protein, 242 aa, Arabidopsis thaliana
MGRGRVQLKRIENKINRQVTFSKRRSGLLKKAHEISVLCDAEVALIVFSSKGKLFEYSTDSCMERILERYDRYLYSDKQLVGRDVSQSENWVLEHAKLKARVEVLEKNKRNFMGEDLDSLSLKELQSLEHQLDAAIKSIRSRKNQAMFESISALQKKDKALQDHNNSLLKKIKEREKKTGQQEGQLVQCSNSSSVLLPQYCVTSSRDGFVERVGGENGGASSLTEPNSLLPAWMLRPTTTNE

SEQ ID NO: 865 - protein, 251 aa, Zea mays
MGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQHRGAAESESEPSPAPAQANRGNLPPWMLRTVK

SEQ ID NO: 866 - protein, 449 aa, Zea mays
MRKFNLMQSQKSRVLGAMSSSLPILPNPLKGSFPRPHNPQHIPMLRQLPDDSMPLCIDTHQSVSLHPRAGVIGVPYSGYTASPLDSVSNLDSQTMAAPFISQSSNFEALQSLSDNTPETHTKAAWFTSSMDVSPLNTDNIAASDVNQIHSIRPAMTSDESATQNDWWADIMNDDWKDILDATATDSHSKAMIQISNSATSLPAVNQSASSHSREICPVASPPNSSNASVAKQRMRWTPELHECFVDAVNQLGGSEKATPKGVLKLMKVDGLTIYHVKSHLQKYRTARYKPDLSEGTSEKRTATEELVLDLKTSMDLTEALRLQMEVQKRLHEQLEIQRKLQLRIEEQGKYLQMMFEKQSQSSTEKVQDPSSRDTTAKPSSNQSQSTNKDSGATMDPNGTGDIARTAELGERSSELGVKQKLVEIESGTEVATGDRSKIYQEKRRKLQDS

SEQ ID NO: 867 - protein, 416 aa, Zea mays
MERLSTNQLYSSGVPVTVPTSLPCIPVSLDESFPRLPDAQSVLMERELRSTPLPPHQTTVAPIRGLFHSNTGSVGPLCSPPSVRFSSHSNPEQYPNHNSYNSQVPSTASSSTLNYGSQYGGFEPSITDFPRDIEPTWCPDPVESILGYSGDVPAGNNLTGTTAIGASDDLTKQTEWWTEFMNEDWKDMVDNPTSTETQPVGQPVQSSNSVHQSATQQTVSSQSVEPLAVVAPSPTAGSNTGKARMRWTPELHERFVDAVNILGGSETTPKGVLKLMKADNLTIYHVKSHLQKYRTARYRPELSEGSSEKKVASKEDIPSIDLKGSFDLTEALRLQLELQKRLHEQLEIQRSLQLRIEEQGKCLQMMLEQQCIPGAEKAQDASTAADELRSPSEIPESSTLKEVPENSQNGSTKQTK

SEQ ID NO: 868 - protein, 334 aa, Nitrosomonas europaea
MHTGTTLTQFIIEEQRHIAGASGDFTALLNDIVTAIKTISNAVNKGALIGVMGALDTENVQGETQKKLDVITNEIMIRNNEWAGHLSGMASEEMDDVYSIPSPYPLGKYLLVFDPLDGSSNVDLNISVGTIFSILRSPVPSRAASMEDFLQPGVKQVCAGYALYGSSTMLVLTTGHGVNGFTLDRDIGEFVLTHPNMRIPADTREFAINASNQRFWEAPVQRYVAECLAGSTGPRGRDFNMRWVASMVAEVHRILTRGGIFMYPRDTKDPSKPGRLRLMYEANPMSFIVEQAGGLSTTGYERILDVVPQDLHQRVPVILGSKNEVEVVLEYHNA

SEQ ID NO: 869 - protein, 638 aa, Oryza sativa
MQRICPAHCSVTHSLTMKSMRLSYIPPAASAAPQSPSYGRKKNASAAPPSAAASTTVLTSPLVTTTRTPKQTEQEDEQLVAKTKTTRTVIATTNGRAAPSQSRPRRRPAPAAAASAASLPMTFCNALEEVINTFIDPPALRPAVDPRNVLTSNFVPVDELPPTPCPVVRGAIPRCLAGGAYIRNGPNPQHLPRGPHHLFDGDGMLHSLLLPSPASSGDDPVLCSRYVQTYKYLVERDAGAPVLPNVFSGFHGVAGMARGAVVAARVLTGQMNPLEGVGLANTSLAYFAGRLYALGESDLPYAVRVHPDTGEVTTHGRCDFGGRLVMGMTAHPKKDPVTGELFAFRYGPVPPFVTYFRFDPAGNKGADVPIFSVQQPSFLHDFAITERYAIFPEIQIVMKPMDMVVGGGSPVGSDPGKVPRLGVIPRYATDESEMRWFEVPGFNIMHSVNAWEEAGGEELVLVAPNVLSIEHALEHMELVHSCVEKVRINLRTGVVTRTPLAAGNFDFPVINPAFLGRRNRYGYFGVGDPAPKIGGVAKLDFDRAGEGDCTVAQRDFGPGCFAGEPFFVADDVEGNGNEDDGYLVCYVHDEATGENRFVVMDARSPDLEIVAEVQLPGRVPYGFHGLFVTQAELQSQHQ

SEQ ID NO: 870 - protein, 576 aa, Oryza sativa
MEVPIAAMTFAHPANVMTLASRQPKSKRSHISPATTAHRNLQTRLAHHHHATPASLPMAICNTVDKVINRFIDLPEQRPTVDPRRVLSGNFAPVDELPPTSCHVIRGSIPSCLAGGVYIRNGPNPQHRLPQRTHHLFDGDGMLHSLLIPSASSTLLSEPVLCSRYVHTYKYLLERETGGPVLPNFFAGFHGVAGLARAVVMIARVLAGQINLNKGFGLANTSITLFADCLYALCESDLPYSMHINPANGEVTTLGRCDFGGDLSFRMTAHPKKDPVTMELFAFRYNVFQPFITYFWFDRAGSKVADVPILSLQKPSVMHDFAITERYAIFPESQLIVNPMDMVMRGSSLVGLDRTMVPRIGVLPRYAKDESDMRWFEVPRFNMLHTTNGWEEADGEEIVLVAPNILSIEHMLGNMELMRARVDMVRINLCTGDVSCTALSPESLEFGVIHQGYVGRKNRYGYFGVSGPLPKIKGIRKLDFDLVGSGDCTVGRRDFGLGCFAGEPFFVPDNIDGYGNEDSGYVVCYTHEEDTGESWFVVMDAKSPELDIVAEVQLPSRIPYGFHGIFVKQAELLAQQ

SEQ ID NO: 871 - protein, 642 aa, Oryza sativa
MASGGGSSNWLGFSLSPHMPAMEVPSSSEPSTAAHHHHHHHPPAAAAAAGAMSSPPDSATTCNFLFSPPAAQMVAPSPGYYYVGGAYGDGTSTAGVYYSHLPVMPIKSDGSLCIMEGMMPSSSPKLEDFLGCGNGSGHDPATYYSQGQEAEDASRAAYQHHQLVPYNYQPLTEAEMLQEAAAAPMEDAMAAAKNFLVTSYGACYGNQEMPQPLSLSMSPGSQSSSCVSAAPQQHQQMAVVAAAAAAGDGQGSNSNDGGEQRVGKKRGTGKGGQKQPVHRKSIDTFGQRTSQYRGVTRHRWTGRYEAHLWDNSCKKDGQTRKGRQVYLGGYDTEDKAARAYDLAALKYWGLSTHINFPLENYRDEIEEMERMTRQEYVAHLRRRSSGFSRGASIYRGVTRHHQHGRWQARIGRVAGNKDLYLGTFSTQEEAAEAYDIAAIKFRGLNAVTNFDITRYDVDKIMESSSLLPGEAARKVKAIEAAPDHVPIGRELGATEEASAATVTGTDWRMVLHGSQQQQAAACTEATADLQKGFMGDAHSALHGIVGFDVESAAADEIDVPGGKISGINFSNSSSLVTSLSNSREGSPERLGLAMLYAKHHPTAVSLAAMNPWMPMPAPAAAHVMRPPSAIAHLPVFAAWTDA

SEQ ID NO: 872 - protein, 345 aa, Nostoc sp. PCC 7120
MENTLGLEIIEVVEQAAIASAKWMGKGEKNTADQVAVEAMRERMNKIYMRGRIVIGEGERDDAPMLYIGEEVGICTQPNADQLCNPDELVEIDIAVDPCEGTNLVAYGQPGSMAVLAISEKGGLFAAPDFYMKKLAAPPAAKGKVDINKSATENLKILSECLDRSIDELVVVVMKRDRHQGLIKEIRDAGARVQLISDGDVGAAISCGFAGTNVHALMGIGAAPEGVISAAAMRALGGHFQGQLIYDPEVVKTGLIGESKQANLDRLSSMGINDPDKVYDAHELASGENVLFAGCGITSGNLMQGVRFFHGGARTQSLVISSQSQTARFVDTIHMAGQPKTVQLH

SEQ ID NO: 873 - protein, 345 aa, Nostoc punctiforme
MENTLGLEIIEVVEQAAIASAKWMGKGEKNIADQVAVEAMRERMNKIYMRGRIVIGEGERDDAPMLYIGEEVGICTQPNAEALCNPDELIEIDIAVDPCEGTNLVAYGQPGSMAVLAISEKGGLFAAPDFYMKKLAAPPAAKGKVDINKSATENLKILSECLERSIEELVIVVMKRERHNDLIKEIREAGARVALISDGDVGAAISCGFAGTNIHALMGIGAAPEGVISAAAMRALGGHFQGQLIYDPAIVKTGLIGESREANIDRLKSMNINDPDKVYDAHELASGETVLFAASGITSGNLMNGVRFFNGGARTQSLVISNQSKTARFVDTIHMFGEPKTLQLN

SEQ ID NO: 874 - protein, 425 aa, Nostoc sp. PCC 7120
MFQNKKHRIALISVSGDPAVEIGQEEAGGQNVYVREVGYALAEQGWQVDMFTRRISPDQAEIVQHSPNCRTIRLQAGPVEFIGRDHVFDYLPEFVAEFQRFQKRQGYNYQLIHTNYWLSSWVGMQLKKQQPLVLVHTYHSLGAIKYQTIADIPAIANQRLAIEKACLESVDTVVATSPQEQQHMRALVSKKGRIEMIPCGTDINNFGNIEKSAAREKLGIEPDAKMVFYVGRFDPRKGIETLVRAVAQSRLRGEANLQLVIGGGSRPGQSDGRERDRIANIVAELELNDCTTFAGRLDHEILPYYYAAADVCVVPSHYEPFGLVAIEAMASKTPVIASNVGGLQFTVVPEVTGLLAPPQDESAFATAIDRILANPTWRDQLGTAARQRVETTFSWAGVASQLSQLYTHLLTQNAPEKKEKEAVAA

SEQ ID NO: 875 - protein, 422 aa, Nostoc sp. PCC 7120
MNSNTEKRIALISVHGDPAIEIGKEEAGGQNVYVREVGKALAQLGWQVDMFSRKVSPEQELIVHHSPLCRTIRLTAGPEEFVPRDNGFKYLPEFVQQLLRFQKENNVNYPLVHTNYWLSSWVGMQLKAIQGSKQVHTYHSLGAVKYKSIDTIPLVATKRLSVEKQVLETAERIVATSPQEQQHMRSLVSTKGYIDIVPCGTDIHRFGSIARQAARAELGIDQEAKVVLYVGRFDQRKGIETLVRAMNESQLRDTNKLKLIIGGGSTPGNSDGRERDRIEAIVQELGMTEMTSFPGRLSQDVLPAYYAAADVCVVPSHYEPFGLVAIEAMASGTPVVASDVGGLQFTVVSEKTGLLVPPKDIAAFNIAIDRILMNPQWRDELGLAARKHVTHKFGWEGVASQLDGIYTQLLTQQVKEPALVTK

SEQ ID NO: 876 - protein, 169 aa, Arabidopsis thaliana
MAQEQATSSLAASSLPSSSERSSSSAPHLEIKEGIESDEEIRRVPEFGGEAVGKETSGRESGSATGQERTQATVGESQRKRGRTPAEKENKRLKRLLRNRVSAQQARERKKAYLSELENRVKDLENKNSELEERLSTLQNENQMLRHILKNTTGNKRGGGGGSNADASL

SEQ ID NO: 877 - protein, 317 aa, Arabidopsis thaliana
MAVELMTRNYISGVGADSFAVQEAAASGLKSIENFIGLMSRDSFNSDQPSSSSASASASAAADLESARNTTADAAVSKFKRVISLLDRTRTGHARFRRAPVHVISPVLLQEEPKTTPFQSPLPPPPQMIRKGSFSSSMKTIDFSSLSSVTTESDNQKKIHHHQRPSETAPFASQTQSLSTTVSSFSKSTKRKCNSENLLTGKCASASSSGRCHCSKKRKIKQRRIIRVPAISAKMSDVPPDDYSWRKYGQKPIKGSPHPRGYYKCSSVRGCPARKHVERAADDSSMLIVTYEGDHNHSLSAADLAGAAVADLILESS

SEQ ID NO: 878 - protein, 170 aa, Arabidopsis thaliana
MATQDSQGIKLFGKTIAFNTRTIKNEEETHPPEQEATIAVRSSSSSDLTAEKRPDKIIACPRCKSMETKFCYFNNYNVNQPRHFCKGCHRYWTAGGALRNVPVGAGRRKSKPPGRVVVGMLGDGNGVRQVELINGLLVEEWQHAAAAAHGSFRHDFPMKRLRCYSDGQSC

SEQ ID NO: 879 - protein, 352 aa, Arabidopsis thaliana
MVRTPCCKAELGLKKGAWTPEEDQKLLSYLNRHGEGGWRTLPEKAGLKRCGKSCRLRWANYLRPDIKRGEFTEDEERSIISLHALHGNKWSAIARGLPGRTDNEIKNYWNTHIKKRLIKKGIDPVTHKGITSGTDKSENLPEKQNVNLTTSDHDLDNDKAKKNNKNFGLSSASFLNKVANRFGKRINQSVLSEIIGSGGPLASTSHTTNTTTTSVSVDSESVKSTSSSFAPTSNLLCHGTVATTPVSSNFDVDGNVNLTCSSSTFSDSSVNNPLMYCDNFVGNNNVDDEDTIGFSTFLNDEDFMMLEESCVENTAFMKELTRFLHEDENDVVDVTPVYERQDLFDEIDNYFG

SEQ ID NO: 880 - protein, 220 aa, Arabidopsis thaliana
MARMTRDGKEHEYKKGLWTVEEDKILMDYVRTHGQGHWNRIAKKTGLKRCGKSCRLRWMNYLSPNVNRGNFTDQEEDLIIRLHKLLGNRWSLIAKRVPGRTDNQVKNYWNTHLSKKLGLGDHSTAVKAACGVESPPSMALITTTSSSHQEISGGKNSTLRFDTLVDESKLKPKSKLVHATPTDVEVAATVPNLFDTFWVLEDGFELSSLTMMDFTNGYCL

SEQ ID NO: 881 - protein, 314 aa, Arabidopsis thaliana
MADLFGGGHGGELMEALQPFYKSASTSASNPAFASSNDAFASAPNDLFSSSSYYNPHASLFPSHSTTSYPDIYSGSMTYPSSFGSDLQQPENYQSQFHYQNTITYTHQDNNTCMLNFIEPSQPGFMTQPGPSSGSVSKPAKLYRGVRQRHWGKWVAEIRLPRNRTRLWLGTFDTAEEAALAYDRAAFKLRGDSARLNFPALRYQTGSSPSDTGEYGPIQAAVDAKLEAILAEPKNQPGKTERTSRKRAKAAASSAEQPSAPQQHSGSGESDGSGSPTSDVMVQEMCQEPEMPWNENFMLGKCPSYEIDWASILS

SEQ ID NO: 882 - protein, 198 aa, Arabidopsis thaliana
MENGMYKKKGVCDSCVSSKSRSNHSPKRSMMEPQPHHLLMDWNKANDLLTQEHAAFLNDPHHLMLDPPPETLIHLDEDEEYDEDMDAMKEMQYMIAVMQPVDIDPATVPKPNRRSVRISDDPQTVVARRRRERISEKIRILKRIVPGGAKMDTASMLDEAIRYTKFLKRQVRILQPHSQIGAPMANPSYLCYYHNSQP

SEQ ID NO: 883 - protein, 131 aa, Arabidopsis thaliana
MDQGGRGVGAEHGKYRGVRRRPWGKYAAEIRDSRKHGERVWLGTFDTAEEAARAYDQAAYSMRGQAAILNFPHEYNMGSGVSSSTAMAGSSSASASASSSSRQVFEFEYLDDSVLEELLEEGEKPNKGKKK

SEQ ID NO: 884 - protein, 181 aa, Arabidopsis thaliana
MARPQQRFRGVRQRHWGSWVSEIRHPLLKTRIWLGTFETAEDAARAYDEAARLMCGPRARTNFPYNPNAIPTSSSKLLSATLTAKLHKCYMASLQMTKQTQTQTQTQTARSQSADSDGVTANESHLNRGVTETTEIKWEDGNANMQQNFRPLEEDHIEQMIEELLHYGSIELCSVLPTQTL

SEQ ID NO: 885 - protein, 286 aa, Arabidopsis thaliana
MALSSAKHQRNHRLSATNKNQTLTKVSSISSSSPSSSSSSSSTSSSSPLPSQDSQAQKRSLVTMEEVWNDINLASIHHLNRHSPHPQHNHEPRFRGQNHHNQNPNSIFQDFLKGSLNQEPAPTSQTTGSAPNGDSTTVTVLYSSPFPPPATVLSLNSGAGFEFLDNQDPLVTSNSNLHTHHHLSNAHAFNTSFEALVPSSSFGKKRGQDSNEGSGNRRHKRMIKNRESAARSRARKQAYTNELELEVAHLQAENARLKRQQDQLKMAAAIQQPKKNTLQRSSTAPF

SEQ ID NO: 886 - protein, 287 aa, Arabidopsis thaliana
MAMQERCESLCSDELISSSDAFYLKTRKPYTITKQREKWTEAEHEKFVEALKLYGRAWRRIEEHVGTKTAVQIRSHAQKFFTKVARDFGVSSESIEIPPPRPKRKPMHPYPRKLVIPDAKEMVYAELTGSKLIQDEDNRSPTSVLSAHGSDGLGSIGSNSPNSSSAELSSHTEESLSLEAETKQSLKLFGKTFVVGDYNSSMSCDDSEDGKKKLYSETQSLQCSSSTSENAETEVVVSEFKRSERSAFSQLKSSVTEMNNMRGFMPYKKRVKVEENIDNVKLSYPLW

SEQ ID NO: 887 - protein, 519 aa, Arabidopsis thaliana
MGGGGDTTDTNMMQRVNSSSGTSSSSIPKHNLHLNPALIRSHHHFRHPFTGAPPPPIPPISPYSQIPATLQPRHSRSMSQPSSFFSFDSLPPLNPSAPSVLVSVEEKTGAGFSPSLPPSPFTMCHSSSSRNAGDGENLPPRKSHRRSNSDVTFGFSSMMSQNQKSPPLSSLERSISGEDTSDWSNLVKKEPREGFYKGRKPEVEAAMDDVFTAYMNLDNIDVLNSFGGEDGKNGNENVEEMESSRGSGTKKTNGGSSSDSEGDSSASGNVKVALSSSSSGVKRRAGGDIAPTGRHYRSVSMDSCFMGKLNFGDESSLKLPPSSSAKVSPTNSGEGNSSAYSVEFGNSEFTAAEMKKIAADEKLAEIVMADPKRVKRILANRVSAARSKERKTRYMAELEHKVRTLQTEATTLSAQLTHLQRDSMGLTNQNSELKFRLQAMEQQAQLRDALSEKLNEEVQRLKLVIGEPNRRQSGSSSSESKMSLNPEMFQQLSISQLQHQQMQHSNQCSTMKAKHTSND

SEQ ID NO: 888 - protein, 449 aa, Saccharomyces cerevisiae
MGLCASSEKNGSTPDTQTASAGSDNVGKAKVPPKQEPQKTVRTVNTANQQEKQQQRQQQPSPHNVKDRKEQNGSINNAISPTATANTSGSQQINIDSALRDRSSNVAAQPSLSDASSGSNDKELKVLLLGAGESGKSTVLQQLKILHQNGFSEQEIKEYIPLIYQNLLEIGRNLIQARTRFNVNLEPECELTQQDLSRTMSYEMPNNYTGQFPEDIAGVISTLWALPSTQDLVNGPNASKFYLMDSTPYFMENFTRITSPNYRPTQQDILRSRQMTSGIFDTVIDMGSDIKMHIYDVGGQRSERKKWIHCFDNVTLVIFCVSLSEYDQTLMEDKNQNRFQESLVLFDNIVNSRWFARTSVVLFLNKIDLFAEKLSKVPMENYFPDYTGGSDINKAAKYILWRFVQLNRANLSIYPHVTQATDTSNIRLVFAAIKETILENTLKDSGVLQ

SEQ ID NO: 889 - protein, 83 aa, Oryza sativa
MAARTVAVAAALAVLLIFAASSATVAMAGRPTPTTSLDEEAAQAAAQSEIGGGCKEGEGEEECLARRTLTAHTDYIYTQQHHN

SEQ ID NO: 890 - protein, 119 aa, Oryza sativa
MSTTRGVSSSSAAAALALLLLFALCFFSFHFAAAARAVPRDEHQENGGVKAVAAVAADQLVLQLEGDTGNGDEVSELMGAAEEEAAACEEGKNNDECVQRRLLSDAHLDYIYTQHKNKP

SEQ ID NO: 891 - protein, 89 aa, Oryza sativa
MVNPGRTARALCLLCLALLLLGQDTHSRKLLLQEKHSHGVGNGTTTTQEPSRENGGSTGSNNNGQLQFDSAKWEEFHTDYIYTQDVKNP

SEQ ID NO: 892 - protein, 102 aa, Oryza sativa
MRPTGRRSSPPVAAALALLLLLVLFFFSHCASAARPLPASAAAELVLQDGATGNGDEVSELMGAAEEEAAGLCEEGNEECVERRMLRDAHLDYIYTQKRNRP

SEQ ID NO: 893 - protein, 513 aa, Arabidopsis thaliana
MGAYETEKPTKDAAALETQSPEDFDQPSPLRKIISVASIAAGVQFGWALQLSLLTPYVQLLGIPHKWSSLIWLCGPVSGMIVQPIVGFHSDRCRSKFGRRRPFIATGAALVAVAVFLIGYAADFGYKMGDKLEEKVKVRAIGIFALGFWILDVANNTLQGPCRAFLADLAAGDAKRTRVANAFFSFFMAVGNVLGYAAGSYTNLHKMFPFTMTKACDIYCANLKTCFFLSITLLLIVTVTSLWYVNDKQWSPPPRNADDDEKTSSVPLFGEIFGAFKVMKRPMWMLLIVTALNWIAWFPFLLFDTDWMGREVFGGDSDGNERSKKLYSLGVQSGAMGLMFNSIVLGFMSLGVEWIGRKLGGAKRLWGIVNFILAAGLAMTVLVTKFAEDHRKTAGDLAGPSASVKAGALSLFAVLGIPLAITFSTPFALASIFSSCSGAGQGLSLGVLNLAIVIPQMIVSLGGGPFDALFGGGNLPAFIVAAIAAAISGVLALTVLPSPPPDAPKATTMGGFH

SEQ ID NO: 894 - protein, 591 aa, Arabidopsis thaliana
MSDSVSISVPYKNLRKEIELETVTKNQDGSGSSSFSSSPLNHPESADGESVSKNCSLVTLVLSCTVAAGVQFGWALQLSLLTPYIQTLGISHAFSSFIWLCGPITGLVVQPFVGIWSDKCTSKYGRRRPFILVGSFMISIAVIIIGFSADIGYLLGDSKEHCSTFKGTRTRAAVVFIIGFWLLDLANNTVQGPARALLADLSGPDQRNTANAVFCLWMAIGNILGFSAGASGKWQEWFPFLTSRACCAACGNLKAAFLLAVVFLTICTLVTIYFAKEIPFTSNKPTRIQDSAPLLDDLQSKGLEHSKLNNGTANGIKYERVERDTDEQFGNSENEHQDETYVDGPGSVLVNLLTSLRHLPPAMHSVLIVMALTWLSWFPFFLFDTDWMGREVYHGDPTGDSLHMELYDQGVREGALGLLLNSVVLGISSFLIEPMCQRMGARVVWALSNFTVFACMAGTAVISLMSLSDDKNGIEYIMRGNETTRTAAVIVFALLGFPLAITYSVPFSVTAEVTADSGGGQGLAIGVLNLAIVIPQMIVSLGAGPWDQLFGGGNLPAFVLASVAAFAAGVIALQRLPTLSSSFKSTGFHIG

SEQ ID NO: 895 - protein, 510 aa, Arabidopsis thaliana
MATSDQDRRHRATRNRPPIPRPSNSSSRPVVPPPRSKVSKRVLLRVASVACGIQFGWALQLSLLTPYVQELGIPHAWASVIWLCGPLSGLFVQPLVGHSSDRCTSKYGRRRPFIVAGAVAISISVMVIGHAADIGWAFGDREGKIKPRAIVAFVLGFWILDVANNMTQGPCRALLADLTENDNRRTRVANGYFSLFMAVGNVLGYATGSYNGWYKIFTFTKTVACNVECANLKSAFYIDVVFIAITTILSVSAAHEVPLASLTSEAHGQTSGTDEAFLSEIFGTFRYFPGNVWIILLVTALTWIGWFPFILFDTDWMGREIYGGEPNIGTSYSAGVSMGALGLMLNSVFLGITSVLMEKLCRKWGAGFVWGISNILMAICFLGMIITSFVASHLGYIGHEQPPASIVFAAVLIFTILGIPLAITYSVPYALISIRIESLGLGQGLSLGVLNLAIVIPQVIVSVGSGPWDQLFGGGNSPALAVGAATGFIGGIVAILALPRTRIQKPIPLP

SEQ ID NO: 896 - protein, 537 aa, Oryza sativa
MARGSGAGGGGGGGGGGLELSVGVGGGGARGGGGGEAAAAVETAAPISLGRLILSGMVAGGVQYGWALQLSLLTPYVQTLGLSHALTSFMWLCGPIAGMVVQPCVGLYSDRCTSKWGRRRPYILTGCVLICLAVVVIGFSADIGYAMGDTKEDCSVYHGSRWHAAIVYVLGFWLLDFSNNTVQGPARALMADLSGRHGPGTANSIFCSWMAMGNILGYSSGSTNNWHKWFPFLKTRACCEACANLKGAFLVAVIFLSLCLVITLIFAKEVPFKGNAALPTKSNEPAEPEGTGPLAVLKGFRNLPTGMPSVLIVTGLTWLSWFPFILYDTDWMGREIYHGDPKGTDPQIEAFNQGVRAGAFGLLLNSIVLGFSSFLIEPMCRKVGPRVVWVTSNFLVCIAMAATALISFWSLKDFHGTVQKAITADKSIKAVCLVLFAFLGVPLAVLYSVPFAVTAQLAATRGGGQGLCTGVLNISIVIPQVVIALGAGPWDELFGKGNIPAFGLASGFALIGGVAGIFLLPKISKRQFWSVSMGGGH

SEQ ID NO: 897 - protein, 506 aa, Oryza sativa
MAVDMELDGGGDGKGKAPPQISLSGLFLACMVAGGVQYGWALQLSLLTPYVQTLGIPHALTSVMWLCGPIAGLIVQPCVGLYSDKCTSSLGRRRPFILTGCIIICISVIVIGFSSDIGYALGDTTEDCKVYRGPRYHAAAAFILGFWLLDFSNNTVQGPARALMADLSGRHGPSAANAIFCSWMALGNILGYSSGSTNDWHKWFPFLMTRACCEACANLKAAFLVAVVFLGLSTAVTMVFAREVALDPVAAAKRNEGEASGLLAVFKGMKNLPVGMPSVLIVTGLTWLSWFPFILFDTDWMGREIYHGRPDGSPAEVTAFQEGVRQGAFGLLLNSIVLGISSFLIEPMCRRLGARAVWVMSSAVVCVAMAAVSVLSAWSLGDFGGSVQDAARAPAEEGGVRASALALFVFLGLPFAVLCSVPFAVTAQLAASRGGGQGLCTGVLNISIVVPQMAIALGAGPWDELFGEGNIPAFAMASVFAAAAAAAGVVLLPKVSVRSVSMAGGH

SEQ ID NO: 898 - protein, 671 aa, Emericella nidulans
MNDLWGLISCHSYGPRGMRVSFPIRKMCRLIGDTVSRNIERLSYASRLQARKLINTVPTDANPSGYIVASSDDLLRLVDADYGALCIRGEVKILAKSPQSQEMLALLEYLKVRKYNSVLTSNHIVKDFQDLNYPPGFKDISGLLYVPLSTDGLDFIVFFRRGQLTEVKWGGNPNEAKFTEGHLEPRKSFQTWRETVLDRCRDWTESEVDTAAVLCLVYGKFIKVWRQQEAALESSSLTKLLLANSAHEVRTPLNAIVNYLEIALEGALDGETRDHLSKSYSASKSLIYVINDLLDLTNVEKGQSLIKDEPFDLPTTFSEATAMFESEAKRKGLNYKVLSQPGIPETVIGDQRRVRQSISNLTSNAVQNTSSGGVTVEVWHAPGEGDTDKATVKIAVLDTGRGISSSTLELLFRELEQVSGEDDSHYYGGSEEGEESAPEAKASKDKAVLGLGLALVARIVRNMHGQLTVRSEEGKGSRFQISLQFPIPEGSDTKSPTAEHRPVATGDSAAPFSTGDDVILVDSTTGSKRNSQDSLTRPDVPRKSEPEDTALADGAGEQASGESEAQTRPKKTGESTASTSHEQSETARSRPSGPSSGPSAPERRPLRVLVAEDDPINAKIIEKRLEKLGHTVQRTVNGEECANAYSAESTQWDVVLMDIQVGGQCLWCLLM

SEQ ID NO: 899 - protein, 153 aa, Zea mays
MDYSNLRRQAASMKKTLFDQGYLDEQFCQVEDLQDEASPNFAEEVVTLFFKDSARLISNAEQALEKYPKDFNRWDAYMQQLKGSCSSIGASRMKSECVSFRDYCGQGNVEGCMRSFQKVKREHGALRQKLEAYFQLLRQAGPAGAATRPGCKN

SEQ ID NO: 900 - protein, 152 aa, Zea mays
MEYSNLQQQAASLKKNLFDQGYLDEQFCQIEDLQDEASPNFTEEVVSLFFKNSTRLMTNIEQAMDRNPRDFSKWDVNMQQLKGTCSSIGACRMKNECTSFRNRCGDENVEGCMRSFQNLKREHGVLRQKLESYFQLLRQAGPAVTATRPRGM

SEQ ID NO: 901 - protein, 155 aa, Glycine max
MDVGQMQRQWIDYTKSLFLEGFLDGQFLQLQQLQDENNPDFVVEVVSLFFEDSERLLKDLTFALDQNGVDFKKVDAHVHQLKGSSSSIGAQRVKNACIAFRNFCEEQNTDACVRCLQQVKQEYCLVKNKLETMFRLEQQIVAAGGSIPTELSFSG

SEQ ID NO: 902 - protein, 167 aa, Saccharomyces cerevisiae
MSTIPSEIINWTILNEIISMDDDDSDFSKGLIIQFIDQAQTTFAQMQRQLDGEKNLTELDNLGHFLKGSSAALGLQRIAWVCERIQNLGRKMEHFFPNKTELVNTLSDKSIINGINIDEDDEEIKIQVDDKDENSIYLILIAKALNQSRLEFKLARIELSKYYNTNL

SEQ ID NO: 903 - protein, 636 aa, Oryza sativa
MDGCDCIEPLWPTDELLIKYQYISDFFIALAYFSIPLELIYFVKKSSFFPYRWVLIQFGAFIVLCGATHLINLWTFTTHTKTVAMVMTVAKVSTAVVSCATALMLVHIIPDLLSVKTRELFLKNKAEQLDREMGLIRTQEETGRHVRMLTHEIRSTLDRHTILKTTLVELGGTLGLEECALWMPSRSGSSLQLSHTLRHQITVGSTVSINLPVVNQVFSSNRAIIIPHTSPLARIRPLAGRYVPPEVAAVRVPLLHLSNFQINDWPELSAKSYAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMSFIKPIAAIKRLSVSVMLAPDLPLCAIGDEKRLMQTILNISGNAVKFTKEGHITLVASVVKADSLREFRTPDFHPTASDDNFYLKVQIKDTGCGISPQDLPQVFTKFPQSQPGGNRGYSGSGLGLAICKRFVTLMGGHIWLDSEGTGRGCTVTFVIQLGICDNTNAYQQKLIPLVWPSSGDADFVGPVPNAPNEEKGQASLKSRYQRSI

SEQ ID NO: 904 - protein, 635 aa, Oryza sativa
MDGSCDCIEPLWQADDLLVKYQYISDFFIALAYFSIPLELIYFVKKSAFFPYRWVLIQFGAFIVLCGATHLINLWTFAIYTKTIAVVLTVAKAATAVVSCITALMLVHIIPDLLNVKLRERFLKDKADELDREMGIIRTQEETGRHVHMLTHEIRSTLDRHTILRTTLVELGRTLVLAECALWMPTRSGSALQLSHTIYNSAAIGSVVPINLPIVSKVFNSNRVVKIPHTSPLASITADKSRYVPPEVVAIRVPLLHLTNFQINDWPELSAKSFAVMVLMLPPDSAREWRPHERELVEVVADQVAVALSHAAILEESMRARDLLMEQNIALDAARREAEMAICARNDFLAVMNHEMRTPMRAIVSLSSLLLETNLSAEQRLMVETILKSSDLLATLTNDVLDVSKLENGSLELEIAPFNLHSTFTDVVNLIKPVAACKRLSVMVTLAPELPLHAIGDQKRLMQIILNVAGNSIKFTKEGHVSITASMARPDALRGPHEPDYHPVVSDGFFYLAVQVKDTGCGISPQDMPHTFRKFAHPENAGKWNSGSGLGLALSRRFVSLMEGNIWLESEGVGKGCTAMFFVKLGMPEKPNANLRRMAPHPLQPNQGAGGPDALSISIMDSNPRVPRVRYQSSV

SEQ ID NO: 905 - protein, 537 aa, Arabidopsis thaliana
MMMKISFNTCFQILLGFIVFIASITLLGRIFSRPSKTKDRCRQLPPGRPGWPILGNLPELIMTRPRSKYFHLAMKELKTDIACFNFAGTHTITINSDEIAREAFRERDADLADRPQLSIVESIGDNYKTMGTSSYGEHFMKMKKVITTEIMSVKTLNMLEAARTIEADNLIAYIHSMYQRSETVDVRELSRVYGYAVTMRMLFGRRHVTKENMFSDDGRLGKAEKHHLEVIFNTLNCLPGFSPVDYVDRWLGGWNIDGEEERAKVNVNLVRSYNNPIIDERVEIWREKGGKAAVEDWLDTFITLKDQNGNYLVTPDEIKAQCVEFCIAAIDNPANNMEWTLGEMLKNPEILRKALKELDEVVGKDRLVQESDIRNLNYLKACCRETFRIHPSAHYVPPHVARQDTTLGGYFIPKGSHIHVCRPGLGRNPKIWKDPLAYEPERHLQGDGITKEVTLVETEMRFVSFSTGRRGCVGVKVGTIMMAMMLARFLQGFNWKLHRDFGPLSLEEDDASLLMAKPLLLSVEPRLASNLYPKFRP

SEQ ID NO: 906 - protein, 512 aa, Arabidopsis thaliana
MVSHPMEKAANGASALETQTGELDQPERLRKIISVSSIAAGVQFGWALQLSLLTPYVQLLGIPHKWASLIWLCGPVSGMLVQPIVGYHSDRCTSRFGRRRPFIVAGAGLVTVAVFLIGYAADIGHSMGDQLDKPPKTRAIAIFALGFWILDVANNTLQGPCRAFLADLSAGNAKKTRTANAFFSFFMAVGNVLGYAAGSYRNLYKVVPFTMTESCDLYCANLKTCFFLSITLLLIVTFVSLCYVKEKPWTPEPTADGKASNVPFFGGIFGAFKELKRPMWMLLIVTALNWIAWFPFLLFDTDWMGREVYGGNSDATATAASKKLYNDGVRAGALGLMLNAIVLGFMSLGVEWIGRKLGGAKRLWGIVNFILAICLAMTVVVTKQAENHRRDHGGAKTGPPGNVTAGALTLFAILGIPQAITFSIPFALASIFSTNSGAGQGLSLGVLNLAIVVPQMVISVGGGPFDELFGGGNIPAFVLGAIAAAVSGVLALTVLPSPPPDAPAFKATMGFH

SEQ ID NO: 907 - protein, 251 aa, Glycine max
MYGRSDSYESDLALLDSIRRHLLGESELIFGAPNFGSGRSSSFSSLDSCLSDDWGELPFKEDDSEDMVLYGVLRDAVNVGWVPSLDAGSPESVSSGFPAVKLEPDVMPALINPCPPPAPAVEEKKVVPPKGKHYRGVRQRPWGKFAAEIPDPAKNGARVWLGTFETAEDAALAYDRAAYRMRGSRALLNFPLRVNSGEPDPVRVTSKRSSSPESMAAAAPKRKKVMVVGTVQEQVGSQVVECTRGEQLLVS

SEQ ID NO: 908 - protein, 186 aa, Zea mays
MAPKRSSEERAAAEQEQPRLRGVRKRPWGRYAAEIRDPVRKARVWLGTFDTPEQAARAYDAAARRLRGPRATTNYPGDVVREAPCTAPALAASASGSTESSSSSSSRDDGHPPPPLPTAPSSLGLGLGLFPATVATQPCLFLDPAPVEREEGERERSCCSRSPPSVLAGLGFDFDLNLPPPAEMVM

SEQ ID NO: 909 - protein, 139 aa, Arabidopsis thaliana
MESSNRSSNNQSQDDKQARFRGVRRRPWGKFAAEIRDPSRNGARLWLGTFETAEEAARAYDRAAFNLRGHLAILNFPNEYYPRMDDYSLRPPYASSSSSSSSGSTSTNVSRQNQREVFEFEYLDDKVLEELLDSEERKR

SEQ ID NO: 910 - protein, 447 aa, Zea mays
MASSLAPASWALPLQMGGAGAAAAGPSCRATLAVVTEPRWAASLRRARVLVALAPRCVALDGPGASGEEEAPKIEDERKKSGETKKPARGRPVWSRILFASKKTRSIIILNALTVIYASDIPVLKEVEALTEPAVFNMVRFVVAAIPFVPFALRSFGDRSVRYAGLELGVWVSLAYLSQAIGLLSSDAGRASFITAFTVVVVPLIDGLLGASIPRLTWFGAIMSLFGIGLLECGGSPPSVGDILNFFSAVFFGIHMLRTEQISRSTDKKKFLALLGFEVLVVAFSSVLWFMFKDGYVDTSGSSFESWTFGMLWDTTVSFPWIPALYTGVLSTVLCMWAEMVAMGDVSATETAVVYGLEPVWGAAFAWFLLGERWDDAAWTGAALVLCGSLTVQLFGSAPEKSKKVKKRSSNALETPVKRRDYLSLSPIPVDSGKIIGRQLERKNKAV

SEQ ID NO: 911 - protein, 361 aa, Zea mays
MDVEARKDAAPARGKAVRRFLVALNCGMLALGAIGGPLLSRLYFSKGGHRQWLSAWLETGGWPLLLVPVAASFGARRARDRGAPVLLTPPRILLAAAGLGVATGVDDFVYAYGLAYLPVSTSAILISTQLAFTVFFAFLVVRQRLTAASVNAVALLTVGAVVLGLHVSSDRPPGVTRGRYWLGFSLTLCAAALYGLVLPLVELAYRRAAGGGRAVTYALVVEMQLVMGFFATAFCTVGMVVNKDFQAIPREARQYELGEARYYMVLAWAAVLWQCFFLGAVGVIFCVHTLLAGILIAVFIPVTEVAAVIFLHEKFSSEKGVALALSLWGLASYSYGEWSQAKAKKEKKSEEDDGEVAQAVP

SEQ ID NO: 912 - protein, 421 aa, Zea mays
MGGIPREPSFSRWCRDPSAASASNTAAAAATSDSDASEEFELPLLPSSSGGGGSPMDIEVGATARSDDLPISPRLLAKVIGLIACWYTLSTCLTLYNKEMLGKHMWKFPAPFLMNTVHFTMQAVASRAIVWFQQRGLEGGPSKMSWKDYCLRVVPTALATALDINLSNISLVFITVTFATMCKSASPIFILLFAFMFRLEKPSFSLLGIMLVVSFGVLLTVAKETEFNLWGFMFIMLAAVMAGFRWSMTQILLQKEEYALKNPFTLMSHVAPVMAIVTAIISIVMDPWHDFRASHFFDSSTHIIRSSLLLLLGGALAFFMVLTEYVLVSVTSAVTVTVAGIVKEAVTILVAVLFFNDPFTWLKALGLAIIIFGVSLFNIYKYKRFKKGHHSEDAGTNIQSYNGTSKYVILDDDTEDQDDSG

SEQ ID NO: 913 - protein, 366 aa, Zea mays
MVMMMRSCLGGGLLPVAVMLCLNVVAAVMVSLVKVAMDGGMKPLVIVTLQQLTAAVFLAPIAFFKERKSRPKLTLEIFAYIFVSAALGAALRQYMIFVALRYTTATFVTAFSNIAPVLTFLLAVATRSEALDLKSRTGLAKLLGTLVSLAGAMVLTLYKGVALTHAAAASQDQQQHSHGRLPPSAADSRGKWTLGTVAILGNCVCLSCWFLLHGRLAKKYPHVYSCNALMSLLSFLQVAVVGLCTQRSISPWIVTSKFNILTVLYAGIVGCGVSFVLVTWCIEKRGAVFVAAFIPVVQIIVSVIDFSILHEQLYLGSVLGSVLVIGGLYLLLWGKRQEALHCPPPPPPKVAEEDPADKEQQQVQHN

SEQ ID NO: 914 - protein, 356 aa, Zea mays
MLVEMGSRAAFVVAFLLRAIYAGTQILTKAAFDEGMNTSVFVFYRHLTGILFLVPIAFVLERKTAPPLSFRVSLKLFFHALYGISGAINIYGLGLSYSSATSSSAIFNLLPAVAFFLAVLLGMETLNLKRFHGIAKAAGVLFSTAGVTVLAFYQGPAFRSFIHHTAFSHHNVHAGVVTAAHPKSVWILGIFLTTLSTASWALWTVLQGPMLEAYPSKLLNTTLQMIFATVQCFFIALAAERDLSRWKLALDIRLYAVIYSGILVSGVAYYMQVWVIEKSGPVFLAMTMPITLLVTIILSLFLGEPVTLGSILGGLIMVGGLYSVLWAKRSEQVHASKQQMAAPTPPPAGDTSVGRA

SEQ ID NO: 915 - protein, 383 aa, Zea mays
MGVGKLMNDVKPYLAMVLLQVGFSGMYIVSVASLKRGMNHFVLVVYRNLVATVVMAPFALLFERRVRPKMTPLIFLKIMGLAVLEPVLDQNMYYLGAKLTSATFASALVNILPAITFLLALALRMERLRLRSLRSQAKVVGTVCTVAGAVLMILYHGPVVPFPWSAGRLHHHVPAAAVESQSSASWLNGICMIIGSCLCWSGFFILQSNTLQSYPAELTLTTLICFLGSVLTGGVALVAERRDMSAWVIGFDTRLFTAVYSGIVCSGVAFYVQGIVTQARGPVFVTAFQPLCMIITTVLGSTILKEETTLGSVIGAAIIVVGLYCLIWGKSKDHLGSNGGKPGAAAVAELPLTSSAPAWSNGKQALAVVETTPPSSLPNKCVH

SEQ ID NO: 916 - protein, 360 aa, Zea mays
MLRRQGRGGKFLEEVLIVGGLLLVQCVLSGYVVFTDHLLALGADPLAVVVVAGAAYAAFCFPFAVALERKRWPSTVSGTLVAQYLLIALGGTTAFQALMLLGIKKTTPAIASAMPNLSPGLIFIVAACFRLERFDRACKYTQAKMAGTVVCLAGALAMGFLHSPTSTSSSLQAAVAAEAAAGGGDYYYDWILGCCCLVAAVTVFALVTVLQAATLAAFPAPLTMCCATSATGAALTAVLRLVLEGRFLGMGSPRIDATLVAGIVVLGGAAVGACMAFQAWCLGRKGPLFVSVFGPVQTVCTAILSAALLRQVLSLGSLAGIVLMFTGLYIVLWAKSNEISADDEEQSLQGGDDAEKALLA

SEQ ID NO: 917 - protein, 393 aa, Zea mays
MADSGEGRRVCGMPEKAQLHVAMLLLQFGYAGFHVVSRLALNMGISKLVFPVYRNIIALCLLVPFAYFLEKKDRPQLTLNFVVQFFLLALCGITANQGFYLLGLDNTSPTFASAIQNSVPAITFAMAAALRIEKVRLDRRDGVAKVAGTLACVAGASVITLYKGPTIFGPSGSGGGGGLELAAVGGDKNWTLGCVYLIGHCLSWSGWLVLQAPVLKKYPARLSVTSYTCFFGVIQFLVIAAFMERDAEAWKFHSGSELFTILYAGFIASGVAFAVQIWCIDRGGPVFVAVYQPVQTLVVAIMASLTLGEKFYLGGIIGAVLIVAGLYLVLWGKSEERARVARDAVSGGDREGLLVAAAAGGGGGGIIRSAGNKVASAATQPLLLPSSTSTDNV

SEQ ID NO: 918 - protein, 377 aa, Zea mays
MANSRIGRYKMSTLSDPSKEDTSPEGSGTTQRNGAWSNTLNTLLQQASVYGVAAGYCLSASLLSIINKWAIMKFPYPGALTALQYFTSVAGVLLCGQLKLIEHDGLNLRTMWKFLPAAVMFYISIFTNSELLLHANVDTFIVFRSAVPIFVAIGETLYLHQPWPSLKTWLSLSTILGGSVIYVFTDNQFTVTAYTWAVAYLASMSIDFVYIKHVVMTIGLNTWGLVLYNNLEALMLFPLELLIMGEFDQMKVDSSKVSNWLSFDVVLPVALSCLFGLSISFFGFSCRRAISATGFTVLGIVNKLLTVVINLLIWDKHASFVGTIGLLICMSGGVLYQQSTMKPKAPKVEPKEENDNDEEQQKLLQMQGVQESNPTQK

SEQ ID NO: 919 - protein, 344 aa, Zea mays
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVTVVAAGVGICTVTDVEVNAKGFICACVAVFCTSLQQITIGSFQKKYNIGSFELLSKTAPIQALSLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPIPRNKGGMLDGEDVPLKARVSGVPAVDLEDGDVKG

SEQ ID NO: 920 - protein, 364 aa, Zea mays
MSGMAARIGEWKPVMAMLIFDLISAVTTALIKKALQEGLDRLVLITLRQLVATVFLAPIAYFRERSTRPKLTLEILVYLFFSAAFGAALSQYTFFYGLQYTTATFAITFTNVAPVLTFLIAVLLRVESLSMKNKAGAAKIAGTLTSFAGVMLLTLYKGVSLTHQQAGEASPEDHNLGAAAASPSDRKSWTLGTLALLANCLCFSFWLLLQSRLTKKYPALYSSTAYMFLISSMQGGALTAAIQRRASVWLLTRPIEIVTVLYTGIMGSGVGYVLMTWCVEKRGPVFTSAFIPVIQIMVAMVDFFFLHENLYLGSVLGSILLILGLYILLWGKKRDASSSAAAKEEEDGEKEDEEEEDKEKQVRS

SEQ ID NO: 921 - protein, 409 aa, Zea mays
MAVVAGDSESLMQRCKPYVAMISLQFGYAGMNVITKVSLNHGMSHYVLVVYRHAFATLSIAPFALVLERKVRPRMTLWAFLQIFVLALLGPVIDQNFYYAGLKFTSPTFSCAMSNMLPAMTFVLAVLFRMEKVNLKKARCVAKVVGTLVTVAGAMLMTLYKGRVVELVWTKHIHLHGPHPDAAAAAAAADKDWFTGSIFLIIATLAWASLFILQAATLKRYDAPLSLTTLICFVGTLQAIVVTFVMEREPSVWRIGFDMNLLAAAYAGIVTSSIAYYVQGLVIQSRGPVFASAFSPLMMIIVAIMGSFILAENIYLGGIIGSVLIVAGLYSVLWGKHKENEEKEGEAAMEIPVAIKAVDGNGRIMEIVELDEVQLEKAQANTNANANAAVAVTAVPAAEARMQGKDDQA

SEQ ID NO: 922 - protein, 347 aa, Zea mays
MEFKRDVWSLLLVLLLGQLVAFSMAASSFASSLIANLGVDAPLTQSFLAYLLLTLVYVPIVLRRRQKLQIAWYWYLALAFFDVQGNYLVVKAYQYSYITSVTLLDCWTVVWVVMLTWYALGTRYSLWQFVGAGTCVAGLALVLLSDAKSQDEQDPKKIPLLGDALVIAGTVGFAFSNVGEEYCVKKKDRAEVVAMLGLFGLLISTVQILVFERKGLEAVTWSPTMISLFAGFAVAIFVFYTVAPFVLKMSGATLFNLSLLTSDMWAVAIRVLFYQQEINRLYYLAFTVVAIGLIIYSLNDRSSDDETAGSTEAPAQYQQLPIEDNSTRIGSSSGSQERTHKEEVHIC

SEQ ID NO: 923 - protein, 499 aa, Zea mays
MRRGSAYLIGFLFKNTKLYLADEASDMMSTLIILLSDTDKATVSAALEAFSRVVASVPKEQLPTHIKLVRDAVSTARDKERRRRKGVPILLPGLCLSKALQPFLPIFQQGLISGSAETKEQAAEGLGELIDVTSEKTLKEVVVPITGPLIRILGDRFPWQVKSAILSTLTIIIMKGGIALKPFLPQLQTTFVKCLQDNNKSVRTRAAAALGKLSALSTRVDPLVSDLLSMLQSGDESVKESVLSALKGVIKHAGKSVSAPIRSRGCALLEDLLQAEADDIRSCAAKVIGTLSQYMDDREIPDLVQILLEVGTSSDWCTRHGALLALSSISMHSPSKLCDLASFPSLVDLLKDSLKDDKFPVREVATRTLGRILVFELQSEADTLQLVQLLVLALRDDSSEVRRRSLSCIKAAAKMNHSALATHHSILGPAIADALKDSSMPVRLAAERCALHVFQLTKGPDNVTTAQKYLGMTGLEVKKIAKLNEESDGSESSDDDRRT

SEQ ID NO: 924 - protein, 373 aa, Glycine max
MMDRRHCYKDLLPLVVLVANECNNTGLFTLFKAATLQGMSNYVFVTYAYSVAFLVLLPVTFFYRRSRVVPPLTFSILSKIALLGVIGCSSQILGYAGIRYSSPTLSSAISNLTPAFTFVLAVICRMEKIAVKRRTTQAKILGSIISVLGAFVVTFYKGQSVIIADNSPSIQLPQSNGILTSVDRNWVIGGLLLTACNILLTVWFVYQVEILKEFPDELSMVFFYNLCAAIVASIVGLLGEKNSSAWKIRPDISLISIVCTGIFNKFLSSAIYAWGIHLKGPVYVAMFKPLSIVIAVAMGVMFLGDSLYVGSIIGATIISIGFYTVMWGKATEQKEEEGEEENVGSQESSITENVPLLQSYITVNSTKKIDGSV

SEQ ID NO: 925 - protein, 351 aa, Glycine max
MGRWVNCRGNIFPFLGMVMAMLAQSGSMVVIKVAMTDGINKYVMVVYSLALSTILLLPFALFLHRSERPPLTFSALCSFFLLAFFGSSGQIMAYVGIDLSSPTLASAMLNLIPAFTFILALIFRMEEVHWKHSSSQAKFLGTIVSIAGAFVVILYKGPPIFKTHLSNSSNKFLFSQQLNWILGGMFCAGDSIVCSLWYIYQASVAYKYPAVTTIVFFQLLFSTIQCGVFALIVVQDQTEWELKLDIGLIGIVYQAIAATLIRYILCTWCVLKAGPLFCSMFKPVAIIFSVFMGAIFLGDDLSLGSLIGAVIIVIGFYAVLWGKSIEDNKIEKGVENLESSCHNVPLLQNRT

SEQ ID NO: 926 - protein, 346 aa, Glycine max
MGKGGSLSDGVVKKIVLSYSYVAIWIFLSFTVIVYNKYILDKKMYNWPFPISLTMIHMSFCATLALLLVRVFRLVEPVSMSRDVYLSSVVPIGALYSLSLWLSNSAYIYLSVSFIQMLKALMPVAVYSIGVMLRKESYKNDTMLNMLSISLGVGVAAYGEARFDAWGVLLQLGAVAFEATRLVMIQILLTSKGISLNPITSLYYVAPCCLVFLSIPWIFVEYPVLRDTSSFHFDFVIFGTNSFCAFALNLAVFLLVGKTSALTMNVAGVVKDWLLIAFSWSVIKDTVTPINLFGYGLAFLGVAYYNHSKLQALKAKEAQKKTAQADEEEGRLLEDRDDNKRNEQQT

SEQ ID NO: 927 - protein, 350 aa, Glycine max
MKELGLVSMMLMAELLDVIVNTLSKAAMKKGMNDFVFIMYSNAFAACLLLLLALFFYRKRTLPPLSCNTLGLFLVVGMLSCINQSIKFFGIGYSSPTLASALSDLVPAFTFILAVIFRMEKLDWKANSTLAKSIGTVVSIAGALLLSLYKGQVIINNNPPFKLFPQKLVSSMQFDWVFGALLLAAHSCFLSINYILLTRIVREYPAELVVVLSRIALTSILSVPAALISVKDLKALRLGFNMELIAIGCSAIFVLSFRGVIHIWIMGKRGPVYVAMFKPLEIVFAVILGVTFLGDSLYIGSVIGAAIIVVGFYAVIWGKSQEKVEEDCTVCSSESYDNEVPLLQNKRTGE

SEQ ID NO: 928 - protein, 362 aa, Glycine max
MEVMCGAKVGNMVHKAKPYVLTVGLQFGMAGTYLFTMASLNHGMSRLVFIVYRNAIAALALAPFALIFERKVRPKMTWTVFIQILVLGFLEPVVDQGFTFLGMQYTSASFASAVMNAVPSVTFVLAVIFRLEHIKIRELRSQAKVIGTLVTFAGALLMTLYKGPQFDLFHHSNTTHQQGGSHTQNHSHWVAGTLFICLGCLAWSSFYILQSITVKRYPAELSLSSLICLAGALQSAVVALIADHNPRAWAIGFDYSLYGPLYTGIMSSGIAYYIQGLVMQSRGPVFVTSFNPLCMIIVTALGSFLLGEHLYLGSIIGGIIIAVGLYSVVWGKGKDYKDDTSSPATTKETETMQLPITLPNNK

SEQ ID NO: 929 - protein, 412 aa, Glycine max
MASWWCSSPSATLTVSTTTTRHFSLLSHTSQFRIQTLTFPPSSFTRFTTAPPSLRFRVPCSNKTAFETELPEDGVDCVGTGQDVECLVNTEEKQSEPSSSSSSSSSSSSMLCLAEALWEGAVLVSPFFFWGTAMVAMKEVLPKCGPFFVSAFRLIPAGFLLVAFAASRGRTLPSGFNAWLSITLFALVDAACFQGFLAEGLQRTSAGLGSVIIDSQPLTVAVLAALLFGESIGVVGAAGLVLGVIGLVLLELPALSFDESNFSLWGSGEWWMLLAAQSMAIGTVMVRWVSKYSDPVMATGWHMVIGGLPLVLFAVLNNDPAVSLSLKEYSSTDILALLYTSIFGSAVSYGVFFYSATKGSLTKLSSLTFLTPMFASIFGFLYLGETFSPVQLVGALVTVAGIYMVNFRSTSE

SEQ ID NO: 930 - protein, 333 aa, Glycine max
MSSVSKGDRKASIDAASWLFNVVTSVGIILVNKALMATYGFSFATTLTGLHFATTTLLTLILKSLGYIQTSHLPLSDIIKFVLFANFSIVGMNVSLMWNSVGFYQIAKLSMIPVSCFLEVVLDNVRYSRDTKLSIVLVLLGVAVCTVTDVSVNAKGFIAAVIAVWSTALQQYYVHFLQRKYSIGSFNLLGHTAPAQAASLLLVGPFMDYWLTGKRVDAYGYGLTSTLFIILSCTIAVGTNLSQFICIGRFTAVTFQVLGHMKTILVLILGFIFFGKEGLNLHVVLGMIIAIAGMVWYGSASSKPGGKERRSFSLPKTQDYSSLPVSSEPDTKE

SEQ ID NO: 931 - protein, 329 aa, Glycine max
MATFEQFWSRKTLLGLALGQFLSLLITSTGFTSSLLAKKGINAPTSQSFLNYVFLAIVYGIIVLYRREALKAKWYYYILLGLVDVEANFLVVKAYQYTSLTSVMLLDCWSIPCVMLFTWIFLKTKYGFKKVTGVVVCIAGLVLVVFSDVHAGDRAGGSNPSIGDILVIAGATLYAVSNVSEEFLVKNADRVELMAMLGLFGGIISAIQISILERNELKSIHWSAGAVLPFVGFAVAMFMFYSLVPVLLKINGSTMLNLSLLTSDMWAVLIRIFAYHEKVDWMYYVAFGAVVVGLIIYSGGDGDENQDPHHVAEDASQRQHDEEATSGKS

SEQ ID NO: 932 - protein, 371 aa, Glycine max
MAKRVFLYKDLVPFGAMVTMECLNVALNTLFKAATLRGMSYHVFVVYAYAVAAIVLIPGPFISQRCRSRVLPPLSFPLLRKIGLLGLIGCASQIVGYTGISFSSPTLSSAISNLVPAFTFLLAIIFRMEKVIVRNTTCQAKVLGTIVSITGAFVVTFYKGPPIIIVHTPSLSLHQPINTLNSVDRSWAIGGLLLTAEYILVPLWYIVQVQIMKVYPNELTVIFFYNLCVSIMAAIVAIFTETNAGAWKIGLDTALASIVCSGIFGSFVNNAVHTWVLRIKGPVYVAMFKPLSIAIAVALGVMFLGDTLHLGSLVGATVISIGFYTVMWGKATEENVDEDVPGQQSPPTTENVPLLQSYKTDTAEKKMHGSV

SEQ ID NO: 933 - protein, 389 aa, Glycine max
MADLGSASSKRMWCSVPERMQLHLAMLALQFGYAGFHVVSRAALNMGVSKLVFPVYRNIIALLLLLPFAYFLEKKDRPAMTLNFVCQFFLLALVGITANQGFYLLGLENTSPTFASAIQNSVPAITFLMAAILRIEQVRLNRKDGLGKVAGTVLCVVGATVITLYKGPTIYSPTTGVNINNTRVTQVFELGSVSLGDAKGKNWTLGCLYLIGHCLSWSGWLVLQAPVLKKYPARLSVTSYTCFFGLLQFLVIALLLERDAQAWLFHSGGEAFTILYAGVVASGIAFAVQIWCIDRGGPVFVAVYQPVQTFVVAIMASIALGEEFYLGGIIGAVLIVAGLYLVLWGKSEERKFAREQLAIASTEHSIIRPASHAKASLAQPLLSSSTENV

SEQ ID NO: 934 - protein, 306 aa, Glycine max
MKSSRRLLRIGLVSAWYSSNIGVLLLNKYLLSNYGFKYPIFLTMCHMTACSLFSYVAIAWLKMVPMQTIRSRLQFLKIAALSLIFCFSVVFGNVSLRYLPVSFNQAVGATTPFFTAVFAYVMTFKREAWLTYLTLVPVVTGVVIASGGEPSFHLFGFIVCIAATAARALKSVLQGILLSSEGEKLNSMNLLLYMAPIAVVFLLPATLIMEENVVGITLALARDDVKIIWYLLFNSALAYFVNLTNFLVTKHTSALTLQVLGNAKGAVAVVVSILIFRNPVSVTGMMGYSLTVLGVVLYSQAKKRSK

SEQ ID NO: 935 - protein, 367 aa, Glycine max
MGAGLVAFLLMVLVQLVYAVMNITSKLAIESGMSPLVLVAYRQLFATVSIAPFAYWLEWNTLPRITQRLMIQILFSSLTGVTGNQMLYFVGLKYSSATIACALTNLLPAFTFILAVLFRQENLGIKKRAGLAKVFGTILCVSGALLLSFYHGKTIGLGQSSIHWRYAEKMEGTSSSGKGNMFLGPLVVILSTLVWAAWFIIQKDISKTFPAPYTSTGLMCFMASFQCVIIAVCVDHRASAWSLHNAMRLSSALYAGIFCTGLAYCLMSWTIERKGPLYVSVFTPLQLVLTAILSWALLREKLYVGTAVGSLLIVLGLYSVLWGKSEEVNKGDGIEEDAVKEAVKDSKNDMELQSYVPSNGNNGRVIA

SEQ ID NO: 936 - protein, 345 aa, Glycine max
MAVSDGVVKKIVLSYTYVAIWIFLSFTVIVYNKYILDRKMYNWPYPISLTMIHMAFCSSLAYILVRVLKLVEPVSMSRDLYLKSVVPIGALYPLSLWFSNSAYIYLSVSFIQMLKALMPVAVYSIGVIFKKEAFKNETMANMVSISLGVAVAAYGEAKFDAWGVTLQLMAVAFEATRLVLIQILLNSKGISLNPITSLYYIAPCCLVFLSVPWIIMEYPSLRDNSSFHLDFAIFGTNSACAFALNLAVFLLVGKTSALTMNVAGVVKDWLLIAFSWSVIKDTVTPINLIGYGLAFLGVAYYNHCKLQALKASEAQKKALQADEEAGRLLEQKDGEGTGRKNDNQN

SEQ ID NO: 937 - protein, 354 aa, Glycine max
MVEAQTWTTRRMSNPRLDTSTTDQVLDIPPTPPGELRNSFGSNPNNLSPTLLTALIISSWYLSNIGVLLLNKYLLSFYGYRFPIFLTMLHMLSCAAYSYASINFLELVPLQHIHSKKQFLKIFALSAIFCFSVVCGNTSLRYLPVSFNQAIGATTPFFTAIFAFLITCKKETGEVYLALLPVVFGIVVASNSEPLFHLFGFLVCVGSTAGRALKSVVQGILLTSEAEKLHSMNLLLYMAPLAAMILLPFTLYIEGNVLALTIEKAKGDPFIVFLLLGNATVAYLVNLTNFLVTKHTSALTLQVLGNAKAAVAAVVSVLIFRNPVTVMGMAGFGITIMGVVLYSEAKKRSKVTTH

SEQ ID NO: 938 - protein, 901 aa, Oryza sativa
MDIVPVVALCCCLVLLPSWAYGLGSMASIAVSYGEDGPVFCGLNSDGSHLVTCFGADASVVYGAPSRIPFVGVTAGDGFACGLLLDTNQPYCWGSNSYVKIGVPQPMVEGAMYSELSAGDNHLCALRTSVKGFHSVNGDTSVIDCWGYNMTATHTVTGAVSAISAGSVFNCGLFARNRTVFCWGDESVSGVIGLAPRNVRFQSIGAGGYHVCGVLENAQVFCWGRSLEMQQMSTPSSTDDGDVNIVPMDAMVSVVGGRFHACGIRSLDHQVACWGFTLQNSTLAPKGLRVYAIVAGDYFTCGVPAETSLKPMCWGHSGPLALPMAVSPGICVSDSCSHGYYEYANHGEVGSGSKTCKPANSRLCLPCSVGCPDDSYESSPCNATADRVCQFDCSKCASDECVSFCLSQKRTKNRKFMAFQLRIFVAEIAFAVILVFSVTAIACLYVRYKLRHCQCSKNELRLAKNTTYSFRKDNMKIQPDVEDLKIRRAQEFSYEELEQATGGFSEDSQVGKGSFSCVFKGILRDGTVVAVKRAIKASDVKKSSKEFHTELDLLSRLNHAHLLNLLGYCEDGSERLLVYEFMAHGSLYQHLHGKDPNLKKRLNWARRVTIAVQAARGIEYLHGYACPPVIHRDIKSSNILIDEDHNARVADFGLSILGPADSGTPLSELPAGTLGYLDPEYYRLHYLTTKSDVYSFGVVLLEILSGRKAIDMQFEEGNIVEWAVPLIKAGDISALLDPVLSPPSDLEALKKIAAVACKCVRMRAKDRPSMDKVTTALERALALLMGSPCIEQPILPTEVVLGSSRMHKKVSQRSSNHSCSENDLVDGDDQRIEYRAPSWITFPSVTSSQRRKSSASEADMDGRTTTDGRNVGSSIGDGLRSLEEEISPASPQENLYLQHNF

SEQ ID NO: 939 - protein, 768 aa, Oryza sativa
MFSLFSFVVIFLCLITNAIYSGSKFVHATDTLLPGKSLSGNQVLISKGGAFRLGFNCLSPPCYSDSTFGIWYIKSSTCRSLLVWAPVANFCIFNPWSSSFILSEDGKLNLIIDGSLSWSSNGVETSVSAVAILLDNGNLVIRDQVNSTMVFWQSFDNPIGILLPGGWLGFNRMTGKNVSLSSKYSTDGYDAYDTGNFILDINANEGRGFTINAPDFDSGNTYKIKYSGAFPRWMGVRADGGSFLLFNDADIYVQLYPDGNVTAAKLGDCGSVLWSAPENWCDFDSYCGSNSFCIIPSKESFFESPCYDFSDLGYLMNVSLNCRYNAPHKQNVSFHPMVGVYKFPQNEWSIEVRSIRECEAACYSDCSCTSFAFNKTCLLWYGELQNTIVFDSRSEGYLMYMRVVEQKQEKSEYKVAIIVVTVIGGLVLILISMILLWRGKRKLFTEKPVNSDSRLMIFSNSQLKNATKGFSEKLGEGGFGCVFKGTLPGFSVVAVKKLKDLRQGEKQFRSEVQTIGMIQHINLVRLLGFCAEGSKRLLVYEYLVNGSLNSHLFSNYSAKLTWNLRYCIAHGIAKGLAYLHEECRHCIIHCDMKPDNVLLDAEFCPKIADFGMAKLLGRDFSRALTTMRGTIGYLAPEWISGLPITHKADVYSYGMMLLEIISGRRNSEKIKEGRHTYFPIYAACKVNEGDVMCLLDRRLDGNADAEQLEKACRIACWCIQDAEDHRPMMGQVVHMLEGVMDVEVPPIPRSLQYFVGMEDNNTQSAECN

SEQ ID NO: 940 - protein, 782 aa, Oryza sativa
MAPTLAFLLVLLLLLAGGGGGGAFLAAAASTDTVVPGKGMAGNQTLVSKNGRFELGFFTPGSGIHYFLGVRLRNMAEYSPTFWIGDRVGVIDLPGVSLEVFGDKLYIKEDGVSLWWSSVAGNGSSSSSDGGAVAVLLDTGDLVVRDQGNPSGVLWRSFDYPGDSLLPGGRLGLDAATGTNVSLTFKGFSHNGSLQVDASRRNGFVLTTDGIDSRGAFPDWMVTSQDNGSSLVLNHPDAPNSTEFLQFNLGLISLMRWSDSTAGWVARWTFPSDCKSGAFFCGDFGACTAGGGGGCECVDGFTPSYPDEWRLGYFVTGCSRSLPLSCEANGQTEHDDSFAILDNLRGLPYNAQDEPVTTDEDCRAACLNKCYCVAYSNESGCKLWYHNLYNLSSADKPPYSKIYVRLGSKLKSNRGLATRWIVLLVVGSLAVTSVMLGLVLLCRYRRDLFASSKFEVEGSLIVYTYAQIRKATGNFSDKLGEGGFGSVFRGTLPGSTTVVAVKNLKGVGQAEKQFRTEVQTVGMIRHTNLVRLLGFCVNGNRRLLVYEYMSNGSLDAHIFSEKSSLLSWHVRYQIALGIARGLAYLHEECEDCIIHCDIKPENILLDYEFCPKICDFGMAKLLGREFNSALTTVRGTMGYLAPEWIYGQPITKKADVYSFGIVLFEIISGRRSTETVKFGSHRYFPTYAAVQMNEGDVLCLLDSRLEGNANVKELDITCRVACWCIQDEENDRPSMGQVVRMLEGVVDMEMPPIPASFQNLMESEDSGIYSEESWNFRTRDQF

SEQ ID NO: 941 - protein, 813 aa, Oryza sativa
MACSFLCKPWLPLTESAKPARSPAPSSRARTVVQQLAVLLLLLGGVGGGGGALLAAAASTTDTILPGESITGNQTLVSKNGEFELGFFNPGVGIHYFLGVRLRKLAAYSPTFWIGDRVYVVDLPRAALELFGDSLYIKEDGASLWWSSPSSSSSSSGGGRGGGAAVAVLLDTGDLVVRDQRNSSLVLWRSFDYPGDALLPGGRLGLDVATGENVSLTFEGFTHNGSLRADASRRNGFVLTTDGRDTRGAFPDWMVTTQDNGGSLVLNHPDATNSTEFLQLKVGQVSLVRWSGADAGWVPRWTFPSGCKSGGGFFCGDFGVCTTATGGECRCVDGFAPSDTKEWGLGYFVTGCSRSLPLSCDANGQTEHGDSFAILDNLQGLPYNAQDEPATTDEDCREACLNKCYCVAYSTETGCKLWYYDLYNLSSADKPPYSKIYVRLGSKLKSKRGLATRWMVLLVVGSVAVASAMLAVLLLCRYRRDLFGSSKFVVEGSLVVYSYAQIKKATENFSDKLGEGGFGSVFRGTLPGSTTVVAVKNLKGLGYAEKQFRAEVQTVGMIRHTNLVRLLGFCVKGNRKLLVYEYMPNGSLDAHIFSQKSSPLSWQVRYQIAIGIARGLAYLHEECEHCIIHCDIKPENILLDEEFRPKIADFGMAKLLGREFNAALTTIRGTRGYLAPEWLYGQPITKKADVYSFGIVLFEMISGIRSTVTMKFGSHRYYPSYAAAQMHEGDVLCLLDSRLEGNANVEELDITCRVACWCIQDREGDRPSMGHVVRMLEGVVDTEMPPIPASFQNLVDGDDSDIYEENWRLRTQD

SEQ ID NO: 942 - protein, 749 aa, Oryza sativa
MILNVIILFVDSYVAVASDTLFPGQSLSGSETLVSENGIFELGLFPSAPAGTKHYLGIRYKNMSSNNPITFWLGNRIPITYFINATLYIDAGKLYIEELGSILWTSNSTRNESNTAVAVILNTGNFVIRDQLNSSVVTWQSFDHPADKLLPGAYLGLDMVMGTNILLTLFKPPYNCTLMIDQSRKRGFIMFIDGHDKYLGTFPEWMVTYEENGSLVRLNDPGIPNDTEYMKLQLGQLSLLRWLDNATISGWQSVWSHPSSCKVSAFHCGAFGICTSTGTCKCIDGFRPTEPNEWELGHFGSGCSRITPSNCLGVVSTDLFVLLDNLQGLPYNPQDVMAATSEECRAICLSECYCAAYSYHSACKIWYSMLFNLTSADNPPYTEIYMRIGSPSKRRMHILVFVLIFGSIGVILFLLMLLLMYKRSSCVARQTKMEGFLAVYSYAQVKKATRNFSDKLGEGSFGSVFKGTIAGSTIVAVKKLKGLGHTEKQFRTEVQTVGMIQHNNLVRLLGFCTRGTRRLLVYEYMPNGSLDSHPFSETSRVLGWNLRHQIVVGIARGLAYLHEECRDSIIHCDIKPENILLDAEFCPKIADFGMAKLLGREFSAALTTIRGTIGYLAPEWISGQAITHKADVYSFGVVLFEIISGRRSTEKIRHGNHWYFPLYAAAKVNEGDVLCLLDDRIEGNASLKELDVACRVACWCIQDDEIHRPSMRKVIHMLEGVVDVELPPIPASFQNLMDDYDSDIYSVEV

SEQ ID NO: 943 - protein, 822 aa, Oryza sativa
MEIARQLSVAYYQRPAMAALQSAVVFADTVTAKRPLSGSQSALVSKRRKFALGFFQPENSQHWYLGIWYNQISKHTPVWVANRGTPISNPDTSQLTIATDGNMVLLDNSTTAIWSTNISKIASNSTVGVILDTGNLVLADESNTSIIHWQSFDHFGNTWLPGGKLGRNNKLAGVSTRLVAWKARNDPSPGVFSLELDPNGTSQYLLEWSITQQYWTSGNWTGRIFADVPEMTGCYPSSTYTFDYVNGENESESYFVYDLKDESVLTRFFLSEMGQIQFLTWIYAAKDWMPFWSQPKVKCDVYSLCGPFSVCTENALTSCSCLRGFSEQNVGEWLQGDHTSGCRRNVELQCSSNASVMGRTDGFYTMANVRLPSNAESVVVIGNDQCEQACLRSCSCTAYSYNGSCSLWHGDLINLQDVSAISSQGSSTVLIRLAASELSGQKQKNTKNLITIAIVATSVLVLMIAALFFIFRRRMVKETTRVEGSLIAFTYRDLKSVTKNFSEKLGGGAFGLVFKGSLPDATVVAVKKLEGFRQGEKQFRAEVSTIGNIQHVNLIRLLGFCSEKSRRLLVYEYMPNGSLDKQLFDNKKHVLSWNTRYQIALGIARGLDYLHEKCRDCIIHCDIKPENILLDGSFAPKVADFGLAKLMGRDISRVLTTARGTVGYIAPEWIAGTAVTAKADVFSYGMTLLEIVSGRRNVQGRRRRQEQQDDGGAAADRPFPLVAAGRLVGGGGGRREELVSAVVDGRLGGDADMGEAERACRVAFWCIQDDENARPAMATVVQVLEGLVEIGVPPIPRSLQFLAELADQSNYLQFFSDLLPSN

SEQ ID NO: 944 - protein, 831 aa, Oryza sativa
MPPLLYNLFVLIVVFLGGGAPACSAATDTVKPGHVVGGKDKVVSNNGKFALGFFKAPAPNQEKWFLGIWFNTVPNRTTVWVANGGEPIMDAADAGSPELTISGDDGDLVALHPTTKSIAWSTNVSAKNSTSNSNNTAAVLLNSGNLVLQDTSNMSQPRTLWQSVDHPTDTLLPGAKLGRDKLTGLNRRLVSKKSMAGPSPGAYCFEVDEDTPQLVLKLCNSSVTYWSSGPWNGQYFTGIPELIGNSPGFHLGFFDNSREEYLQFNVSNEAVVTRNFIDVDGRNKQQVWLDSSQSWLTLYSNPKVQCDVYGVCGAFSVCSFSLLPLCSCMKGFTVGSVKDWEQGDQTGGCVRKNQLDCVGSNTSSSDSTDKFYSMSDIILPDKAESMQDVDSSDECMKVCLNNCSCTAYSYGSKGCLVWHTELLNAKLQQQNSNGEIMYLRLSARDMQRSKKRRVIIGVVVGACAAGLAVLMFILMFIIRRNKDKNRSENYGSLVAFRYKDLRSATKNFSEKIGEGGFGSVFRGQLRDSTGIAVKRLDGRSQGDKQFRAEVRSIGTIQHINLVNLIGFCSDGDSRFLVYEHMPNRSLDTHLFQSNGKFLDWNTRYQIALGVARGLCYLHESCHDRIIHCDIKPQNILLDASFLPKVADFGMAKFVGRDFSRALTTMRGTIGYLAPEWISGTAITPKVDVYSYGMVLLELVSGRRNSARSEEECTTTTTTSTSTDTDGNYSVYFPVQASRKLLDGDVMSLLDQKLCGEADLKEVERVCKIGCWCIQEDEVDRPTMGQVVQILEGVLDCDMPPLPRLLQRIFERPSSVSTSTPVFLFVGSPERQ

SEQ ID NO: 945 - protein, 824 aa, Oryza sativa
MEAHGNRRSSPTYLVMLWMISVASLLITCRGSIQKQVLFPGFTAAQMDYIDNDGIFLLSNGSVFGFGFVTSNVSDNTFYILAVVHMATTTTVWSANPNSPVTHSDDFFFDKDGNAFLQSGGGSKYGLPISPGRDCHLYATTGLWQSVVLGKDASSPLWQSFSHPTDTLLSGQNFIEGMTLMSKSNTVQNMTYTLQIKSGNMILYAGFETPQPYWSAQQDSRIIVNKNGDRIYPANLSSASWSFYDQSGSLLSQLVIAQENANATLSAVLGSDGLIAFYMLQGGNGKSKFSITVPADSCDMPAYCSPYTICSSGTGCQCPSALGSFANCNPGVTSACKSNEEFPLVQLDSGVGYVGTNFFPPAAKTNLTGCKSACTGNCSCVAVFFDQSSGNCFLFNQIGSLQHKGGNTTRFASFIKVSSRGKGGSDSGSGKHNTIIIVIMLGTLAIIGVLIYIGFWIYKRKRHPPPSQDDAGSSEDDGFLQTISGAPVRFTYRELQDATSNFCNKLGQGGFGSVYLGTLPDGSRIAVKKLEGIGQGKKEFRSEVTIIGSIHHIHLVKLRGFCTEGPHRLLAYEYMANGSLDKWIFHSKEDDHLLDWDTRFNIALGTAKGLAYLHQDCDSKIVHCDIKPENVLLDDNFIAKVSDFGLAKLMTREQSHVFTTLRGTRGYLAPEWLTNYAISEKSDVYSYGMVLLEIIGGRKSYDPSEISEKAHFPSFAFKKLEEGDLQDIFDAKLKYNDKDGRVETAIKVALWCIQDDFYQRPSMSKVVQMLEGVCEVLQPPVSSQIGYRLYANAFKSSSEEGTSSGMSDYNSDALLSAVRLSGPR

SEQ ID NO: 946 - protein, 257 aa, Glycine max
MADSSREENVYMAKLAEQAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKETSKQQPGE

SEQ ID NO: 947 - protein, 117 aa, Glycine max
MADSSREENVYMAKLAEQAERYEEMVEFMEKVAKTVEVEELTVEERNLLSVAYKNVIGARRASWRIISSIEQKEESRGNEDHVAIIKEYRGKIEAELSKICDGILNLLESNLIPSAA

SEQ ID NO: 948 - protein, 120 aa, Oryza sativa
MSPAEASREENVYMAKLAEQAERYEEMVEFMEKVAKTTDVGELTVEERNLLSVAYKNVIGARRASWRIISSIEQKEESRGNEAYVASIKEYRSRIETELSKICDGILKLLDSHLVPSATA

SEQ ID NO: 949 - protein, 253 aa, Sorghum bicolor
MSREENVYMAKLAEQAERYEEMVEYMEKVAKTVDVEELTVEERNLLSVAYKNVIGARRASWRIVSSIEQKEESRKNEEHVAQIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDITEEGTEEGKEASKGDAE

SEQ ID NO: 950 - protein, 115 aa, Sorghum bicolor
MSREENVYMAKLAEQAERYEEMVEYMEKVAKTVDVEELTVEERNLLSVAYKNVIGARRASWRIVSSIEQKEESRKNEEHVAQIKEYRGKIEAELSNICDGILKLLDSHLVPSSTA

SEQ ID NO: 951 - protein, 262 aa, Oryza sativa
MSAQAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLESHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDTAEEIREAPKRDSSEGQ

SEQ ID NO: 952 - protein, 120 aa, Oryza sativa
MSAQAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLESHLVPSST

SEQ ID NO: 953 - protein, 249 aa, Zea mays
MTETREINVFMAKLAEQAERYDEMVEAMKNVADLGQELTVEERNLLSVAYKNVIGARRASWRIITSIEQKEESKGNTAHVERIKEYRKKVENEVSKICADVLGTLDNKLIPNAQTTESKVFYYKMKGDYHRYLAEFATSEARKEAADNSLAAYKSATDIANSELAPTHPIRLGLALNASVFYYEIMGSPKQACELARKAFDDAIAELDQLNEESYKDSTLIMQLLRDNLTLWTSDLEGDKADAEPEAAN

SEQ ID NO: 954 - protein, 116 aa, Zea mays
MTETREINVFMAKLAEQAERYDEMVEAMKNVADLGQELTVEERNLLSVAYKNVIGARRASWRIITSIEQKEESKGNTAHVERIKEYRKKVENEVSKICADVLGTLDNKLIPNAQTT

SEQ ID NO: 955 - protein, 116 aa, Glycine max
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMRVIDEHLIPSAA

SEQ ID NO: 956 - protein, 257 aa, Oryza sativa
MAPSDDLVYMAKLAEQAERYDEMVEAMNSVAKLDEGLTKEERNLLSVGYKNLIGAKRAAMRIIGSIELKEETKGKESHVRQTAEYRRKVEAEMDKICCDVINIIDKYLIPHSSGAESSVFYYKMKGDYYRYLAEFKTGTEKIEVSELSLNAYETASKTAQTDLTPTDPIRLGLALNISVFYCEIMNSPDKACQLAKNAFDEAVAELPSLSEENYKDSTLIMQLLRDNLALWNSDMADDADDIRERTDTTGAKGDPAA

SEQ ID NO: 957 - protein, 115 aa, Oryza sativa
MAPSDDLVYMAKLAEQAERYDEMVEAMNSVAKLDEGLTKEERNLLSVGYKNLIGAKRAAMRIIGSIELKEETKGKESHVRQTAEYRRKVEAEMDKICCDVINIIDKYLIPHSSGA

SEQ ID NO: 958 - protein, 259 aa, Glycine max
MAAAPSPREENVYMAKLAEQAERYEEMVEFMEKVSAAADNEELTVEERNLLSVAYKNVIGARRASWRIISSIEQKEESRGNEDHVSVIRDYRSKIESELSNICDGILKLLDSRLIPSASSGDSKVFYLKMKGDYHRYLAEFKTGAERKEAAESTLSAYKAAQDIANAELPPTHPIRLGLALNFSVFYYEILNSPDRACNLAKQAFDEAIAELDTLGEESYKDSTLIMQLLRDNLTLWTSDMQDDGADEIKEAAPKQDDQ

SEQ ID NO: 959 - protein, 120 aa, Glycine max
MAAAPSPREENVYMAKLAEQAERYEEMVEFMEKVSAAADNEELTVEERNLLSVAYKNVIGARRASWRIISSIEQKEESRGNEDHVSVIRDYRSKIESELSNICDGILKLLDSRLIPSASS

SEQ ID NO: 960 - protein, 259 aa, Triticum aestivum
MAKAAATREEMVYLAKLAEQAERYEEMVEFMEKVVAAAGTVELTIEERNLLSVAYKNVIGARRASWRIVSSIEQKEEGRGAAGHAAAARGYRALVEAELSNICAGILRLLDERLVPAAAAVDAKVFYLKMKGDYHRYLAEFKSAAERKDAADSTLGAYQAAQDIAMKELPPTHPIRLGLALNFSVFYYEILNSPDRACSLAKQAFDEAIAELDSLGEDSYKDSTLIMQLLRDNLTLWTSDMQDDAGDEMRDSSKPEDEQ

SEQ ID NO: 961 - protein, 119 aa, Triticum aestivum
MAKAAATREEMVYLAKLAEQAERYEEMVEFMEKVVAAAGTVELTIEERNLLSVAYKNVIGARRASWRIVSSIEQKEEGRGAAGHAAAARGYRALVEAELSNICAGILRLLDERLVPAAA

SEQ ID NO: 962 - protein, 266 aa, Zea mays
MSPSEPTREESVYMAKLAEQAERYEEMVEFMERVARSAGGAGGGEELSVEERNLLSVAYKNVIGARRASWRIISSIEQKEEGRGNEAHAASIRTYRSKIETELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKDAAAPKESAEGQ

SEQ ID NO: 963 - protein, 125 aa, Zea mays
MSPSEPTREESVYMAKLAEQAERYEEMVEFMERVARSAGGAGGGEELSVEERNLLSVAYKNVIGARRASWRIISSIEQKEEGRGNEAHAASIRTYRSKIETELARICDGILALLDSHLVPSAGGA

SEQ ID NO: 964 - protein, 867 aa, Oryza sativa
MAGAGAVGGSNWEEMVRRMLPPGTTIPEAPANLDYSIALEYDGPPVSYELPRIDPVDLPAIPTAQPVSGPLVPGRSNGVVAPVVRPVFMPPVHRKQDAHRAEPPPVAAQGRRRRSSESVDSAPQNEGFSDDDDSCSVSQESAHNFHGQRGGRTAAQEGRRAQVVTFGVTEDSRYESKEFDDVSEQYVAVTKKEKRGRTCSRCGKRKWESKESCIVCDARFCSYCVLRAMGSMPEGRKCITCIGQPIDESKRSKLGKGSRILSRLLSPLEVRQILKAEKECQANQLRPEQLIINGFPLNPDEMASLLSCQRPPQKLKPGRYWYDKESGLWGKEGEKPDRVVSTNLTFNGKLQPNASNGNTQVYMNGREITKIELRVLKIAQVQCPRDTHFWVYHDGGYEEEGQNNIKGKIWESPVTRFACALFSLPVPPANSDEPKDEAPYSARTVPDYLDQKRIQKLLILGSPGAGTSTIFKQAKLLYDTRFTQEELDSIKLMIQSNMFKYLGILLEGRERFEEEALAGSNNPSSEDENTQHDGNKSNGSDSCIYSINAKLKKFSDWLLDIIAMGDLDAFFPAATREYAPIVEEMWKDPAIQATYKRKDELHFLPDVAEYFLSRAIEVSSNEYEPSEKDIIYAEGVTQGNGLAFIEFTLDDRSPMSEMYTDNHEPHSQTLNKYQLIRVSAKGMNEGCKWVEMFEDVSMVIFSVALSDYDQLGAPSSGGNSPLVNKMIQSRDLFEATIRQPCFRDMPFVLVLNKFDLFEEKIGRVPLSTCEWFSDFCPLRTHHNNQSLAHQAFYYVAMKFKELYAACTDRKLFVWQARARDRLTVDEAFKFIREVLKWEDEKDGGGYYPDESFYSTTELSSSRLIRQE

SEQ ID NO: 965 - protein, 372 aa, Saccharomyces cerevisiae
MKCRVWSEARVYTNINKQRTEEYWDYENTVIDWSTNTKDYEIENKVGRGKYSEVFQGVKLDSKVKIVIKMLKPVKKKKIKREIKILTDLSNEKVPPTTLPFQKDQYYTNQKEDVLKFIRPYIFDQPHNGHANIIHLFDIIKDPISKTPALVFEYVDNVDFRILYPKLTDLEIRFYMFELLKALDYCHSMGIMHRDVKPHNVMIDHKNKKLRLIDWGLAEFYHVNMEYNVRVASRFFKGPELLVDYRMYDYSLDLWSFGTMLASMIFKREPFFHGTSNTDQLVKIVKVLGTSDFEKYLLKYEITLPREFYDMDQYIRKPWHRFINDGNKHLSGNDEIIDLIDNLLRYDHQERLTAKEAMGHPWFAPIREQIEK

SEQ ID NO: 966 - protein, 408 aa, Oryza sativa
MAWCAARSRLLPLATAPQLLRRLLLSSAAAPRYAHPHHHHSNSRRRRRPLAPTVYAAAAAAAAEAPLPMPPRIGRATRHPGGAASVARVYADANSQRPKEYWDYESLDIEWGEQDGYEVLRKLGRGKYSEVFEGFRPGGDERCVIKILKPVKKKKIKREIKILQNLYGGPNIVKLLDVVRDDESKTPSLIFEYVNNTDFKVLYPTLLDYDIRYYIYELLKALDYCHSRGIMHRDVKPHNIMIDHEKRQLCLIDWGLAEFYHPKMEYNARVASRSYKGPELLVDLLDYDYSLDLWSLGCMFAAMIFRVDPFFNGQDNYDQLVKITEVLGTEDFYNYLEKYGLELDPQLERLVGRHNRKPWSMFVNSGNRHLASPEAIDFVDRLLRYDHQERPTAKEAMAHPYFNPVRST

SEQ ID NO: 967 - protein, 333 aa, Glycine max
MSKARVYTDVNVLRPKEYWDYESLTLQWGDQDDYEVVRKVGRGKYSEVFEGINVNSNERCIIKILKPVKKKKIKREIKILQNICGGPNIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDELNAYLNKYHLELDPQLDALVGRHSRKPWSKFINADNQHLVSPEAIDFLDKLLRYDHQDRLTAREAMAHPYFSQVRAAESSRMRTQ

SEQ ID NO: 968 - protein, 280 aa, Oryza sativa
MSGAYRDRGFGGAAAEMDRKRIKDVLEKHLDRSSPSTSRGAAVAKERDRLAAAGGKLPAPLGKAGKVSDGAEEFETDSEDSDVSGSEGEDTSWISWFCSLRGNEFFCEIDDDYIQDDFNLCGLSNQVPYYDYALDLILDIESSNGDVFTEEQNELIESSAEMLYGLIHARYILTSKGLAAMLEKFKNYDFGRCPRVYCCGQPCLPAGQSDIPRSSTVKIYCPKCEDLHYPRSKYQGNIDGAYFGTTFPHLFLMTYPHLKPQKPSQQYVPKVFGFKLHKQS

SEQ ID NO: 969 - protein, 278 aa, Saccharomyces cerevisiae
MSQEFVEDYSRTGSSDDEDSGAYDEWIPSFCSRFGHEYFCQVPTEFIEDDFNMTSLSQEVPHYRKALDLILDLEAMSDEEEDEDDVVEEDEVDQEMQSNDGHDEGKRRNKSPVVNKSIIEHAAEQLYGLIHARFILTKPGLQAMAEKFDHKEFGTCPRYYCNGMQLLPCGLSDTVGKHTVRLYCPSCQDLYLPQSSRFLCLEGAFWGTSFPGVFLKHFKELEEYVERKSKESYELKVFGFRINDEAVSGPRMKWLRQYPSTEEDWEEFAKCEFETPAV

SEQ ID NO: 970 - protein, 275 aa, Zea mays
MHRDRGVSAAAIPGDRKRIGEPMDRSSPSTSWGFSGGREKERIGVGKQPEMPRSGGGSTAMSKSKLSDESETDSEESDVSGSDGEDTSWISWFCSLKGNEFFCEVDDDYIQDDFNLCGLSNQVPYYDYALDLILDVESSHGDMLTEEQNELIESAAEMLYGLIHVRYIITSKGLSAMLDKYRNVEFGRCPRVNCSGQPCLPVGQSDVPRSSTVKIYCPRCEDIYTPRSKYLSNIDGTYFGTTFPHLFLMTYPHLKPQKPLQQYVPRVFGFKIRKP

SEQ ID NO: 971 - protein, 272 aa, Zea mays; identical to SEQ ID NO: 752

SEQ ID NO: 972 - protein, 155 aa, Zea mays
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGYGGGGGYGGGGGGYGGGNRGGGYGNSDGNWRN

SEQ ID NO: 973 - protein, 205 aa, Zea mays
MADVDEYRCFIGNLSWSTTDESLKDAFSKFGNLTEAKVVLDKFSGRSRGFGFVTFDEKQAMEDAIEGMNGLDLDGRNITVDKAQPQGPGRDRNGDRDYDRERGSRYERGRDYGGGRAPRGGGGGGGGGDCFKCGKPGHFARECPSGDGGRGDRYGGRDDRYGGGGGGGGGRYGSDRGGDRYSGRSRDGGSYGGGDRYSRDRSGPY

SEQ ID NO: 974 - protein, 156 aa, Zea mays
MAAFNKLGGLLRHSALVSGITGGSSPAVFNAARLMSTKLFIGGLDWGVDDVKLREAFSSFGEVTEARVITDRETGRSRGFGFVNYSDSDAAKEAISAMDGKEIDGRQVRVNMANERPAGNRGGGGYGGGGYGGGGYGGGGGYGGGGYGGGSQSYDA

SEQ ID NO: 975 - protein, 133 aa, Zea mays
MMLANKLGGLLKNATSSNMSVYQAIRCMSSSKLFVGGLSYGTDDHSLRDEFAKYGQVIEAKIILDRESGRSRGFGFITYTSSEEASAAITAMDGKTLDGRNIRVNHANERTGGFRSSGGYGGGLFKMAQGFLK

SEQ ID NO: 976 - protein, 348 aa, Saccharomyces cerevisiae
MSKTAVKDSATEKTKLSESEQHYFNSYDHYGIHEEMLQDTVRTLSYRNAIIQNKDLFKDKIVLDVGCGTGILSMFAAKHGAKHVIGVDMSSIIEMAKELVELNGFSDKITLLRGKLEDVHLPFPKVDIIISEWMGYFLLYESMMDTVLYARDHYLVEGGLIFPDKCSIHLAGLEDSQYKDEKLNYWQDVYGFDYSPFVPLVLHEPIVDTVERNNVNTTSDKLIEFDLNTVKISDLAFKSNFKLTAKRQDMINGIVTWFDIVFPAPKGKRPVEFSTGPHAPYTHWKQTIFYFPDDLDAETGDTIEGELVCSPNEKNNRDLNIKISYKFESNGIDGNSRSRKNEGSYLMH

SEQ ID NO: 977 - protein, 425 aa, Zea mays
MLPSHLNGHSALGRRRPRLSAAAGESPAAAGVEAAAPLEEHDRIYFQAYSHLGIHETMIKDRVRTDAYHAAIMRHQKFIEGKVVLDVGCGTGILSVFCARAGAKRVYAVEACEIVVQAREIVKANNLTDQIVVIHGRVEDVDLEEKVDVIISEWMGYMLLYESMLPSVLFARDKWLKPGGLILPSHATLFMAPVTNRERYEDSVDFWRDVYGINMSALVPLAKKFTSEEPSIETIGGENVISWPSVFKRFDCYNFTAEEFKSITSKYKVSSMMLAPIHGFGFWFEVEFNEPIESSHNFPSSLDPLEIIQKKRRRSSEDIVLSTAPEDEPTHWQQTILYFPDPIEVKQDQIIEGSVTVSQSEENPRFLNIHLECFTGGQTLVKDCAMPMNWCFYASSGLISGAQWGVGREELTIFQISLMEVENLY

SEQ ID NO: 978 - protein, 377 aa, Zea mays
MASLPNGGGAAASGSCGARPVDKEVDFANYFCTYAYLYHQKEMLCDRVRMDAYHSAVFRNAPHFQGKVVLDVGTGSGILAIWSAQAGARKVYAVEATNMAEHARELARANGVTDIVEVIQGTVEDVDLPEKVDVIISEWMGYFLLRESMFDSVICARDRWLKPDGVMYPSHARMWLAPIRTGLGDKKREDFDIAMDDWSLFVQDTQTYYGVNMNALTKAYRAEHEKYYLKSSIWNNLHPNQVIGQPAAIKEIDCLTATVDEIREVRAQVTLPIRMEARLSALAGWFDVHFRGSAQNPGVEEVELTTAPDEHGGTHWGQQVFLLTPPLSVTKGDNVNVSFSMVRSKENHRLMDMEFTYELHELSGRKHPAVKTKMYLE

SEQ ID NO: 979 - protein, 157 aa, Zea mays; identical to SEQ ID NO: 631

SEQ ID NO: 980 - protein, 371 aa, Zea mays
MDEGQGVRYWCHMCQEVIDPMPEMKCPGCEGGFVEEMDSEDFEPAANARSDRSVSLLAPLLLGMMGGSSRRSRLRREAMVEADADQDDEEDDSDHELELSRRRRRRRRSSALFSVLEAMRDRDEVRGSDDTDSDTERDLERGRRERMERQRERLRQIERVSARGRERTESLILINSNNEAIILQGTFGSDDNQEDSSNTSSGVSLGDYFLGPALDTLLQRLAESDLSRSGTPPAKKEAVAALPTVNIEEALGCSVCLEDFEMGGEAKQMPCQHKFHSHCILPWLELHSSCPICRFQLPTEETKNNPCESASTAGTVNGGGDNAAASGSDTESTNHNEDDHSDSPIFSALSTLFSDPFSSDDDESVPHSYEN

SEQ ID NO: 981 - protein, 325 aa, Zea mays
MSNRATHWCYACRRPIRLRGQDIVCPNCNDGFIQEISEMGGILNTYGLIEPDFEERRARRFGMMDAMSSLMRQRMEEMGRDGLFDIRGRQGTGTEYGRRPTAVPTLVFGGIPSPGVDSGDVNVVLRGGRRVGAAQPNFSSLVVGPSLEALFEQLLLQNNRQGPAPAPQSAIDSMPVVKINRRHLDDDPQCAVCKDKFEVGAEAREMPCKHLYHTDCIIPWLVQHNSCPVCRHPLPSQRSGSTSSARPSAYYNEAADPPGVTRADLEPAPRDGGRESQERRRSFSFLWPFGPSSSRSSSYQYEQNVDEPAVYDPNQIAYSEWHYDH

SEQ ID NO: 982 - protein, 358 aa, Zea mays
MHISLFNHSALLTPFVSVQAGRIWRMTEAAVTRYWCHGCVRVVEEAMGEEIKCPFCGGGFIEEMIGEEFDGLASQQSERDSSQWGASNNPFEQPRAEADSEDEEDDDDYDDDIGRAFESFIRRHGRPSALRRAFDSIQDDLRADRDSDFSILINAFNQALALQRSVLDADEARDDQGGSSNDDGLMEEYVLGAGLTLLLQYLTENDPSQYGTPPANKEAVDALPTVQIAEAVSCSVCLDDLELGSQAKQMPCEHKFHSPCILPWLELHSSCPVCRFELPSEETEDLDEPSNVDRTENTHEEVRADGPEDDSESSNRAWALVPWFSGLFSTPEPQTVRGAFTDQQTRSTSGTNMNAGES

SEQ ID NO: 983 - protein, 348 aa, Zea mays
MAEQAGAGRYWCHMCAAAVSPAEGEVEMKCPFCHSGFLEEMETARGAATDDGDGDGDGAVAQVHPGADRPSSIWAHAILSTVDSSARRRRNRRQQEAASDVYDWNDPEFSLRRRRVTAFLRLLHELRDRQLQRLESAAGVALEGDQLTPFGRSLFIGAAGGEHGVALGDYFLGPSLDALVQQLAENDAARHGTPPAKKEAVEAMPTVEIAGGNDGDDAASCPVCLEDYAAGERAREMPCRHRFHGNCIVPWLEMHSSCPVCRFQLPATDDKSSCSGGDGGFVSVDADREGSDNGGGDGRASSPGNAELAEAEESGRRLPPSLQWLNSLFSPSAQSSGSGGSSSHHWEN

SEQ ID NO: 984 - protein, 211 aa, Zea mays
MVLMAGMLPGVECARRRRVRQGGAGMGAEAAGGGTGRRSSFCLYAAGHGGAGNSGKRSGGVVHGHGWTLDSNAREAKERLDQKLRTKREAAIKRHHSTGSIKLGVPHRSAGADERGESSAPAMAGVQREVYSKKGVMRRLMRWSRPRWAAAEQAECAVCLDEFRAGDVLAHLRCGHRFHWACALPWLEGTSRCPFCRAAVDAGAAAAADGA

SEQ ID NO: 985 - protein, 280 aa, Zea mays
MSFVFRGSRTDIEAGGFPGFAPERRAMRIHAGSRPVNSNSLAFLLTVLVLFMVLNSHQISPNLLLWLVLGVFLMATSLRMYATCQQLAHAAAANSFLGHTELRVHVPPSITLATRGRLQSLRLQLALLDREFDDLDYDTLRALDADNSPHAPSMSEEEINSLPVFKYKVQAQQRHPPARKSDGPSQLSVSSTGSGNEEKQDGLKADGTSKPSEDELTCSVCLEQVTVGDLLRSLPCLHQFHVNCIDPWLRQQGTCPICKHQVSDGWHATGNGEEDASYMV

SEQ ID NO: 986 - protein, 155 aa, Zea mays
MGISSMPEPRDSLLGYLVYNTVISIAALAGLVRAALVFLDLQAALPPGDDGGDQLAASGPGLAERFLRAFRPALYEVLASTATTCEADGGGDDCSVCLAGFRARAVVNRLPCGHLFHRACLETWLRYERATCPLCRAHVPLPADETPLLRYPEFE

SEQ ID NO: 987 - protein, 249 aa, Zea mays
MDPSGGAFLPPLQQGSSSFPRSSSNASLARSGSGGGGVGAGRGTRGRKMMRRVCRGVITFIFAIAGLFLGAVTGGLIGLATESGLFRGTGIGAITGALVSIEVVDSSIRLWQARRSGIWSILYVLNVIYSLLTGRLVREKVDPAVQRVVRSQMNAVDSSPFRESPDLFEVEATNGMPRASIDKLPESWITEEYRRDAVGDLSGCSVCLQDFQVGEKVRSLPDCWHVFHVPCIDGWLIKHGSCPLCRRKL

SEQ ID NO: 988 - protein, 184 aa, Zea mays
MAMATQGQADQQQQHGRSEPTTSVAANRWGPYSGAGDFASNMAVILAALLAALALGLALNAAVRYLLRRSRRAGSVGGQGNGSGVLMPSDDPAEKPSVEVELQAPPPALLVYSAAGTTLAGAAAECAICLAEFADGDAVRVMPACGHGFHARCIERWLAEGRRSSCPTCRAPAVQRSLHASELL

SEQ ID NO: 989 - protein, 514 aa, Zea mays
MASPRGRMSFPLRSFLMICLMAQLGASNVVLMANNTTLSFDDVEAIFTPAVKGSGVNGVLYAVEPMDACSPLRTKAIGGSVSTFALVIRGGCHFDDKVRNAQNAGFKAAVVYDTEDNGILVSMAGSSSGVHIYAVFVSKASGEELKKYSGQTDAELWIIPTYANSAWSIMAISFISLLVMSAILAACFFARRHQIRRDRARLPQTREFHGMNSRLVKAMPSLIFTKVQEDDCTSATCAICLEDYSAGEKIRVLPCRHKFHAACVDLWLTSWRTFCPVCKRDANAGTPEPPVSESTPLLSSSAIRLPEPTASVSFWSTVAAAAAASPPRPISRHPSPSRSISRKHSVSGSSIPGTPIPRFHASSSSPTCTSGSSLDLANMPSSPWPRASHLASAHSSCGGRLSPPIHIRNTSAAHVSRSAYGSPSRYVGSSHMSRGSPSCYYLGSSSGQQHPYLRHCTLSGTSLFTMVPQSPQQNQLQHGGDSEKDLSAAAPFRQLYYLQHCPDSGTSSQSLPGC

SEQ ID NO: 990 - protein, 146 aa, Zea mays
MGISSMPAPEDSLLGFVLYNTAASVAILAGLVRAALLFLGLAAAAEDEEPRQQAEAVTVTAVGPSLADRFRSRFRPSRYGRRRGGDCRVCLVRFETESVVQRLPCGHLFHRACLETWIDYDHATCPLCRHRLLPPAAAADEVPRIA

SEQ ID NO: 991 - protein, 655 aa, Zea mays
MQGQRNSVEHFADVFGFDIASSSGNPVMDQQSYWNNVLGSVESQNLQGYQMNHSDAAMPYGNETQQDGTFLGFWESGEASASGSSNNAKTEHLSIGGGLRIGERRLVADNGISLDVDINLNANVNDLCGQSSNVNCTSQGPEHYGGGDRSVVNSQPTDLRLHPYRTFLLDAEQADSFTLNPSENPLCDFSLMQESIDQRPGSSLDGRRLACKRKNVEGPNGQSSAGASTSFSHRNDNAFHNIASSSYNPAPIRNPSSPNCLPVPSSIDDQLPRYGTNAGLSAGTYDLNGGVNNAGNSQRSFRARITTSQQIAPCSVWPSSNAIRLPNSWNHQPPHFQSAFDDTQEVIPVVSSLNLQYQHPVNVSSVPPAANRFTGHGASSSRAGSLENRILGSQEAPTRNVVPANYSDLVPPSVVDPRRLLPEPSNWSSDVRGTAISGSIPPVSRANNSATVNPPAGFSHQNLTRRHPRNLSEEIGRLSGALRGHQPPRLRPGFLLERQGDGVWGVPLSTRGREGRRLMEIRNALEMIHRGENVRLESIFYGGVDIHDRHRDMRLDIDNMSYEELLALEERIGNVGTGLSEEAVIRLLKQRKFSSWTLKASLDPEPCCICQEEYADGDDLGRLDCGHDFHAGCIKQWLVVKNVCPICKSTALKKT

SEQ ID NO: 992 - protein, 520 aa, Zea mays
MAFRNMVCTPQVINLTSDSERGQAQGGNGSEISEQGAQHAVRVVGNAMNIGLSGVRSYYDMSINHHHQSVHNPPPNLGVDSGFVFASNMYNPCMSSTSMNRHVSHAQSFGSGNQVLPQNQVPGTMDESSRNDSIGESAREHIKRKNAAVAGSYHFVNGFASSSSSSHAPQNPMLGPWDPSFESTVSSNVAPFNPSEYHGHNNSWPSLEGSSITGSNGFNSMVVHPDSVQRGNYTFPPTHISHSWMSHATNGIADGVPQWEYANATANIQGRFAHSGATEIANVGFHEYQNGPSTICRGPVPYFHQHAMHGMQALDPTQMQVPYQQCHSNGFLHGGINYPGNRLQLGPRNPVLFTSSERAFGPPQHPFLANPVNHRNIRILPPEHATIMDFSRLYEVSNTVDEHRDMRLDIDSMTYEELLALEEQIGDVNTGLTKSHIVDKLRTSLYVPGISSMSDQPSKSSLENDACIICQEEYQARDCVGTLDCGHRYHAECVKQWLMVKNLCPICKTTALSANRRQGQ

SEQ ID NO: 993 - protein, 205 aa, Zea mays
MGSLLCCMGCSEDVSAAPPVSCLCLLWPFHYYHNLNSGSAACHRCDTRVAPDGGRSPPANQVDSLDTLGLPPRPLPYDDPQSSPRMVQHPLVSGHDKAPTHVQKLGQPAETKNTHTGSTCTAHKVSASSPKQHSEGSRMDDGVQFCDSSDSEDDCPVCLEEYDYENPKIALQCKHNFHLSCIYEWMERSQACPVCAKTMLFNEDE

SEQ ID NO: 994 - protein, 171 aa, Zea mays
MGGCCCCSSRTSEAVRARAPVDIYHQQNLEEQEPLSSIFDGSSPASAIVAVDTNLDTSTPDTYRAPPAPLPYDVILAVPNNPGLEKPDTKSKTDDQQESINDQESLKVDESCKKSVTEDKADEEDVCPICLEEYDEENPRSITKCEHHFHLCCILEWMERKDTCPVCDQVW

SEQ ID NO: 995 - protein, 396 aa, Zea mays
MASVTDETAKIEGLTSAAAFVEGGIQDACDDACSICLEAFCESDPSALTGCKHEFHLQCILEWCQRSSQCPMCWQPITMKDPTSQELLEAVERERNIRTNQTRNTTIFHHPALGDFELQHLPVGNDAELEERILQHLAAAAAMGRAHHLGRREGHRGRSGSHGRPHFLVFSTQPNSPSAGTISSSSAHMEGENDSNPATPRASESSPRAIRIGEVGNQSPGMLTYDAEQDAVVSSGNSTPVSSPRFFNRRHSTGQSTPDRAGPSDIQSFSDSLKSRLNAVSMKYKESITKSTRGWKERLFSRNSSVADLGSEVRREVNAGIASVSRMMERLETRGNSRTSDSPAASTSEVPPATESSNERVTESNSAAAAGGGGTTTTGTSASNASAPCVATSGSN

SEQ ID NO: 996 - protein, 168 aa, Zea mays
MAEKKMVTLRSSDHEEFEVEEAVAMKSEIIRLLIEDDCADNAIPLPNVDSKTLALVIEYCNKHVHAAAADDSAAAETSNASSAAGGGDVDLKKWDAEFVKVEQATLFDLILAANYLDIKGLLDLTCQTVADMMKGKSPEEIRRTFNIKNDFTEEEEEEIRRENSWAFD

SEQ ID NO: 997 - protein, 334 aa, Zea mays
MSESELAVIKPEALKTYIWLQCFDGSIQQVEEEVAMFCPMICREIVKNGTGSSKNHAIALPERVNPASLSLILDYCRFHQVTGRSNKERKSFDEKFVRIETERLCELTSAADSLQLKPLVDLTSRALARIIEGKTPEEIRDIFHLPDDLTEEEKLEPLKNVNDDPRIRLLNRLYAKKRKELQERQKLKDVQVQKEEKDERSLDELLCFINGDGGSGGGESSTKSKKKNKRRKDHAKNPAKADSESVNVEGAACVVPCKVDSSNVSRLPCQSPDMQDDVEYPFEDADLDDGLDPAMKEELDREVEDFARRLNSVWSESHIGGNGSVQRFPGFNHR

SEQ ID NO: 998 - protein, 176 aa, Zea mays
MAAEGEKKMITLKSSDGEEFEVEEAVAMESQTIRHMIEDDCADNGIPLPNVNSKILSKVIEYCNKHVHAAAAAAAASKAGSDDVGAAAANSTAASGEDLKNWDADFVKVDQATLFDLILAANYLNIKGLLDLTCQTVADMIKGKTPEEIRKTFNIKNDFTPEEEEEIRRENQWAFE

SEQ ID NO: 999 - protein, 599 aa, Zea mays
MGGEAPEPRRLTRALSIGGGGGGWVPDEMLQLVLGFVEDPRDREAASLVCRRWHRVDALSRKHVTVPFCYAVSPARLLARFPRLESLAVKGKPRAAMYGLIPDDWGAYARPWVTELAAPFECLKALHLRRMVVTDDDLAELIRARGHMLQELKLDKCTGFSTDGLRLVARSCSSLRTLFLEECQINDKGSEWIRDLAVNCPVLATLNFHMTELEVMPVDLELLAKSCKSLISLKIGDCDLSDLIGFFQSATSLEEFAGGTFNGQGELTKYGDVKFPSRICSLGLTFMGASEMPIIFPFAAILKKLDLQYTFLTTEDHCQLIAKCPNLLVLAVRNVIGDRGLGVVADTCKKLQRLRIERGDDEGGVQEEQGGVSQVGLTAIAVGCRELEYIAAYVSDITNGALESIGTFCKKLYDFRLVLLDREERITDLPLDNGVRALLRGCTMLRRFALYLRPGGLSDAGLGYIGQCSGNIQYMLLGNVGETDDGLISFALGCVNLRKLELRSCCFSERALALAILSMPSLRYVWVQGYKASQTGRDLMLMARPFWNIEFTPPSSQNAGRLIEDGEPCVDSHAQILAYGSLAGKRLDCPQSVVTLYPA

SEQ ID NO: 1000 - protein, 590 aa, Zea mays; identical to SEQ ID NO: 728

SEQ ID NO: 1001 - protein, 573 aa, Zea mays
MAYFPDEVVGYILGYVTSHQDRNAVSLVCRAWYDIERHGRHSVLVRNCYAVCPERVHMRFPNMRALSLKGKPHFAEFNLVPAGWGATANPWVDACARACPGLEELRLKFMVVTDECLKLLSLSFTNFKSLVLVCCEGFSTTGLANIATNCRFLKELDLQKSCVKHQDHQWINCFPKSSTSLECLNFSCLTGEVNAVALEELVARSPNLKSLRLNLAVPFDVLSRILSRTPKLEDLGTGSFLQGNDPAAYASLCRALENCTSLKSISGFWDAPGFYVQGILSNCKIRNLTCLNLSYATLIQSTQLIGIIRHCKKLHVLWVLDHIGDEGLKAVSFSCPDLQELRVYPSVVAPRGTVTEEGLVALSSCRKLQRVLFSCVRMTNTALMTIARYCPRLTSFRLCIRKPRSADAVTGQPLDEGFGAIVRSCRGLRRLAMSGLLTDSVFLYIGMYAEKLEMLSVTFAGDTDDGMVYVLNGCRNLKKLVIKESPFGDAALLAGAHRYESMRSLWMSSCQITLGGCKALAATMPNINVEVIGGASFGAMDGGVSGARKVDMLYLYRTLAGPRCDTPGFVSIL

SEQ ID NO: 1002 - protein, 596 aa, Zea mays
MGGEVPEPRRLSRSLSFGCGGVPEEALHLVLGYVDDPRDREAASLVCRRWHRIDALSRKHVTVGFCYAVEPARLLARFRRLESLALKGRPRAAMYGLIPEDFGAYAAPWVAELAAPLDCLKALHLRRMTVTDEDIAVLVRARGHMLQVLKLDKCSGFSTDALRLVARSCRSLRTLFLEECIIADEGSEWLHELAVNNSVLVTLNFYMTELKVEPADLELLARNCKSLISLKMSDCDLSDLIGFLQTSKALQEFAGGAFFEVGEYTKYEKVKLPPRLCFLGGLTFMGKNEMPVIFPYSASLKKLDLQYTFLTTEDHCQLIAKCPNLLVLEVRNVIGDRGLEVVADTCKKLRRLRIERGDDDPGQEEQGGVSQIGLTAVAVGCRELEYIAAYVSDITNGALESIGTFCKNMYDFRLVLLDKQNKITDLPLDNGVRALLRSCTKLRRFALYLRPGGLSDAGLGYVGQYSGNIQYMLLGNVGESDNGLIRFAMGCANLRKLELRGCCFSERALAVAVLQMPSLRYVWVQGYRASQTGRDLMLMARPYWNIEFVPPRPESACRVMADGQPCVDTHAQVLAYYSLAGRRPDCPRWLVTLHPA

SEQ ID NO: 1003 - protein, 235 aa, Zea mays
MPSQSTHTSSSLSSSTTPILPCSSAAALFRSVMAAVATETPFHVLAVDDSLPDRKLIERLLKTSSFQVTTVDSGSKALQFLGLHDQDSTVPPVHTHQLDVAANQDVAVNLIITDYCMPGMTGYDLLKKIKESSSLRDIPVVIMSSENIPSRINRCLEEGADEFFLKPVRLSDMNKLKPHILKSRCNQEQHQQSDSHSGERRNPTISSSDSINNRKRKGAGTEEILPQLANRSRHS

SEQ ID NO: 1004 - protein, 293 aa, Zea mays
MGGAQFPGDNDVAEVDAARDGEVDRRDVGKMKHGCEHYRRRCKIVAPCCNQVFPCRHCHNEATASGDRHTICRQDVEKVVCLLCETKQPVSQVCISCGVNMGEYFCDICKFYDDDTDKGQYHCIDCGICRVGGKENFFHCVKCGSCYSVILRDNHQCVENSMRQNCPICYEYLFDSLQGTRVLNCGHTMHLTCFEEMVAHNKYTCPICSKTALDLTHHWEMLDQEIEATIMPLVYRYKIWVLCNDCNKVSEVNFHVIGHKCSHCRSYNTRTTSRPADLSGSSSPSTDSSDNNI

SEQ ID NO: 1005 - protein, 300 aa, Zea mays
MGALDLHLDFASAQHGQAKLKEYAKSSLLSDGNYNTDKINGSNPDDYEKFEKGIMHYGCPHYRRRCRIRAPCCNEIFDCRHCHNETKNSIKIDKMKRHELPRHEVQQVVCSLCGTEQEVRQVCINCGVCMGKYFCGLCKLFDDDVSKQQYHCNGCGICRIGGRENFFHCSKCGCCYSIALKNSHACVEGAMHHDCPICFEYLFDSTNDVSVLPCGHTIHVKCLKEMEEHCQFACPLCSKSVCDMSKAWERLDMELATLSDSCDHKMVRILCNDCGAISDVQFHLIAHKCQNCKSYNTRQI

SEQ ID NO: 1006 - protein, 252 aa, Zea mays
MISPDTIRTAIGVIGNGTALVLFLSPVPTFIRIWKKGSVEQYSPIPYVATLLNCMMWVLYGLPAVHPHSMLVITINGTGMAIQLTYVALFLLYSVGAARRKVVLLLAAEVGFVGAVAALVLSLAHTHERRSMVVGILCVLFGTGMYAAPLSVMKMVIQTKSVEYMPLFLSLASLVNGICWTAYALIRFDLYITIPNGLGVLFAVAQLVLYAIYYKSTQEIIEARKRKADQIAMTGVVVDGGKTNNQAGAGQY

SEQ ID NO: 1007 - protein, 306 aa, Zea mays
MPQRHSKNNNDLAFFTYEEKRKLGYGTQRERLGKDSIKPFDACCLCLKPLIGPLCCPKGHTFCKECILECLLSQKKDIKRKLAAHEAQKKQEKEEEEEKLILQKAKELDAFDQQNHGAVPQYHDRSGSQYKNGFHGANSVKVTSFEEEALRNMKAFWLPSATPEATVKVDLPSTDTVCPEGQEKLKLKSLFPISFTEETADQKSSKAGNSCSYMCPSCKSTLTNTMSLVAVSTCGHVFCKKCSDKFLVKDKACLECSKPFRERNLVPLEKGGTGFAAHDERLEARDFKYLGSGSGLGLVKPAPKTY

SEQ ID NO: 1008 - protein, 262 aa, Zea mays
MDSGYNPRTVEEVFRDFKGRRAGIIRALTTDAEDFFKQCDPEKENLCLYGFPNESWEVNLPAEEVPPDLPEPALGINFARDGMQEKEWLSMVAAHSDAWLLSVAFYFGARFGFNKNDRKRLYSLIDDLPMAFEIVSGKSETKAPAPPSSSNHSNIKPKSNNKKKPPEPKVKQPKPRAPAEEGEEEDGSASEDEHGETLCGACKESYGPDEFWICCDLCEKWFHGKCVKITAAKAEHIKQYKCPSCTGGGGVSNSGTKRARPS

SEQ ID NO: 1009 - protein, 314 aa, Zea mays
MGAVASSAGGARGGDGTVLGDLPENCVAEVLLRLDPLEICRMARLSRTFRGAASGDGVWESKLPRNYARLLAVAAAGDGEGGQAAASAPGAELLPKKELYARLCRRNRFDGGKKEFWLDKGGGGLCMSISSRALSITGIDDRRYWNFIPSDESRFRTVAYLSQIWWFEVRGEVEFFFPEGTYSLFYRIHLGRPFKRLGRRVYSSEHVHGWDMKPVRFQMSTSDGQHVQSKCYLSDPGIWINHHVGDFVVKDSSRPVNIRFAMIQIDCTHTKGGLCVDSVVVKPQHLSQKKSALDLRVDSSNKLLLLSREEGYDP

SEQ ID NO: 1010 - protein, 296 aa, Zea mays
MGAWVSVLLGMDGAAAAGPAAVGLGDLPELCAAQVLLRLDPPEICRLAQVNHAFRGAAGADFVWEAKLPENYNYLMEFVGSGDEGKRRRRRAGKKEIYARLARPVPFGDGKKEFWLDKNKGMICMALSSKALVITGIDDRRYWQHMPTSESRFQSVAYLQQIWWFEVVGEVDFCFPVGTYSLYFRVHLGKFYRRFGRRQCTSEHVHGWDKKPVRFQLSTSDGQQALSQCYLEEPGSWVLYHAGDFVASKPDQLMKLKFSMAQIDCTHTKGGLCIDSVLIYPKGKGFHQERVVRSQK

SEQ ID NO: 1011 - protein, 353 aa, Zea mays
MIECTMPSTLLDDLPNEVALQCLARVPFLFHPTLQLVCRSWRASVCSGELLKIRNQIGTTEELLCVLAFEPENMWQLYDPLRDKWITLPVMPSQIRNIARFGVASVAGKLYVIGGGSDRVDPLTGDHDRIFASNEVWSYDPLHRVWSQRAPMLVARAMFACCALDGKIIVAGGFTNCRKSISKAEIYDPEAGIWEPLPDLRLAHSSACTGLVIKGKMHVLHKGLSTVQILEDGGSHWAVEDFSWLQGPMAMVGGELYVLSNSCIMKQRGENFPDKMVSCASEFQSRIGFGMIGVGDNIYLVGGVIGPGPRNQCIKLLSDVDILNVTSERPTWRPGSPMTHCRGSICGCALLRI

SEQ ID NO: 1012 - protein, 437 aa, Zea mays
MDAASRPPPPHGAGVRVRAPLVESVSCYCRLDTGLKTVVEARKFVPGAKMCMQPEVKQNKRKSRGSKKERCRTQAPLLPGLPDDLAIACLIRVPRLEQPKLRMVCKRWNRLLSGNYFYSLRKKIGVAEEWVYVFKRDREGKISWYAFDPLHQLWKSLPPVPQEYSEALGFGCAVLSGCYLYLFGGKDPLRGSMRRVVFYNARTNKWHRAPDMMRKRHFFGSCVINNCLYVAGGECEGIQRTLQSAEVYDPNRNRWACVTEMNNGMVPFIGVVYDGKWFLKGLDSHRQVTSEVYLPSSNTWSAIDDEMVTGWRNPSISFNGRLYSADCRDGCKLRVYDENTGTWTRFMDSKHHLGSSRAFEAAALVSLNGKLCVIRNNMSITLVDVSNPTMSVETDSARMWETVVRKGQHRSFVANLWSSIAGRNLKSHIIHCHVLQV

SEQ ID NO: 1013 - protein, 363 aa, Zea mays
MINHHEIVQFGKLYNRDMESAPAHTPLIHGLPDEVALICLARVPRRYHNILRRVSRRWRALLCSEEWHLCRKRNNLDEPWIYVICREAGIKCYVLAPDPPSRCFRIMHVIEPPCSGRKGVTIEALDKKLFLLGGCSSVYDATDEVYCYDASSNRWSSAAPMPTARCYFVSASLKEKLYITDGYGLTDKSPNSWDIYDPATDSWCTHKNPLLTPDIVKFVALGEELVTIHRAAWHRMYFAGVYDPLERTWRGRGNEIALCYSSPTVVVDGTLYMLEQSMGTKLMVWREDAKEWAMLGRLSDKVTRPPCALVAIGRKIHVVGRGLSMVTVDVDTAARVDGFLVTTSVGPLVEEDLTPERCVVITI

SEQ ID NO: 1014 - protein, 283 aa, Zea mays
MAAAAAAASSSSSSEVPIAARTCVSVGEVAVGAVATGSGDRVAADCGVCAICLDRIALQETALVKGCDHAYCVTCILRWASYKENPLCPQCKHPFEFLSVHRSLDGCLHDYLFEESVCLLLRAAWFEPLIVEAHEEALEEEEFLHQQYQYDDDEDDLDEESYYMNRSPSIRIGNRRWGDNGYIRGGRKEARPVNTDVAAGPSRTPKKKEKAASSSASVSVSGSGSGSGSVSKDVAGRRAKRAQKREAADKAAAEKHLKHLQRLGLRKSPEPVVPEEVGPQVNE

SEQ ID NO: 1015 - protein, 84 aa, Zea mays
MKVKILQWHAVASWTWDAQDETCGICRMAFDGCCPDCKFPGDDCPLIWGVCNHAYHLHCILKWVNSQTSTPLCPMCRREWQFKG

SEQ ID NO: 1016 - protein, 122 aa, Zea mays
MSAMETDINAPPPPAPAGEGSSAAGSSSSRKPNKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 1017 - protein, 526 aa, Zea mays; identical to SEQ ID NO: 662

SEQ ID NO: 1018 - protein, 433 aa, Zea mays
MGVGAEPKDQAATAAGVPAEQDEAGGKEDKAAAVSCSICLDAVLAASGERSTARLHCGHEFHLDCIGSAFNAKGVMQCPNCRKIEKGNWLYANGSRSAHDVSMDEWAHDEDLYDVSYSDMPFRFHWCPFGRLTQLPSLFEEGESSPPVTFHDFMGQHVFTEQVAVSAAAGTTNPCPYVAYLHPLTPLTSLSSSHVPDRTMDRPAYHDHWNPMAGPSDVRSMQTMQPADFHHSHWAHVPHSYGQPNSNNEQPGIPFGARAVRVDGDSQRRASVVSPSYFSNGSGSRSRPPNVPPLMPQFMRAHGSISEQYQQNSSSSLFAGAHRSGGMRPAPTPLPENPTFTLFPPGSSGHSSMETDDAGGSRFYAWEGDRFAPYPLMPVDCETSWRTSQQQSHQSTSEPTSAPRRLFGQWLAVGRPSPSPEGSSYRQLHSPRM

SEQ ID NO: 1019 - protein, 446 aa, Zea mays
MGAGAQEDEEEITTVAEGGVGEEEQAAAEGAGEEEQLEQGAGGEGEGGEEKAPAVMLCSICLDTVVAGGEERSTARLQCGHEFHLDCIGSAFNAKGIMQCPNCRTIEMGNWLYANGSRSSQDVNNDEWGYDDLYDHGHSELATFVPLRIQWCPIGRLELPSLFEEGESPAPATFNDFTGQFNSEPMVPVPATPHPGPYLAYFQPAPTPVSSSSLVAERTMDGAAYHDHWNTLAGLSDGRRPWAYYPQPNSDNGIAEQQGLPLGAMAVGGVDSESQQRGSLSLFYGNGSGRPRIPGVPPMAPQFTRAHGNINDQFQQTASLFAGSQQSGGMRPLGAVGPSVPPPPENTSFCLFPPASSVPSTMEAEDVNRANQFYAWERDRLAPYPLMPVNSEGTWWSSSQQQPPPEPAASASRRLSGQWIGRLPLPPPENRSPDGSSFRPLHIPRM

SEQ ID NO: 1020 - protein, 273 aa, Oryza sativa
MSPAADSAASKRQAELLKQEGNAFFKKDRISAAIDAYTGAIALCPKVAVYWTNRALCYKRRNEWVRAEEDCRTAIQLDSHSVKAHYMLGLALLNKDELAEGIKELEKSLELGRGAHPASYMVEEIWQELSKAKYIEWENLSSERVRQLHKLKEACKEALRNYNSLDNPPAYVPEEQLNELEEVFRNARKSDIPTEVPDHLCCKITLDIFRDPVITPSGITYERAVILDHLHRVGKFDPVTRETLEPHQLVPNLAIKEAVHAFLSEHGWAYRMR

SEQ ID NO: 1021 - protein, 230 aa, Zea mays
MSANVGESTSGGSSNDAAGGSFECNICFELPQEPIVTLCGHLFCWPCLYRWLHIHAHSPECPVCKALVEEDKLVPLYGRGKDRVDPRSKNMPEGEIPHRPTGQRPAPAPQADANNNFANANPNANPWFMGTGVPLANARWGNYAFSAAFGGLFPMLSFQVHGFPDAAAYAQPAGFHYGYGHGHGFHGGHMGHAHGVHRQAPLGQQQQADIYLKALLFMIGILVIASLIAF

SEQ ID NO: 1022 - protein, 609 aa, Zea mays
MEWDSDSDGGDDEEEEEVRPGGGDAGPGFSLAIEGVLGACGMVVSDALEPDFPIIYVNRGFESSTGYSAEEVLGRNCRFLQCRGPFAQRRHPLVDAAVVTRIRRCLDEGTEFHGDLLNFRKDCSPYMARLQLTPIYGDDEVITHYMGIQFFNDSNVDLGPSSGSVTKELARSTWIAPGNTDSPTPVGKGNLWEHSSLFLLSDEVICQKILSKLSPRDIASVNSVCKRLHHMTRNEDLWRMVCQNAWGTEATRALETVAGSRSLAWGRLARELTTLEAVAWRKLTVGGAVEPSRCNFSACAVGNRVVLFGGEGVNMQPMNDTFVLDLSASKPEWRHINVSAAPPGRWGHTLSCLNGSRLILFGGCGGQGLLNDVFILDLDAQHPTWREIPGLAPPVPRSWHSSCTVDGTKLVVSGGCADSGVLLSDTYLLDVTMERPVWREIPASWSPPSRLGHSLSVYDGRKILMFGGLAKSGPLRLRSSDVFTLDLSEDKPCWRCITGSRMPGAGNPAGVGPPPRLDHVVVSLPGGRVLIFGGSVAGLHSASKLYLLDPTEDKPTWRLLNVPGHPPRFAWGHSTCVVGGTKAIVLGGQTGEEWTLTEIHELSLASSLV

SEQ ID NO: 1023 - protein, 618 aa, Zea mays
MFDDAGAVAVKRMRLWEEDEVEVEEEGMEVDAEPGWPWGTPAAGLSRAAAIVVADAADPDFPVIYVNAAFESATGYRAHEVLGRNCRFLQFRDPRAQRRHPLVDPMVVSEIRRCLNEGIEFQGELLNFRKDGAPLYNRLSLIPMHGDDGYVTHVIGIQLFSEANIDLSSVSYPVYKQQTNNRPIIQDLNSASHEHAPKVQSADHCGMLQLSDEVLAHNILSRLSPRDVASIGSVCTRMHELTKNDHLRKMVCQNAWGRDATVKLEMSTKMVGWGRLARELTTLEAASWRKFTVGGRVEPSRCNFSACAVGNRLVLFGGEGVNMQPMDDTFVLNMEAARPEWRRVKVSASPPGRWGHTLSWLNGSWLVVFGGCGQQGLLNDVFVLDLDAQQPTWREVASEGPPLPRSWHSSCTLDGSKLVVSGGCTESGVLLSDTFLLDLTKEKPAWREIPTSWSPPSRLGHTMSVYGTTKLLMFGGLAKSGSLRLRSSDAYTMDVGEDSPQWRQLATTGFPNVGPPPRLDHVAVSLPCGRIIIFGGSIAGLHSPAQLFLVDPAEEKPTWRILNVPGKPPKFAWGHSTCVVGGTRVLVLGGHTGEEWILNELHELCLASRPDDDDDDRY

SEQ ID NO: 1024 - protein, 983 aa, Zea mays
MMESAAAQSCAACGDDARAACRACSYALCRACLDEDAAEGRTTCARCGGDYAAINPARASEGTEAEEEVVENHHTAGGLRERVTMGSHLNDRQDEVSHARTMSSLSGIGSELNDESGKPIWKNRVESWKEKKNEKKASAKKTAAKAQPPPVEEQIMDEKDLTDAYEPLSRVIPISKNKLTPYRAVIIMRLIVLGLFFHYRITNPVNSAFGLWMTSVICEIWFGFSWILDQFPKWYPINRETYVDRLIARYGDGEESGLAPVDFFVSTVDPLKEPPLITANTVLSILAVDYPVEKISCYVSDDGSAMLTFESLAETAEYARKWVPFCKKYAIEPRAPEFYFSQKIDYLKDKIHPSFVKERRAMKRDYEEYKVRINALVAKAQKTPDEGWIMQDGTPWPGNNPRDHPGMIQVFLGETGARDFDGNELPRLVYVSREKRPGYQHHKKAGAMNALVRVSAVLTNAPYILNLDCDHYVNNSKAVREAMCFMMDPTVGRDVCYVQFPQRFDGIDRSDRYANRNVVFFDVNMKGLDGLQGPVYVGTGCCFNRQALYGYGPPSLPALPKSSICSWCCCCCPKKKVERSEREINRDSRREDLESAIFNLREIDNYDEYERSMLISQMSFEKSFGLSSVFIESTLMENGGVPESANPSTLIKEAIHVISCGYEEKTEWGKEIGWIYGSVTEDILTGFKMHCRGWRSIYCMPVRPAFKGSAPINLSDRLHQVLRWALGSVEIFFSRHCPLWYGYGGGRLKWLQRLSYINTIVYPFTSLPLVAYCCLPAICLLTGKFIIPTLSNAATIWFLGLFMSIIVTSVLELRWSGIGIEDWWRNEQFWVIGGVSAHLFAVFQGILKMIAGLDTNFTVTAKATDDTEFGELYLFKWTTVLIPPTSILVLNLVGVVAGFSAALNSGYESWGPLFGKVFFAMWVIMHLYPFLKGLMGRQNRTPTIVVLWSVLLASVFSLLWVKIDPFVGGTETVNTNNCNTIIC

SEQ ID NO: 1025 - protein, 1074 aa, Zea mays
MAANKGMVAGSHNRNEFVMIRHDGDAPVPAKPTKSANGQVCQICGDTVGVSATGDVFVACNECAFPVCRPCYEYERKEGNQCCPQCKTRYKRQKGSPRVHGDDEEEDVDDLDNEFNYKQGNGKGPEWQLQGDDADLSSSARHDPHHRIPRLTSGQQISGEIPDASPDRHSIRSPTSSYVDPSVPVPVRIVDPSKDLNSYGLNSVDWKERVESWRVKQDKNMLQVTNKYPEARGDMEGTGSNGEDMQMVDDARLPLSRIVPISSNQLNLYRIVIILRLIILCFFFQYRISHPVRNAYGLWLVSVICEVWFALSWLLDQFPKWYPINRETYLDRLALRYDREGEPSQLAPIDVFVSTVDPLKEPPLITANTVLSILAVDYPVDKVSCYVSDDGSAMLTFESLSETAEFARKWVPFCKKHNIEPRAPEFYFAQKIDYLKDKIQPSFVKERRAMKREYEEFKIRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIVVKSCCGRRKRKNKSYMDSQSRIMKRTESSAPIFNMEDIEEGIEGYEDERSVLMSQRKLEKRFGQSPIFIASTFMTQGGIPPSTNPASLLKEAIHVISCGYEDKTEWGKEIGWIYGSVTEDILTGFKMHARGWQSIYCMPPRPCFKGSAPINLSDRLNQVLRWALGSVEILLSRHCPIWYGYNGRLKLLERLAYINTIVYPITSVPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAAALGQCGVNC

SEQ ID NO: 1026 - protein, 261 aa, Zea mays
MWSFASNAIAGSLKKKAQPSKCSISNADYSDDEVSSCTSREEGLDCPICWESFNLVENVPYVLWCGHTMCKNCILGLHWAVVKFPSLPIQLPLFISCPWCNLLSFRLVYKGNLRFPRKNYFLLWMVESMNGGRAKFHSTNHDEHHSTWHSSAGTSSSHQQRRNAAVGSESSSGRETGVGRNIFHTDNISASLQKLMVCFMQLTAKFPLVIIFLLIVLYAVPASAAVLVLYALVTFLFALPSFLILYFAYPSLDWLVREIFA

SEQ ID NO: 1027 - protein, 272 aa, Zea mays
MWGFASNAWASGLGKRSPPNCTSSSAACSDDEASSCTSREEGLECPICWESFNIVENVPYVLWCGHTLCKNCVLGLQWAVIKVPTVPMQLPFFVCCPWCNLLSLRILYKGNLTFPRKNYFLLWMVEGMNGERARSRPATHSEQHTPWLSSSSRANGNAGCSNPTRRHLPLPPPVDTTSPTNANHANHGVPVPLLNAERVQASLRKSLSFLVHLTAKFPLVFIFLLIVLYAIPASAAVLLLYILITVLFALPSFLILYFAYPSLDWLVREIFA

SEQ ID NO: 1028 - protein, 196 aa, Zea mays
MDSSTSAAAAGEAAVPPEDDVCSVCHDRFRIPCQANCSHWFCGECIIRVWNYGPPVQACKCPICRRLINLLVPAALSGQEDGPQAQRILGEIQHYNCIFGGAPRSLTQRLQDLPFFIRRLFRELMDPQRTLPLVFRARMLMMVALSAIYVLSPVDILPESMLGLFGFVDDLLILLIVFLHLAAVYRSLLLYRHGGQ

SEQ ID NO: 1029 - protein, 251 aa, Zea mays
MDSRVVDGAGGGADASLPADPPSPVPDPAAGGMDARLPSDLLRAVLQRLPPIDLARSACVCRAWRAVASDRAVVEAAFCAPWGVRRVVGEPATGAFWRAASLGRFALSHAIRRGDTVPGVALKYSVQVTDIKRFNNMMSDHGIYSRERLLVPISNPEILLGSTCYIEMDHNAKREVAIFYPEGRPGGKTDSVASIVSAERRNKRILESVRRSLHVDDGTAAYYLSVTEGDPRAAMTEYSEDLRWEQQRAGR

SEQ ID NO: 1030 - protein, 341 aa, Zea mays
MELDSIECMSYSDSMGDDDTDAVTSSQLPRPFLKSSSTAGTAAVNVVVVSDRVGAAGPVAGAGSLVISPATGVHELLECPVCTNSMYPPIHQCQNGHTLCSTCKTRVHNRCPTCRQELGDIRCLALEKVAESLELPCKYYSLGCSEVFPYYSKLKHESQCNFRPYNCPYAGSECSVVGDISFLVAHLRDDHKVDMHSGCTFNHRYVKSNPREVENATWMLTVFHCFGQYFCLHFEAFQLGMAPVYMAFLRFMGDENDARNYSYSLEVGANGRKMIWEGTPRSIRDSHRKVRDSHDGLIIQRNMALFFSGGERKELKLRVTGRIWKEQQNPDSGACIPNLFS

SEQ ID NO: 1031 - protein, 400 aa, Zea mays
MEAPRPNNGRKRKPTPPAGLGALHDDLLERVLARLPPATYFRLRAVCSRWRAAAASPTFLHACARVPSRDPWFLMLSDSDSGPRPPVAFDAAGRSWNRCHAAPGAAVPVAASAGLVLYRAPATGALTVANPLTGASRALPSPPQQAARQLQAIAMYGAGGPYRVALFAGDLPDDLSMAVYDSSSNSWEGPLPLARKPGDDSCPDAPAPDDTVYFLSKSGDVVATNMQRSASKQYSSSVVVRRDGDGDAAFAYFLSYSGTVVACDTARRTFAELPRILPVYFEYSIDVVACGAAAYAVVLSEYLGTASLRVWEFAGGAWRQVAAMPPAMSHGFHGTRPDINCVGHGDRLMVCVTSAEANACFMCDVASNQWEELPKYVNADGEASEFLAAFSFEPRVEVTV

SEQ ID NO: 1032 - protein, 337 aa, Zea mays
MAFFSHHHLQQPHPQQAPPPNQQQPVLPSFRNALPVPVDGQIPAPLTFFNPPPAFPEQPAQTTLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKIFRKIRDKEAEVETINKRNSELEDQIKHLGVEVGAWQQRAKYNESLINALKYNLEQVCAHQSKDFKEGCGDSEVDDTASCPYGGAVNLQLMPKENRQPKNLTACRVCKSSEACMLLLPCRHLCLCKECESKLSICPLCQSSKILGMEIYYA

SEQ ID NO: 1033 - protein, 354 aa, Zea mays
MHPKARIHADPVREVDHFDCLPDSLVLLILNKVEDVRSLGRCYAVSKRLCGLVSLVHDVYVKIDRVVAVDGDAEGTLNLSSPKPRSIFSHFLRLMLFTIIKPFHNMRSPNGTARPLFPQLSQHSPAQVLRNFTHVRNLRIELPSGDVGTEEGVLLKWRAEYGSTLENCVILGGTRVDRKPVGGEHEPALEDNGSMPESFYTNGGLKLRVVWTISSLIAASTRHYLLRSIINGHPTLQSLVLTDADGQGTLCMGAKQLEEFRENQLSASACSNRTQVPACNMKLKYAPYVELPGGMALQGATLVAIKPSPEGSNGSHPNRKEAEGFVFGAFDGPFKAAVKTLMKRRTYLLEMNGF

SEQ ID NO: 1034 - protein, 254 aa, Zea mays
MAKRRRHELAPVVEELISPMNSLDDGCLMHIFSFLSPIPDRYNTALVCHRWRFLACHPRLWLRVERPIRDAMEPGVYPDLEAAVSAARPGDTILIAAGGSHVACNIQIKKPICIIGGGDLPDDTVLTCSRGFDNALEFLSTCKIANLTIRAELGCCLLHRGGRLTIQECLLQCEQNPLDHLSFPIISTAIEYDPFSSLKEQGHGVTVVRTRIEGGARAVRTNGTLALRHVRAIYSRSSVFFWFEVGEKVEAPVH

SEQ ID NO: 1035 - protein, 342 aa, Zea mays
MKFGATYEEYLRAERDKFLGQCSHVEYKRLKKVLKKCRVGRSLQADGTNGDEQQEGRDESSNICECNSCTLCDEMFFTELNKEASEIAGCFRSRVQRLLHLHVPSGLQRCIWRFRQCFIDDQQIMVQEGRMLLNYVTMNAIAIRKILKKYDKIHGSVSGRDFKSKMQTEHIELLQSPWLIELAAFHLNCDDSDADEPRAGEFFKNGFFKNFSCDLSGAQPLLTMTISETLKYEYSLTCPICLDTLFNPYALSCGHLFCKACACGAASVYIFQGVKSAPPEAKCPVCRAVGVFDRAVRMTELELLLKRRDKDYFLQRLREERSVMVKQAKEYWDSQAMLSMGI

SEQ ID NO: 1036 - protein, 371 aa, Zea mays; identical to SEQ ID NO: 777

SEQ ID NO: 1037 - protein, 237 aa, Zea mays
MAGQERRTIDLEEGWAFMQKGITKLKNILEGKPEPQFSSEDYMMLYTTIYNMCTQKPPHDYSQQLYDKYRESFEEYITSMVLPSLREKHDEFMLRELVQRWSNHKVMVRWLSRFFHYLDRYFISRRSLTPLKEVGLTCFRELIYQEIKGQVKDAVIALIDKEREGEQIDRGLLKNVLDIFVEIGLGQMECYENDFEDFLLKDTTEYYSVKAQSWILEVRYGDLRAYGSCHSKGCSHL

SEQ ID NO: 1038 - protein, 277 aa, Zea mays
MEHSNTQSGAAKVSILMIGQQAIMDAYLCLLHLTAGILVESLFNAFATAAFFKFVVFSIFEMRYLLAIWKASRPLNSGEGWEIMRRELSVLYSRFYGILLGGILLMYELHNFLRPLLLLMYSFWVPQIVTNVIRDTRKPLHPQYILGMTVTRLAIPLYIFGCPSNFMRIEPDKKWSIAVTVFMGIQAAVLLLQHYLGSRCFIPRQILPEKYCYHRKVEDSTNQPIDCVICMTTIDLTQRTSEYMVAPCEHIFHSGCLQRWMDIKMECPTCRRSLPPA

SEQ ID NO: 1039 - protein, 422 aa, Zea mays
MDALPPLQRATSPPPQPRPQPPVPSRRYGVHFSASSFIQAPLTTLLEYSGILRPDPGGGTQQDGAGAGPGEVSIRIVAPGEAGTSSERPEEVIVEEEEEDGHATRTRPEDPSPAAGGGEGGRESSSSYQRYDIQQVARWVEQILPFSLLLLVVFIRQHLQGFFVTIWIAAVMFKSNDILRKQTALKRERKIPVLVGITILFVVHVSGFYWCYKNGDLIRPLMMLPPKEIPPFWHAIFIILVNDTMVRQTAMVVKCLLLMYYKNSRGRSYRRQGQMLTIVEYFLLLYRALLPTPVWYRFFLNKEYGSLFSSLTTGLYLTFKLTSVVEKVQSFLTALRALSHKDFHCGSYATSEQVAVAGDLCAICQEKMHVPILLRCKHVFCEDCVSEWFERERTCPLCRALVKPADLRSFGDGSTSLFFQLF

SEQ ID NO: 1040 - protein, 425 aa, Zea mays
MEAAGRLLLLIVSSLLLLFSPERPAEAAPPRIQPLATAALSRLYDTSNYGRLQLNNGLALTPQMGWNSWNFFACNINETVIRETADALVSTGLAALGYNFVNIDDCWSYVKRGKQDQLLPDPKTFPSGVKALADYVHGKGLKLGIYSDAGKFTCQVRPGSLGHENDDAAIFASWGIDYLKYDNCYNLGIKPQKRYPPMRDALNSTGRQIFYSLCEWGQYDPALWAGKVGNSWRTTDDITDTWKSMTDIADKNNKWASYAGPGGWNDPDMLEVGNGGMSLAEYRSHFSIWALMKAPLLIGCDVRNMTSETMEILSNKEVIQVNQDPLGVQGRKILGQGKYGCREVWAGPLSGNRLVVALWNRCSDTANVTMKLPAVGLDGYAAYSVRDLWKHETLSENVVGTFGAQVDVHDTKMYIFSPATIVASV

SEQ ID NO: 1041 - protein, 389 aa, Zea mays
MWGERTHHKHWHQGHGTSGNSNNKKHDKRQPKFIPDNYSSVDEVTTALREAGLESSNLILGIDFTKSNEWSGRHSFRRKSLHAINGTPNPYEQAISIIGRTLSPFDDDNLIPCFGFGDASTHDHSVFSFYPENRPCRGFEEVLVRYRQIVPHLNLSGPTSFAPLIYAAISVVENSNWQYHVLVIIADGQVTAANINDGRLSPQEQATIQAIVDASYYPLSIVMVGVGDGPWDAMQHFDDCIPERAFDNFQFVNFTGIMSTSKDMSKKEAAFALAALMEIPSQYKATQGLRPPEKQAQRIGSPRILPPPNKVLENDNAAAAASHPPQTASSKSTGIGKSAADEQVCPICLTNPKDMAFQCGHLTCKECGPTLSTCPLCRALITMRVRLYS

SEQ ID NO: 1042 - protein, 348 aa, Zea mays
MVTPYLPSSHNHRRRLPILLKIGFLLMMGENKLMGKRWEDMDTDVLVKIFKELNLVELSPVSQVCRLWRLACSDPLIWGTLDFGLLKSNFIQTRASPYIWVDDRSDRRLARILRVAMAISCGNVNCMIFHYNLFMKDEHLHFISERSPHLKRLVMPAWNRITKVGICNAIQRWQALESLTMPTIGHPPYIMEEIARSCKNFTELKIMGSFDQQFASAILQFLPKLKVLSLRCSKVSMDALQCLLNSMEYLEVLNISHCLLLVVAANGRKQVVHELDSQILERASRLREFHYCQSRLCVACQRMVVDEGIMRWYRYEDWFWRRDEVRSLDLQDYGKLFDVGCERLTSVD

SEQ ID NO: 1043 - protein, 390 aa, Zea mays
MEIDSLREGFDRVAEKRSLSSAKALEVVDQIVNEIEQAIVKLQMMNTDSTGNVDHPSILAELKAKLNEMAPLNQLEGSQKELNVALSKYLKLLEKSFNPDISKAYRNVDFEVHTVNNIIANHFYRQGLFDLGDMFVHECGELGGASLKLPFQEMYAILEAMKARNLEPALSWAAKNHDQLLQNGSMLEFKLYQLQFVEILSKGSRGEAKDEALLYARTHLVPFAAVHKEEFQKLMACLLWVGRLDQSPYSELMSSAHWEKLAEELTHQFCSLLGQSRESPLSVAVSAGFQGLPTLLKLTQVMAAKKQEWQVMKQLPVPIDIGPEFQYHSVFVCPVLREQSSDENPPMRMPCGHVVSKQSIMKLSKSSSRAFKCPYCPSEAMASHCKQLHF

SEQ ID NO: 1044 - protein, 235 aa, Zea mays
MRKFQDSIKALQADIDHANAMASEFLRDYDGSVIQMRVAYSAVAHFLLQWTDCKLAGALGLLKVMLYKVCADGSSALPDWEMEASIREFYGVIFPSLLQLPSGITELDDRKQRKLCLKKFRSRDEQLSEVDTERELECGICLEVSPKVVLPDCAHMLCMRCFEDWNAKSKSCPFCRACLEEVKPGSLWIYTDGSDVVDMDTLTRENIRRLFMYINKLPLVVLHVVDLDVYKYRIK

SEQ ID NO: 1045 - protein, 242 aa, Zea mays
MRKAYRDSIKVLEADIQHANTLASEFPRDYDGACLQMRLSYSPAAHIFLFLVQWTDCSLAGALGLLRILIYKVYVDGTTTMSTHERKASIKEFYAVIFPSLLQLQRGITDVEDKKQKAVCMEKYRKKDEDGRDTLSDIDVEREEECGICMEMNSKVVLPNCTHAMCIRCYQDWSSRSQSCPFCRDNLKKTCPSDLWIYVEDQDVVDMETVSSENLRRLFMYISKLPLIVPDVIFSVYDSHIK

SEQ ID NO: 1046 - protein, 419 aa, Zea mays
MELLPVEVVGNILSHLGVARDVMIASAVCRKWRDACRRHLRLLSFNSNDFPRDMTTRQLEIVITQTIFQTMGLQRLSIHIDNTHEFSAAPVIAWLMYTRETLRSLSYNVRTIPNVSILEKCGRQKLEVLDLELDHNTITGVEPSYQRFTCLKSLSLRHVSILALDLSLLVAACPRIESLALDVLEVVTSELQSTMELTSHTLKSLFAKSVGVDKIILDADNLEVLHLNALNLDLFELNGKGTLKHFKIDDVSVTHLDIGDNTDHLEAVDVSNFTIVWPKFYSMISRASNLRMLRFWGVVFDDEDEIVDSETIAVSFPLLRHLSLSYELRDGLLHYSLQGSSLLENVSVLELGWTVISEHFGPWVFGMIGRCPNLKKLVIHGVLSETKTREDRQMLASFTSFIVCVMRKYVHVDVQFEYE

SEQ ID NO: 1047 - protein, 335 aa, Zea mays
MGECEDGKEYRCWEELLPDALGLIFRNLPLQEVLTVLPRVCKSWGRVVAGPYCWQEIDIEEWSQQQSKPEQIGRMVELLVGRSGGSCRRISVSGLPCDPLFSFIADNARALGTLEIPRSEISDSVVEAVAPRLSNVTFLDISSCTKIGARALEAFGRHCRSLVGLRRVMHPIDLADKVCQHDEAHAIARSMPRLRHLEMGYMLVATEAVLEILGQCRELKFLDLRGCWAVDDRFLRERHPGLRVLGPRVVDDCYENSYWEECSDYYSDEDEDYDDDVVSWGLFVDDDDDYYYAVGSDDDEAIWDDAQGLENLEVRFYGGGGFGESFAGFDWPPSP

SEQ ID NO: 1048 - protein, 360 aa, Zea mays; identical to SEQ ID NO: 663

SEQ ID NO: 1049 - protein, 977 aa, Zea mays
MYGNDNWINSYLDAILDAGKGVAAAAAGAARGRGGGWGGDRPSLLLRERGHFSPARYFVEEVITGYDETDLYKTWLRANAMRSPQEKNTRLENMTWRIWNLARKKKEFEKEEAIRLSKHRLETKKPRNDATAEMSEDLFEGVKGEDAGDPSVAYGDSTTGNTPRTSLFDKLYIVLISLHGLIRGENMELGRDSDTGGQVKYVVELAKALSSCPGVYRVDLLTRQILAPNFDRGYGELDELLASTSFKNFRCERGENSGAHIIRIPFGPKDKHLAKENIWPFIQEFVDGALGHIVRMSKTIGEETGSVCPVWPTVIHGHYASAGVAAALLSGALNVPMLFTGHFLGKDKLEELLKQGRQTREQINVTYKIMRRIEAEELSLDASEIIIASTRQEIEEQWNLYDGFEVMLARKLRALVKRGANCYGRYMPRMVIIPPGVEFGQLIHDFDMYGDEDNQSPALDPSIWFEIMRFFTNPRKPMILAIARPYSEKNIATLVKAFGECHPLRELANLTLIMGNREAISKMNKISAAVLTSVLTLIDEYDLYGQVAYPKLHKHSEVPDIYRLAARTKGAFVNVAYFEQFGVTLIEAAMHGLPVIATKNGAPVEIYQVLENGLLVDPHDQHAIADALYKMLSEKQFWSRCRENGLKNIHQFSWPEHCKNYLSRISSLGPRHPAFACKEDHKVPVKCRKHISIIAVDSVNKEDLIQIIRNSVEATRTGTMSGSTGFVLSTSLTIAELQSVIVRTGMLPTDFDAFICNSGSDIYYPLQSSDVPSNSRVTFALDHNYRSHIEYRWGGEGLRKYLVKWASSVVERRGRTEKQVIFEDSEHSSTYCLAFRVVNPNHLPPLKELQKLMRIQSLRCHALYNHGATRLSVIPMHASRSQALRYLSIRWGIELPNAVVIVGETGDSDYEELFGGLHKTVILKGGFNTPANRIHTVRRYPLQDVVALDSSNIIGIEGFSTGDIRSAMQQQLGIPTQ

SEQ ID NO: 1050 - protein, 893 aa, Oryza sativa
MRSLRRVLLQLVLLAGVAFRGVRFDDAADAAAAAQGSSDLFELPSPSPTLALPGGGDEGASTEIIAAPWPGRHGLFTPPRSTSQPARAVVQPAADFGSQLQFYDNGTIQLVDLLSKLPRWQFSTGPPLSKHITTSKPDLNYVIYLDGSETSDLIEVHNGSGVRLPWKLEEFIAETPYIRDSFVTIGSKVSTTFVVNADSGEIIYKHSLPVALNEVGGPLVEEIPSKLDAARSGTSANIIVVVRTDYSISASDLGEHLFNWTRTSFTANYYARYGHQDMLAQSSCLRGNIPCIRTEGPPIKLYLPDSSSDNAIVLRPVNEVSAVDALEPLLPPKKLPQPAGESNVALDSAQNQTADIALGHFVPADTELTNSVTKFSYRWLFPTFLMLLIMACLVKLADASKYCRQFVIRFLKPFMRDEKLMDPRGKSEGTSKRRKARKKDGLINSTQIFSASDKEGNGTGGSTEAQSNKAHDSTNVELPNGLNGRQIGKLCVYSKEIGKGSNGTVVFEGSYGGREVAVKRLLRSHNDIASKEIENLIASDQDPNIVRMYGFEQDNDFVYISLERCRCSLADLIQLHSVPPFSNTKGTDIELWRQDGLPSAQLLKLMRDVVAGIVHLHSLGIIHRDLKPQNVLISKEGPLRAKLSDMGISKRLQEDMTSVSHHGTGFGSSGWQAPEQLRHGRQTRAIDLFSLGCLIFYCITKGKHPFGEYYERDMKIINNQFDLFIVDHIPEAVHLISQLLDPDPEKRPTAVYVMHHPFFWSPELCLSFLRDTSDRIEKTSETDLIDALEGINVEAFGKNWGEKLDAALLADMGRYRKYSFESTRDLLRLIRNKSGHYREFSDDLKELLGSLPEGFVQYFSSRFPKLLIKVYEVMSEHCKDEEAFSKYFLGSSA

SEQ ID NO: 1051 - protein, 415 aa, Oryza sativa
MRSLRRVLLQLVLLAGVAFRGVRFDDAADAAAAAQGSSDLFELPSPSPTLALPGGGDEGASTEIIAAPWPGRHGLFTPPRSTSQPARAVVQPAADFGSQLQFYDNGTIQLVDLLSKLPRWQFSTGPPLSKHITTSKPDLNYVIYLDGSETSDLIEVHNGSGVRLPWKLEEFIAETPYIRDSFVTIGSKVSTTFVVNADSGEIIYKHSLPVALNEVGGPLVEEIPSKLDAARSGTSANIIVVVRTDYSISASDLGEHLFNWTRTSFTANYYARYGHQDMLAQSSCLRGNIPCIRTEGPPIKLYLPDSSSDNAIVLRPVNEVSAVDALEPLLPPKKLPQPAGESNVALDSAQNQTADIALGHFVPADTELTNSVTKFSYRWLFPTFLMLLIMACLVKLADASKYCRQFVIRFLKPFM

SEQ ID NO: 1052 - protein, 479 aa, Oryza sativa
MADEKLMDPRGKSEGTSKRRKARKKDGLINSTQIFSASDKEGNGTGGSTEAQSNKAHDSTNVELPNGLNGRQIGKLCVYSKEIGKGSNGTVVFEGSYGGREVAVKRLLRSHNDIASKEIENLIASDQDPNIVRMYGFEQDNDFVYISLERCRCSLADLIQLHSVPPFSNTKGTDIELWRQDGLPSAQLLKLMRDVVAGIVHLHSLGIIHRDLKPQNVLISKEGPLRAKLSDMGISKRLQEDMTSVSHHGTGFGSSGWQAPEQLRHGRQTRAIDLFSLGCLIFYCITKGKHPFGEYYERDMKIINNQFDLFIVDHIPEAVHLISQLLDPDPEKRPTAVYVMHHPFFWSPELCLSFLRDTSDRIEKTSETDLIDALEGINVEAFGKNWGEKLDAALLADMGRYRKYSFESTRDLLRLIRNKSGHYREFSDDLKELLGSLPEGFVQYFSSRFPKLLIKVYEVMSEHCKDEEAFSKYFLGSSA

SEQ ID NO: 1053 - protein, 1115 aa, Saccharomyces cerevisiae
MRLLRRNMLVLTLLVCVFSSIISCSIPLSSRTSRRQIVEDEVASTKKLNFNYGVDKNINSPIPAPRTTEGLPNMKLSSYPTPNLLNTADNRRANKKGRRAANSISVPYLENRSLNELSLSDILIAADVEGGLHAVDRRNGHIIWSIEPENFQPLIEIQEPSRLETYETLIIEPFGDGNIYYFNAHQGLQKLPLSIRQLVSTSPLHLKTNIVVNDSGKIVEDEKVYTGSMRTIMYTINMLNGEIISAFGPGSKNGYFGSQSVDCSPEEKIKLQECENMIVIGKTIFELGIHSYDGASYNVTYSTWQQNVLDVPLALQNTFSKDGMCIAPFRDKSLLASDLDFRIARWVSPTFPGIIVGLFDVFNDLRTNENILVPHPFNPGDHESISSNKVYLDQTSNLSWFALSSQNFPSLVESAPISRYASSDRWRVSSIFEDETLFKNAIMGVHQIYNNEYDHLYENYEKTNSLDTTHKYPPLMIDSSVDTTDLHQNNEMNSLKEYMSPEDLEAYRKKIHEQISRELDEKNQNSLLLKFGSLVYRIIETGVFLLLFLIFCAILQRFKILPPLYVLLSKIGFMPEKEIPIVESKSLNCPSSSENVTKPFDMKSGKQVVFEGAVNDGSLKSEKDNDDADEDDEKSLDLTTEKKKRKRGSRGGKKGRKSRIANIPNFEQSLKNLVVSEKILGYGSSGTVVFQGSFQGRPVAVKRMLIDFCDIALMEIKLLTESDDHPNVIRYYCSETTDRFLYIALELCNLNLQDLVESKNVSDENLKLQKEYNPISLLRQIASGVAHLHSLKIIHRDLKPQNILVSTSSRFTADQQTGAENLRILISDFGLCKKLDSGQSSFRTNLNNPSGTSGWRAPELLEESNNLQCQVETEHSSSRHTVVSSDSFYDPFTKRRLTRSIDIFSMGCVFYYILSKGKHPFGDKYSRESNIIRGIFSLDEMKCLHDRSLIAEATDLISQMIDHDPLKRPTAMKVLRHPLFWPKSKKLEFLLKVSDRLEIENRDPPSALLMKFDAGSDFVIPSGDWTVKFDKTFMDNLERYRKYHSSKLMDLLRALRNKYHHFMDLPEDIAELMGPVPDGFYDYFTKRFPNLLIGVYMIVKENLSDDQILREFLYS

SEQ ID NO: 1054 - protein, 573 aa, Saccharomyces cerevisiae
MRLLRRNMLVLTLLVCVFSSIISCSIPLSSRTSRRQIVEDEVASTKKLNFNYGVDKNINSPIPAPRTTEGLPNMKLSSYPTPNLLNTADNRRANKKGRRAANSISVPYLENRSLNELSLSDILIAADVEGGLHAVDRRNGHIIWSIEPENFQPLIEIQEPSRLETYETLIIEPFGDGNIYYFNAHQGLQKLPLSIRQLVSTSPLHLKTNIVVNDSGKIVEDEKVYTGSMRTIMYTINMLNGEIISAFGPGSKNGYFGSQSVDCSPEEKIKLQECENMIVIGKTIFELGIHSYDGASYNVTYSTWQQNVLDVPLALQNTFSKDGMCIAPFRDKSLLASDLDFRIARWVSPTFPGIIVGLFDVFNDLRTNENILVPHPFNPGDHESISSNKVYLDQTSNLSWFALSSQNFPSLVESAPISRYASSDRWRVSSIFEDETLFKNAIMGVHQIYNNEYDHLYENYEKTNSLDTTHKYPPLMIDSSVDTTDLHQNNEMNSLKEYMSPEDLEAYRKKIHEQISRELDEKNQNSLLLKFGSLVYRIIETGVFLLLFLIFCAILQRFKILPPLYVLLSKIGF

SEQ ID NO: 1055 - protein, 542 aa, Saccharomyces cerevisiae
MAEKEIPIVESKSLNCPSSSENVTKPFDMKSGKQVVFEGAVNDGSLKSEKDNDDADEDDEKSLDLTTEKKKRKRGSRGGKKGRKSRIANIPNFEQSLKNLVVSEKILGYGSSGTVVFQGSFQGRPVAVKRMLIDFCDIALMEIKLLTESDDHPNVIRYYCSETTDRFLYIALELCNLNLQDLVESKNVSDENLKLQKEYNPISLLRQIASGVAHLHSLKIIHRDLKPQNILVSTSSRFTADQQTGAENLRILISDFGLCKKLDSGQSSFRTNLNNPSGTSGWRAPELLEESNNLQCQVETEHSSSRHTVVSSDSFYDPFTKRRLTRSIDIFSMGCVFYYILSKGKHPFGDKYSRESNIIRGIFSLDEMKCLHDRSLIAEATDLISQMIDHDPLKRPTAMKVLRHPLFWPKSKKLEFLLKVSDRLEIENRDPPSALLMKFDAGSDFVIPSGDWTVKFDKTFMDNLERYRKYHSSKLMDLLRALRNKYHHFMDLPEDIAELMGPVPDGFYDYFTKRFPNLLIGVYMIVKENLSDDQILREFLYS

SEQ ID NO: 1056 - protein, 420 aa, Zea mays
MSNEEYLHTDTHGLQISETVVEPQVGRSEGDLLPTSSTDDLHISGGRTKQSDAGELRKGNSIDDSTPTYLDITIGHLPERKTASRITTEGSGEFITGKGMLAGTSSVTISAMEAGRSEDGADSIYDPSGAITPYHDSQTQTVMPHENTSTGILGPPALPVGVSTRFEEKNIMQEAPEIIKTGGKDTELKRRNFQRNKQVLKDTFDEWEEAYQRDAEQRKADELFMREALLEAQRAADIWEVPVGAVLVQNGEIIARGCNLVEDHRDSTAHAEIVCIREASNKLKTWRLADTTLYVTLEPCAMCAGAILQARIDTVVWGAPNKLLGADGSWVRLFPGDGQTSTLDSTNQSQAAGPVHPFHPKIAIRRGVLSAECSEIMQQFFQLRRKKKPQSPPQAHRHGHHHPVKFFSKMHHMFGTIFCL

SEQ ID NO: 1057 - protein, 312 aa, Zea mays
MAESFVLNTGSRIPSVGLGVWQIQPDAANDAIYAAVKAGYRHIDCAAAYNNEKEVGLALKKLFEDGVVKRDDLFITSKLWAANHAPEDVEEGIDTTLQDLQLDYLDLYLIHGPIRIKKGTSTMTPENFLPTDIPATWAAMEKLYDSGKARAIGVSNFSCKKLHDLLAVARVPPAVNQVECHPVWQQDKLRKLCQSNGVHLSAFSPLGSPGSPWINGPSVLKNPIVVSVADKLQKTPAQVALRWGIQMGHSVLPKSANESRIKENIDIFGWSIPEDLMAKFSEIKQVRLLTAEFVVHPQAGYNTLEDFWDGEI

SEQ ID NO: 1058 - protein, 309 aa, Glycine max
MAITLNNGFKMPIIGLGVWRMEGNEIRDLILNSIKIGYRHFDCAADYKNEAEVGDALKEAFDSGLVKREDLFITTKLWNSDQGHVLEACKDSLKKLQLTYLDLYLVHFPVAVRHTGVGNTSSPLGDDGVLDIDTTISLETTWHAMEDLVSSGLVRSIGISNYDIFLTRDCLAYSKIKPAVNQIETHPYFQRDSLVKFCQKHGICVTAHTPLGGAAANAEWFGTVSCLDDQVLKGLAEKYKKTAAQISLRWGIQRNTVVIPKSSKLERLKENFQVFDFELSKEDMELIGSIDRKYRTNQPAVFWGIDLYA

SEQ ID NO: 1059 - protein, 75 aa, Saccharomyces cerevisiae
MSQQQGYYQQGPPQQGYYQQGPPQQGYYQQGPPQQGYPQQQPVYVQQGQPKEESCLDSCLKCLCCCFLLELVCDN

SEQ ID NO: 1060 - protein, 127 aa, Saccharomyces cerevisiae
MSSTNGNAPATPSSDQNPLPTRFEVELEFIQSLANIQYVTYLLTQQQIWKSPNFKNYLKYLEYWCNPPYSQCIVYPNCLFILKLLNGFMESAIVNEDGLLEGLDELPKIIQLQGPQWMNEMVERWAN

SEQ ID NO: 1061 - protein, 250 aa, Saccharomyces cerevisiae
MQHIKHMRTAVRLARYALDHDETPVACIFVHTPTGQVMAYGMNDTNKSLTGVAHAEFMGIDQIKAMLGSRGVVDVFKDITLYVTVEPCIMCASALKQLDIGKVVFGCGNERFGGNGTVLSVNHDTCTLVPKNNSAAGYESIPGILRKEAIMLLRYFYVRQNERAPKPRSKSDRVLDKNTFPPMEWSKYLNEEAFIETFGDDYRTCFANKVDLSSNSVDWDLIDSHQDNIIQELEEQCKMFKFNVHKKSKV

SEQ ID NO: 1062 - protein, 241 aa, Saccharomyces cerevisiae
MVKAVIFTDFDGTVTLEDSNDYLTDTLGFGKEKRLKVFEGVLDDTKSFRQGFMEMLESIHTPFPECIKILEKKIRLDPGFKDTFEWAQENDVPVIVVSSGMKPIIKVLLTRLVGQESIHKIDIVSNEVEIDAHDQWKIIYKDESPFGHDKSRSIDAYKKKFESTLKAGEQRPVYFYCGDGVSDLSAAKECDLLFAKRGKDLVTYCKKQNVPFHEFDTFKDILASMKQVLAGEKTVAELMEN

SEQ ID NO: 1063 - protein, 492 aa, Saccharomyces cerevisiae
MSDDLFSKALENPDQDLNVELPKDDVDLGLLGDGGNERKTDEPVADAERSTGLGSGSSESESDSGSDSDSDSGSSGSEDDSADQDVEGEDEGGDAIENEDEDEDPSPSGPILSKNEILEETVPELPEDYEISEKTIITPIGVLKSAFENNIIIHATMSGEKRVLKEGSIFCLEDRTLIGMLTEVFGPLQNPFYRIKLPDSKKNLFDELKVRLGEKAFIVTPDAHWIDTFELKRNKGTDASNGYDEELPEEEQEFSDDEKEALFKKMKKQQRQRKKRDNRKLANDSDNVKVKRARQPKANSLPKLVPPLGMSSNAPMQHGYKSRNARENIKRESSATSNRNGSSPVPITQHHQQQFSANNYPFPQQPNGMPYPPYSPFPQPTNFQYPPPPFGQATPAQFSNTVPYGSLPPAYNNMSPPTQQSFMPMTQSQPPLPYGVPPMNQMQNPMYIQPPPQAPPQGNGNFQQVMELHQILLQQQQQQHQYQHQHQQDPRT

SEQ ID NO: 1064 - protein, 312 aa, Saccharomyces cerevisiae
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 1065 - protein, 110 aa, Saccharomyces cerevisiae
MVSQETIKHVKDLIAENEIFVASKTYCPYCHAALNTLFEKLKVPRSKVLVLQLNDMKEGADIQAALYEINGQRTVPNIYINGKHIGGNDDLQELRETGELEELLEPILAN

SEQ ID NO: 1066 - protein, 333 aa, Saccharomyces cerevisiae; identical to SEQ ID NO: 930

SEQ ID NO: 1067 - protein, 246 aa, Glycine max
MAEDLVLDTAIRDWVLIPLSVVMVLIGVLRYFVSKLMHSSQTPDAKIVKEGQVIVRARNLRAGANFIPSKAFRARKIYFCNEENGLLFVPKGQGQNPQAQMFSDPNMAMDMMKKNLSMIIPQTLTFAWVNFFFSGFVAAKIPFPLTQRFRSMLQNGIDLSTVDVSYVSSRSWYFLNLFGLRGLFSLILGEENAVDDTQRMMQMGGFGFDPSKGLSAEKDNLDITQHDWALPNFEQRAEAVLRKVAS

SEQ ID NO: 1068 - protein, 166 aa, Zea mays
MASEHAAGGEAKHDQKQSLMDKAKGFVVEKIAHIPKPEATLDGVTFKGLSRECITLHSSVNVSNPYDHRLPICEVTYTLRCAGKEVASGTMPDPGWIAASGSTALEIPAKVPYDFLVSLVRDVGRDWDIDYELQVGLTVDLPIVGNFTIPLSTSGEFKLPTLKDLF

SEQ ID NO: 1069 - protein, 131 aa, Zea mays
MSEEKHHHFFNHHKKDEEQPAGEYGYSETEVVTATGEGEYERYKKEEKEHKHKQHLGEAGAIAAGAFALYEKHEAKKDPEHAHRHKITEEVAAAAAVGAGGYVFHEHHEKKKDHKDAEEASGEKKHHHLFG

SEQ ID NO: 1070 - protein, 138 aa, Oryza sativa
MAEEKHHHHLFHHKKDDEPATGVDSYGEGVYTSETVTTEVVAGGQDEYERYKKEEKQHKHKQHLGEAGALAAGAFALYEKHEAKKDPENAHRHKITEEIAATAAVGAGGYAFHEHHEKKKDHKSAEESTGEKKHHLFG

SEQ ID NO: 1071 - protein, 180 aa, Oryza sativa
MSAAEERGDRQERDDGEGGEEERRERGGVGGLVDRAKGFVAEKIAKIPKPDATLDRVSFKGVSRECITLHSHLDVNNPYSHRIPICELTYTFKSGDKVIASGTMPDPGWIAASGTTNLELPVKVPYDFIVSLIKDVSGDWDIDYVLEVGITIDLPVVGSFTIPLATEGEMKLPTFRDLLF

SEQ ID NO: 1072 - protein, 180 aa, Zea mays
MRGAEEERSGAATDAGGEEEKRERSVGLMAGLMDKAKGFVVEKVTQIPKPEAALDHVSFQSISREGVELHSHVDISNPYSHRIPICEITYTFKSAGKVIASGTMPDPGWIAASGSTKLDLPVKVPYDFIVSLMKDLGGDWDIDYMLEVGLTVDLPAIGAFTIPLTTEGEIKLPTFRDLLF

SEQ ID NO: 1073 - protein, 141 aa, Zea mays
MAEEKHHHHHLFHHKKDEEQEEQLAGGGYGESAEYTEATVTEVVSTGENEYDEYKKEEKQHKHKQHLGEAGAIAAGAFALYEKHEAKKDPEHAHRHKIEEEVAAAAAVGSGGFAFHEHHEKKKDHKDAEEAGGEKKHHFFG

SEQ ID NO: 1074 - protein, 499 aa, Zea mays
MTATPAVIGLSARGNRLLATSFGSAELAPPDAYPSRQFAAAAPKLTVVAHRASASASSPADIGGAGHARAHAIRALRNHSAPALAPPPPADPAPELDSKFEFEFESSLEAIVLLQRSMLEKQWELPFEDDISSTEDEDEDERSTVVVARSGVSARQRRMSGRRRGAVVGRKSVTVSPELMQSRNRIYLRGTVSKDLLTHKQVVQLSRKIKDGIWLQHQRSKLKEKLGNEPSYKQLAQSLRIPAPELRARMRESFLAREMLAMSNTRLVISIAQKYDNLGVELPDLIQGGLIGLLRGIEKFDASRGFRISTYVYWWIRQGVSRALADNSRSFRLPTYLHERLVAIRGAKYALEDQGIAPTVENIAESLNISEKKVHNATEAVHKVISLDQQAFPSLNGLPGDTLHSYIEDQNVANDPWHGFEERYLKEEVNSLINSTLNERERDIIRLYHGIGKQCHTWEDISRQFGLSRERVRQVGLVAMEKLKHAARREHLDALLEEY

SEQ ID NO: 1075 - protein, 550 aa, Zea mays
MNSSRSLLSSPLFASSSPNFRSSASVSSSPSPSRTTAVPMIHDTSSSRASTACHYSPSLVAEEQLHGSKDTLTLKGEKALLELLLGMALDQHVDGRKLITQQEAEDSDFESYLREATSRVLYQPTFMYGASEFISSEEDDDDSISESSSASLAKPAGTLDLGKLTEEPQLDVPQPHRRSVDPNHSYDQVFIRSTRLLERRSKKRNGGHRALDNGVACSGVNSKRKDKFGRVLDPDEPFRLFLRDRETTEFLTAKEEKQMFSQIQDLMKLEEAQRNLQAQCGREPTVEEWAQAVGMSCRELQSCVRTGRRCREKMARSNFRLVIHVARKYEGCGLDIQDLVQDGCCGLMKTFEKFNPSKGCRFPTYAYWWIRQSIKKSIFKNSRLIRLPESVYALLRKVGKARMECIMDGEQPTNEVVARRAGITIEKLAKLRAKTRKVRSMQDRVWSDDGVTYQEITEDPNIEGPEVSVDRLMMRQQVRSFLAGILSPREKEIIEHRFGIHDGQPKTLHVIGDMYGLSKERIRQVQNKALDKLRNSISAQGFHVYFDLLT

SEQ ID NO: 1076 - protein, 539 aa, Zea mays
MACLAPQFKWAPSAAAHMPSSSSSSSYSRCSALRVHCAVTSAAVVEDRTNGSAAQLRLAYAAPAIQRNFEATLASEALLNEEAVVAAAAAEAVALARAAAEAAQEVVQIVQRNNHQPVIRPKKCVDNYLANEILRTEMRSSSPDMYANNPLMEYLDSYGIMDAEDELDAYAQYTENIAVKSARQSERKARRTRAAIKASTTLHASQKVALSSKKKRSKGSSSSMNPLGSLWKMTGRRLLTAKEEVEFSEGIQDLLKLEAIQAELIEYNGGQPTFSQWATAAGVDEKTLRKRLNYGIYCKNRMVTSNVRLVISIAREFEGPGMDFYDLIQEGMQGLIRGAEKFDSSKGFRFSTYSHWWIKQAMRKSVSEQSQIFRLPAHMVEASYRVKECTKRLRRKLRRRPTNEEIAVDTGIPIKRVEAAVNLPKYSVSLDSKIGSTDMTYQEVTADPSAETAEEMLNRMSMKKDVHMALDTLTTREKQVVVLRFGLEDGRIRTLQEIGNIMGVSRERIRQIESGAFRKLRSKKKVKALKDYLVPVGNW

SEQ ID NO: 1077 - protein, 577 aa, Zea mays
MAQACKKRRGVYISSESGDSDTDSDVEGSKHSQKSGVTSISTCEHQSSYNLKAASMKSSRMIRLCGNIVRKLIDHKCGWLFKEPVDPDLYGIPDYFDVIRSPMDLGTIKNKLTKKKYVSIEEFAADVRLTFSNAMKYNPPGNDVHIFAKELNEMFDSEWESVERKFRGRNLGQDQQTMKAIKVRAMMDSKSTVARGPVACSNPKTLVTRGPVACSNSIAKKTLTDALSSKVKIKFSVRSSAHTSSKDILVQAAGSKEGSLNHSVPTGNKEASSNCTIPIAKEAKISRAREIERCSGSIGKQSWSCNDTSTSPLASSVQGEESYLHDEPLSPSRALRAAMLRSRFAGTIVKAQQKALLDHGKNIDPVKLQLEKERLEKRQQEEKARIEAQVKAAEAAAQQKFEEEMRMKRKQEREAARLALRMMKKTVDIDNSDFLKELENFSKTWQANPPGKLIVDFISGDLPPGLGSPLERLGLFMKEDFEDEVEQEMEDRVSPSMDVDIRKDFQEDLGHEMQDSASPVTVIGTKNDVQGVAGHEMEDSGSPATVIDTKKEETEHEMVDSVSPLMDVDTEEGEISC

SEQ ID NO: 1078 - protein, 326 aa, Zea mays
MKRQSKRPTASRESPETGEKQKLAFAEEEAPPARKVEPDDEAEMDEDEDELGPGLGGGRAARSPCGLGEKKRRLALEQVRALERCFETDNKLDPDRKARIARDLALQPRQVAVWFQNRRARWKTKTLERDFAALRARHDALRADCDALRRDKDALAAEIRELRQKLLPKPEATVKLEATTGNDTAEERRQATAGAPPAGACKDGSSDSDSSVVFSDVEASPYSGGAAFEPPALAGLGAPFLDTSVAPTGCSSPPVFVETKWQQHGPTQYPFPFDSYKACAGYGFTEEWLASSDLIGSDGGAAGFFSEDHASSLNFNWCPSGIQGWE

SEQ ID NO: 1079 - protein, 282 aa, Zea mays
MKKCASELELEAFIRESGEDARAAAGGSSPGCGGSSDPGGSGVFSPGFGFADSDTMDGGSWWYGNVRTPNPVMSQAASISASPGLTTSANHALESESDSDSESLYEVEGVPYERGNRSIETKRIRRMVSNRESARRSRRRKQAQLSDLESQVERLKGENATLFQQLSDANQQFSTAVTDNRILKSDVEALRIKVKMAEDMVARSAVSCGLGDLGLAPYVNSRKMCQALNVLTGLDLLGSDAFRGPTAGTRVQNSPVQSTASLESLDNRKSNEVTSCAADIWP

SEQ ID NO: 1080 - protein, 377 aa, Zea mays
MAQDEAVATQKTGNTTSPSKDYPTPSPYPDWSTMQAYYGPGVLPPTYFTPAIAPGHPPPYMWGPQPIMPPPFGTPYAAVYPHGGAYPHPLVPMMSTPMSVEPAKSTNSKEKNSNKKLKEIDRTAVSAGSGNSKRTVSSIEDYSAEGSSDVNDQNVNETSRKRSSDGGPGAETTTGGNTECVLAPNHTLGNATILPQHCFSAPVIKPSATNVANSRAIGTALSPPPGVMVPVHNAVPSDLSVKDERELKREKRKQSNRESARRSRLRKQAETEELATQVESLAAENTSLRSEIGQLTESSEKLRLENSALMVKLKDTAEPSPIKASASPSSPRASAENFLSMIDSANAPSVSRHTEHGGPRLRQLLDSSPATDVAAVS

SEQ ID NO: 1081 - protein, 518 aa, Zea mays
MEYERIEKPFPVQGGGFSPKRLRAMLLGVDKRRKGQDGAAEEDEDGGGGGDYGALPKAHARSGAGDGGGATCEEYKDVDVVSTTSEFSSSLETAGGHRPRDAHPVATGSRTRVPPEEDSCDSESVASNFEFHKERRAAAAASVVPPFSKPAPSKWDDAQKWIASPTANCPGRGGAAPAPKKTEKPGSGIGRLPLPATKVVVEATEEIDTKRMDPSQEKREIGWQKAARWAPPDPCPEVEPCPTKTTLLAVETTVAAASAAAVNFNRHDASTTLQSAATCIPPPTTVRSVSMRDMGTEMTPIASQEPSRTGTPVRATSPNCSQPTTPRRTLGGPSAVGSFISHGGECSSSELSEQELQTKTRREIMLLGTQLGKTSIAAWASKKEEEKDASLSLKPVPMDQSTQNITAIRAAAWEEAEKAKYLARFKREEIKIQAWEDHQKAQIEAEMRKIEVEVERMRARAQDKLMTKLASARHSADEKRATAELKRNRAAARTAEQAEHIRRTGRVPPSFGCWNWCS

SEQ ID NO: 1082 - protein, 199 aa, Zea mays
MAEEEAKKVEVEVTKEPEAAAKEDVADDKAVIPASDPPPPPPPADDSKALAIVEKVADEPAPEKPAPAKQGGSNDRDLALARVETEKRNSLIKAWEENEKTKAENKAAKKVSAILSWENTKKANIEAELKKIEEQLEKKKAEYAEKMKNKVAMIHKEAEEKRAMVEAKRGEEVLKAEEMAAKYRATGHAPKKLIGCFGA

SEQ ID NO: 1083 - protein, 255 aa, Zea mays
MFPPGLIHHRPDATAPGDGPPRSGPGGPSLVLTADPKPRLRWTADLHERFVDAVAQLGGPEKATPKTILRTMGVKGLTLFHLKSHLQKYRLGKQSGKEGSEQSKDASYLLDAQSGMSVSPRVAAQDMKESQEVKEALRAQMEVQRRLHEQVEVQKRVQIRMEALEKYIDSILESACKMVTEQFASSGFSISNPDLPEISPGGVMCGSTDTLGSSVLNQLSVSSIDSHSPGGKPSPSGMEGPTLLQKSPELKRRSS

SEQ ID NO: 1084 - protein, 270 aa, Zea mays
MHPSAVSFDSGDGRRRGGAQMLLFGGGGSANSNGFFRGVPMAVLAMDDATRVGKRPFFTTHEELLEEEYYDEQAPEKKRRLTAEQVQLLERSFEEENKLEPERKTELARRLGMAPRQVAVWFQNRRARWKTKQLETDYDRLKAAYNALAADHQGLLADNDSLRAQVICLTEKLQGKETSLSATIAAQEVDQPNEHTTGTEKLLAQQLKDDLHSSCGCTGHGALSSEEEDGGVVSDEGCNFDLPDAMFAVGVTNHGAEEAQLANWTSWFWN

SEQ ID NO: 1085 - protein, 272 aa, Zea mays
MDPSAVSFDSGGTRRGGGAQMLLFGGGGSANSNGFFRGVPMAVLGMDDATRVGKRAFFTTHEELLEEEYYDEQAPEKKRRLTAEQVQLLERSFEEENKLEPERKTELARRLGMAPRQVAVWFQNRRARWKTKQLETDYDRLKAAYDALAADHQGLLADNDNLRAQVISLTEKLQGKETYPSATTAAQEVDQPDEHTAVSGTEELLAQQLKDNLHSSGDCTGHGTLSSEEDDGGVVSDEGCSFALPDAMFAAGFTHHGAEEVQLANWTSMFWN

SEQ ID NO: 1086 - protein, 267 aa, Zea mays
MAAGGGGGSAAPFVWKTYTMVEDPGTAGVIGWGSGNNSFVVADPFVFSQTLLPAHFKHNNFSSFVRQLNTYGFRKVHPDRWEFAHASFLRGQTHLLRNIVRRGSSAAGAGGGKRKDASPTELASGDDMTMVATEVVRLKQEQRAIDDRVASMWRRVQETERRPKQMLAFLLKVVGDRDRLHRLVGDAPVPDNGFASGGAAEPPAAEVGEKRARLLLDGDSMVALGPEAVDFAGFYSGGGAFGDVAVDAAAGSRGGGFSFAFGVDAGY

SEQ ID NO: 1087 - protein, 227 aa, Zea mays
MIKRRKPPSAVAPLRQQRAPASCLEVGEFGFEEEIDRLKRDKNILITEVVKLRQEQQSTKDHVRAMEERLRVAEQKQVQMMGFLARAMRNPEFFQQLAQQQDKRKELEDTISKKRRRPIDNTPFYSDGESEQLDSQLKMFESGVLNGLNEPELENLAVNIQELGKGSIDDGNLTQVSDQSELNDDFWAELLVEDFGDKAGQPELEGRTEDVNDLAQQLGYLSSSSPK

SEQ ID NO: 1088 - protein, 257 aa, Zea mays
MDSNRSMATSGVAPFVAKTYRMVDDPATDGVVAWGRDNNSFVVADPFAFSQTLLPAHFKHSNFSSFVRQLNTYGFRKVDPDRWEFAHVSFLRGQTHLLGQIVRRSSGGKRKDDGNGAGAGSADDEDAVAMEVVRLRREQRAIEEQVAAMWRRVQETERRPKQMLAFLVKVAGDPQVLRRLVSGAGGDAVFAAAEPEDGASIKRARLLLDAGSGGDGAVDFSGLYSTTAGSEDDGVGFGSDYLQPPPPYVFPVNSGGY

SEQ ID NO: 1089 - protein, 298 aa, Zea mays
MVEEGATAAASRSGPAPFLSKTHQMVEEPGTDEVISWAEQGRSFVVWKPVELARDLLPLHFKHCNFSSFVRQLNTYGFRKVVPDRWEFANENFRRGEQGLLSGIRRRKSTTPQPSKYGGGSVVNTAFPPPLPFPPPASVTTSGGGGGAGAGNERSSSSASSPPRTDDLTSENEQLKKDNRTLSTELAQARRHCEELLGFLSRFLDVRQLDLGLLMQEDVRAGAGDDAAPRRAMVSQLERGGEEGKSVKLFGVLLKDAARKRARCEEAAASERPIKMIRIGEPWIGVPSSGPGRCGGGN

SEQ ID NO: 1090 - protein, 220 aa, Zea mays
MSVETERSSTESSGASGLDFEDTALTLTLRLPGSAPSAAAAAAASLSLSSSSSSAFPDPDRKRASSDADPGRSSPLAASSDAAPAPKARVVGWPPVRSYRKNALADAAGSGKAAKFVKVAVDGAPYLRKVDLQAYAGYDQLLRALQDKFFSHFTIRKFADDERKLVDAVNGTEYVPTYEDKDGDWMLVGDVPWKMFVETCQRLRLMKGSEAVNLAPRAAR

SEQ ID NO: 1091 - protein, 229 aa, Zea mays
MAWRGPLGAGEEALDSGLELSLGLPAYFARPSGLDAAREEPAEASAYAIQAASGSNVSKARVRPAGAAPVVGWPPVRSFRRNLAASSSRPSSGKHTRQEGSAKDGLFVKINMDGVPIGRKVDLTAYGGYADLSAAVGKLFRGLLAAQRDRAATAGGEEEEEGEGPVIGGDYTLVYEDDEGDRVLAGDVPWEMFVATAKRLRVLKSSDVPASSVTLGAGGPERSAADCCC

SEQ ID NO: 1092 - protein, 203 aa, Zea mays
MGRGRVELKRIENKINRQVTFAKRRNGLLKKAYELSVLCDAEVALIVFSNRGKLYEVLQNSRNEYLKLKAKVDNLQRTQRNLLGEDLGSLGVKELDQLEKQIDSSLSHIRSTRTQHMLDQLTDLQRREQMMCEANKCLRRKLEETSNQVHGQVWEHGANLLLGYERHSSPQQAPSHVGNGLFFHPLEAAAEPTLQIGFAPEHM

SEQ ID NO: 1093 - protein, 245 aa, Zea mays
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKEKSLQEENKVLQKELAEKQKDQRQQVQRDQTQQQTSSSSTSFMLREAAPTTNVSIFPVAAGGRVVEGAAAQPQARVGLPPWMLSHLSC

SEQ ID NO: 1094 - protein, 223 aa, Zea mays
MVRGKTELKRIENATSRQVTFSKRRNGLLKKAFELSVLCDAEVGLVVFSPRGKLYEFASAASLQKTIDRYRTYTRENVNNKTVQQDIQQVKADAVSLASRLEALEKTKRMFLGENLEECSIEELHNLEVKLAKSLHVIRGKKTQLLEQQISKLKEKERTLLQDNKELRDKRNLQSPPEAPPDLNRCVPPWPRSLPAPSNDMDVETELYIGLPGRERSSNRDSD

SEQ ID NO: 1095 - protein, 226 aa, Zea mays
MGRGKIEIKRIENATNRQVTYSKRRTGIMKKARELTVLCDAQVAIIMFSSTGKYHEFCSPGTDIKTIFDRYQQAIGTSLWIEQYENMQRTLSHLKDINRGLRTEIRQRMGEDLDSLDFDELRGLEQNVDAALKEVRHRKYHVISTQTDTYKKKVKHSHEAYKNLQQELGMREDPAFGYVDNTGAGVAWDGAAALGGAPPDMYAFRVVPSQPNLHGMAYGFHDLRLG

SEQ ID NO: 1096 - protein, 251 aa, Zea mays; identical to SEQ ID NO: 865

SEQ ID NO: 1097 - protein, 209 aa, Zea mays
MGRGKIEIKRIENSTNRQVTFSKRRNGILKKAREISVLCDAEVGVVVFSSAGKLYDYCSPKTSLSKILEKYQTNSGKILWGEKHKSLSAEIDRIKKENDTMQIELRHLKGEDLNSLQPKDLIMIEEALDNGLTNLNEKLMEHWERRVTNTKMMEDENKLLAFKLHQQDIALSGSMRELELGYHPDRDLAAQMPITFRVQPSHPNLQENN

SEQ ID NO: 1098 - protein, 245 aa, Zea mays; identical to SEQ ID NO: 1093

SEQ ID NO: 1099 - protein, 354 aa, Zea mays
MGKKKKRVDKVFCYYCDREFDDEKILVQHQKAKHFKCHVCHKKLSTASGMAIHVLQVHKESVTKVPNAKPDRESTEIEIFGMQGIPAHVLAAHYGEEEDPSTKVPKVEVPQVRPVIMPNSLGMAFPPRPAYGVAPPIYNPALNPLMARPPIWPAAPAQAWYPQQAAYPQQSAVSVPPIVAGLPPQQPLFPIQNVPTPMTSAAANVLQTSFPMAPPGVPSPVAPHVSQPLFPVNTSAVNGAVNSPFLASVAPGTIPASSSAAVGVAGIGYGTNNQGTRDPAVGSSPAVSNNKASGAQPATNEVYLVWDDEAMSMEERRLSLPKYQVHDETSQMNSVDAAIDRRISESRLAGRMAL

SEQ ID NO: 1100 - protein, 204 aa, Zea mays
MSFTGTQDKCKACDKTVHIIDLLTADGVSYHKTCFKCSHCKGVLSISSYSSMDGVLYCKTHFEQLFKETGTFSKNFQGGASSNKNDQAKAPSKLSSAFSGTQDKCAACQKTVYPLEKMTLEGESYHKSCFKCSHGGCILTTSSYAALNGVLYCKIHFSQLFKEKGSYNHLIETAQTKKNEAAEAGPEPPADAGAAEPEAPAQSA

SEQ ID NO: 1101 - protein, 286 aa, Zea mays
MGAPKQRWTSEEEAALRAGVARHGVGNWRMILNDPELSSTLRYRSNVDLKDKWRNMNVIVTSSSTRDRGRTSTRRTRAAPKNNDQLLAMSTITSEVDDEIVDVKPIVSMSVEGWNTSNSKKSHSRLDNIIMEAIKNLNEPTGSHRTTIANYIEEQYWPPSDFDHLLSAKLKYLATSGKLLKVNRKYRIAPSLLEDVQREPLKLGSDASRTLTRSQVDAELVRMATMTVEAAAAAAAHAVAEAEAIMAEAEAAAREAEAAEAEARAAQAFAEAAVLTLKNRNAAKLV

SEQ ID NO: 1102 - protein, 278 aa, Zea mays
MGRQPCCDKVGVKKGPWTAEEDQKLVGFLLTHGHCCWRVVPKLAGLLRCGKSCRLRWTNYLRPDLKRGLLSDDEERLVIDLHAQLGNRWSKIAAQLPGRTDNEIKNHWNTHIRKKLVRMGIDPVTHLPLQEPPAPAPAPAEQQEQSHRQQEELQLQELQNGRELIMQEGAGEDDITPMIQPHEIMPTAAAASNCGSVSSAHAGSASVVSPSCSSSAVSGVEWPEPMYLLGMDGIMDADWGSLFPDTGAGGGGGGFDLGVDPFDQYPGGGFDQEDDHRI

SEQ ID NO: 1103 - protein, 302 aa, Zea mays
MGSEADCDRIRGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRKLAAASAPAGSSDVDARPTKRVSLSPDSPSGSGSGSGSGSGSDRSDLSHGAGQVYRPVARSGGFEPADCAMSRPLEEEEEEKEDPLTSLSLSLPGTDQRFHHDRAHSQFQELPASPPSPSPPPPPAGPTSAYPFSPVFMEAMQELIRTEVQRYMASVGVRAGCGAAGGADLCMPQLVDGVMRAAAERVGRMQ

SEQ ID NO: 1104 - protein, 356 aa, Zea mays; identical to SEQ ID NO: 811

SEQ ID NO: 1105 - protein, 475 aa, Zea mays
MPRSGGGGNGGGISSSSRVMPNLPAGFRFHPTDEELMVHYLMRQAASMPCPVPIIAEVNIYQCNPWDLPAKALFGDKEWFFFSPRDRKYPNGARPNRAAGSGYWKATGTDKAILSSSTPTSHGGANIVVGVKKALVFYGGRPPKGTKTDWIMHEYRLSGAADDDCKGSTRRRVSSSSSSSMRLDDWVLCRIHKKSNDFQLSSSSEHEHEQEEPAAGGSATTVEELDALVVVDNSSSSDTTTTTITTNDNNSTETAATHHDPQTMMMLSKSCSLTDLLDSIDYAALSSQMLLLDAPHPHADDPPPHMVYYPPAASATHQQAIIANNTNSNDDYYDDDNLLPTAAATAVDAAAAAVLLSSSPADTNGVNKRKRVTAVDYYGAAEPPTFFHHHLDDGGNSFFSTTKKLKPPPPSDSRHGGHFGTATASSYRDSQQLVDSASSSGVFFHQYGYGYSSSNPFLNLNQQQQLLLNSHIGMQ

SEQ ID NO: 1106 - protein, 174 aa, Zea mays
MAMATSASYPPPPPFYRLYKNFEQDPSSAPEPPPPIDEPFKALGVDYTGDVVIPSLESHNVRQLYPKGPNIDFKKELRTLNRELQLHILELADILVERPSQYARRVEDITLIFKNLHHLLNSLRPHQARATLIHMLESQIRHRKEAIEDIKQRREEAQKVLGESLLILDGSQTN

SEQ ID NO: 1107 - protein, 143 aa, Zea mays
MPVPLAPYPAPPAPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCSFVTSVGTSPGAEQKPSS

SEQ ID NO: 1108 - protein, 241 aa, Zea mays
MASCGAGDAASAQPRASISHVIFDMDGLLLDTEGFYTEVQEKILARYDKVFDWSLKAKMMGKKAAESARIFVDECGLNGLLTPEQFLEERESMLQALFPSCTKLPGVLRLVHHLHANGVPMAVATGSHKRHFALKTQNHQEMFSLMHHVVMGDDPEVKAGKPSPDIFLAAMRRFEGGVEPSKCLVFEDAPSGVAAAKNAGMSVVMVPDPRLDVSYHKGADQVLSSLLDFKPAEWGLPAFKE

SEQ ID NO: 1109 - protein, 401 aa, Zea mays
MYSPSMSAAAVNIYIPQTQSFGLGSVLPPSLHNQVSTGIIDESSSSVNFGDSAIGFMKRKNAVVAGSHNFLHGFAGSSSSVHVPQNPVHGAWNPSSQSNCLPSSAASNLPEYHNSNGWPYLEESSADASNSFSSVAACPELAPHGNYLYPACHISQSNTWVPQPAGYGVPQWGYSNAVVNPPDMSNGPLPHFCQNSMQAPQIQVPHQQSIGNNVVHGLNPSATGLPLHPRMLALPFNAEHTFGHPMHPPLINQANNGALRILPYQNATVMDHSRIYEAGHVIDEHSDMRLDVDNMTYEELVALQEQIGDVNTGLTESYIQENLRSSFHVPGAASMSDQFSELSLENDACIICQEEYKAKELIGTLECGHKYHVNCIKQWLMMKNLCPICKTTALSSDRRNG

SEQ ID NO: 1110 - protein, 324 aa, Zea mays
MSATATDEAAVEARLQELRGRLGKKQHFEEAVNELAAAVRDRYAGASPALRKAMYSTVCRVATVLQTRYTAPGFWHVGLNLFVGIEKLVSNPAEKEHLKTCISRAREHLDEKENEDSVPSNREADTRFLFEGHLTVGQEPPPPAWLVAQNLTRELSILTESSGDQDGSNNRTVPRAEEITPAIMNLLETISGDRDLETALEESLQGIIEYPQRAPPASKEVVANLPVIAVTEEVMSRLGSETECAVCRENLVVDDKMQELPCKHLFHPLCLKPWLDENNSCPICRHELRTDDHVYESRKEREREEEEDRRGAANAVRGGEFIYI

SEQ ID NO: 1111 - protein, 293 aa, Zea mays; identical to SEQ ID NO: 1004

SEQ ID NO: 1112 - protein, 484 aa, Zea mays
MGLLGMMGDSFGCSATGERLVSAARDGDIQEARALLELNPRLARYSTFGIRNSPLHYSAAKGHHEIVSLLIESGVNINLRNCRGQTALMQACLYGHWKVVQILVLFKANIHRRDCFSGATAIHFAALKGHTRCIRLLVADYVPSLSEFWTIMRGKSTDEMKKGAFDAASLQRLVNGKSDGGVTPLHLAALHGHAESVQLLLDLGASVSEVTVNDGSTIDLIGSGSTPLHYAACGGSAVCCQLLIAAGANMGAQNVNGLTPLLVARSWHKTSIEGILSKQPENRMRILPSPYLCLPLMSIVKIARECGWRKTSASSTCQDPCVICLEVECTVAAEGCGHEFCTKCALYLCSTTSSSTSTRGVPGSISCPLCRHAIVSFMRLTSTTPIKELPWTSASLALCAAGSNTGRPEHGGSLHRRPDLRRLRSISVQLGCSSFRSIGSGKLSSMKLNCTGAEEAVPCLVSCLRPDVQRSSSYRGRIRRYSEF

SEQ ID NO: 1113 - protein, 407 aa, Zea mays
MASLCDFCGKQRSMIYCRSDAASLCLSCDRNVHSANALSRRHTRTLLCDRCGSQPASVRCLEDNASLCQNCDWNGHDAESGASGHKRQAINCYSGCPSSAELSRIWSFITDIPTVAAEPDYEDGLSMMTIDGSDVTNRHDTSDDKRLLEIANTTLMSDPPSADKLKSPTGSSSGDGFDVMTLATDQPAGPVSATPKVPNARDDDKFNDGMYEDLCVDDADLTFEDYEELFGTSHIRTEELFDDAGIDGYFELKETPPFYFNEQPKAMQIECGNVVSADCAMSNPGARADSSLCIPVRQVRSSISHSLSGLTGESSAGDHHDCGVSPMLLMGEPPWHSPGGPEGSVAGGSRDSALTRYKEKKKRRKFDKKIRYASRKARADVRKRVKGRFIKAGEAYDYDPLSQTRSY

SEQ ID NO: 1114 - protein, 554 aa, Zea mays
MADTPTSRMVHPFGDVPRQTPKQFLYSGNPQHLCHPYQSAPDTHVVPQRRYTVRSQSHSPNNAGSQDHETHKQYTLESSAASGCSRHGSPSSQSVHAGSGSPVSHDDSHSGSTNGHGSPVSASCVTGEDPTDLKQKLKDLEAVMLGTSETDPEIVNSLEISAANQLSLEPEEWEHMVSMPRGNLKELLIACARAVERNNSYAIDLMIPELRKMVSVSGEPLERLGAYMVEGLVARLAASGSSIYKALKCKEPRSSDLLSYMHFLYEACPYFKFGYMSANGAIAEAIKGEDRIHIIDFHIAQGAQWVSLLQALAARPGGPPFVRVTGIDDSVSAYARGGGLELVGRRLTHIAGLYKVPFQFDAVAISGSEVEEEHLGVVPGEAVAVNFTLELHHIPDETVSTANHRDRILRLVKGLSPKVLTLVEQESNTNTAPFAQRFAETLDYYTAIFESIDLALPRDDRERINIEQHCLAREIVNLVACEGEERVERHEVFGKWKARLMMAGFSPSPLSALVNATIKTLLQSYSPDYKLAERDGVLYLGWKNRPLIVSSAWH

SEQ ID NO: 1115 - protein, 368 aa, Zea mays
MDRELLETFDAAKKAADAAAGDGNSPEAGRCLDALRRLRDIRVNTDILVSTQVGKRLRPLTKHPHSGIQAVAADLFGYWKKVVLEESGKKNGGSENERSSDSSGKVEKARPVKIEKNSASASMKLEKRDVDVTGQKPNNAKVEKTTSNGSKAQSVKVERISKEVIRTPDAKRPASVPNGHPKLTSLVKCNDPTRDKIRELLAEAFVRVSRETSDDDRDEVRNILDEVEACDPYRVAVTVESALFERLGPSTGTHRAKYRSIMFNLRAENNTDFRRRVLIGLVAPERLPGIPPDEMASDARKQENMQIKEKALFDCERGAAPKATTDQFKCARCGQRKTTYYQLQTRSADEPMTTFVTCVNCNNHWKFC

SEQ ID NO: 1116 - protein, 259 aa, Zea mays
MRIQCDACEAAAATVVCCADEAALCARCDVEIHAANKLASKHQRLPLGDAAALPASLPRCDVCQERPAFIFCVEDRALLCRDCDEPIHVPGTLSGNHQRYLATGIRVGFSSVCGASAEGLPPAPPKGSSKPAAVISAPAAGTTTKTRTVKDALPQEVPSSPFLPPSGWAVEDLLELSDYESSDKKDSSLGLKELEWFEDIDLFHAHSPAKTAMAEFFASPQPVSNAGFYKANGARLFKKSRMEVPDDDDEDYFIVPDLG

SEQ ID NO: 1117 - protein, 448 aa, Zea mays
MGQKDSKPSHGYGYSSYDYGSASSGYTSRNTGNSSSSYSVRYAPSSENSVQPETHARLQRKYSKIGDDYRSLSQVTEALAQAGLESSNLIVGIDFTKSNEWTGKISFNRRCLHDIGNTPNPYEQAISIIGRTLSAFDEDNLIPCFGFGDASTHDQEVFSFYPENRPCNGFEEALDRYREIVPTLRLAGPTSFAPMIETAIGIVDSTGGQYHVLLIIADGQVTRSVDTQSGQLSPQERATIDAIVRASQFPLSIVLVGVGDGPWDMMHQFDDNIPARSFDNFQFVNFTEIMSKSIAADRKEAEFALSALMEIPTQYKATIDLQLLGRRQRITPRIALPPPTRTAYSRSSSFSQQSGVYSRSSSFDQQTSGASQQRSESLKQQKKPAATKRPDTYASERALEDRILCPICMYKSKDLAFGCGHQTCYECGRNLERCPLCQQNITTRIRLY

SEQ ID NO: 1118 - protein, 411 aa, Zea mays
MGQKDSKPSHGYGYSSYDYGSASSGYTSRNTGNSSSSYSVRYAPSSENSVQPETHARLQRKYSKIGDDYRSLSQVTEALAQAGLESSNLIVGIDFTKSNEWTGKISFNRRCLHDIGNTPNPYEQAISIIGRTLSAFDEDNLIPCFGFGDASTHDQEVFSFYPENRPCNGFEEALDRYREIVPTLRLAGPTSFAPMIETAIGIVDSTGGQYHVLLIIADGQVTRSVDTQSGQLSPQERDTIDAIVRASQFPLSIVLVGVGDGPWDMMHQFDDNIPARSFDNFQFVNFTEIMSKSIAADRKEAEFALSALMEIPTQYKATIDLQLLGRRQRITPRIALPPPTRTAYSRSSSFSQQSGVYSRSSSFDQQTSGASQQRSESLKQQKKPAAPKRPDTYASERALEDRIVSVPHLHV

SEQ ID NO: 1119 - protein, 423 aa, Zea mays
MERYSDMRPKAEVSYLGRGSRFSSRNQSSEERTNHSSDKPGSSTRFNPTKARIGGNQGRPRYVCDSFKSPSSKVSPAGSSKFPLSKFEERRRQPFVPGFDIAESSRRKADAKQLQGSKKIAAENDSSDNLRGESEGFTTEQVVKPEGSHVVGHSGVSAYTVGSLVQTASLGSRTHRQKHKEVNLGTPGASSSTLTNRSTIPGNSTMGVRPAYGHVNGGQIHGLKNLGCSSVPDAQPSGCPSESVISRRRFEFMRKRAFDQESSSRSVNLSLGHSTPTDIRRIRMNEQSLCQQIPRSSSRSHQESAGSVRTRRPSPHATRMSVPDGRADGVLSLHESSTKDVQPAQEHLSLEEVSTESSIRPFFVEFDNNIFSSSHLRRSSTRAERGRPSSLFEESPRQMFHSLMGERDRHRHITMEGITEVAF

SEQ ID NO: 1120 - protein, 358 aa, Zea mays
MDGSRKRVDAEDVKGDSTGGKRLRASESFQSGVGSKVKLCTNFFSTYGCPFGEGCHFVHYFPGDYRAVSEMTNLGGATIAPPGGMMMDGPPTPIVKTRLCNKYNTAEGCKWGDRCHFAHGESELGKSMMDNYMPPPIGPPPTGYFAPPPMAPPPMAPPPMAPPPMAPLPMAPPPMAPPPMAPPPMAPPPMAPLPMAPPPMAPPPMAPPPMAPPPMAPLPMAPPPMAPPPMANPGLATPASFGAYATAKISVDASLAGGIIGKGGANIKQISSVTGAKVVIQEDRHESDTSLKNIEFEGTFDQIRNASAMVIELIVSISGIGSNFKTKMCENFAKGSCSYGGKCHFAHGESELRKPAAA

SEQ ID NO: 1121 - protein, 226 aa, Zea mays
METVVGDLMATELRLGLPGTVDDCSQPQLVKATPPSTPRGKRRATADAVEEAAGAEEASKRDAETAPPAAKAPVVGWPPVRSYRKSCFQQASSKQAAAAKQEAAAAAPGCTASSAAATNTTSSSSAAVVVGSFVKVSMDGAPYLRKVDLRMYRGYRELREALEALFVSSSSANNLSEFAVTYEDKDGDLMLVGDVPFEMFASTCKKLRIMKRSEATGLGSSSARQQ

SEQ ID NO: 1122 - protein, 205 aa, Zea mays
MRTICDVCESAPAVLFCAADEAALCRPCDEKVHMCNKLASRHVRVGLADPNKLARCDICENSPAFFYCEIDGTSLCLSCDMTVHVGGKRTHGRYLLLRQRVEFPGDKPGHMDDVPMEIKDPENQREQNTPKEQMANHHNVNDPVSDGNCDGQGNIDSKMIDLNMRPARTHGQGSNSQTQGVDLSVNNHDSPGVVPTSNSERDAIK

SEQ ID NO: 1123 - protein, 103 aa, Glycine max
MASETASSADEETVVVVSAAAGAGGTDKRGKHRILAELKRLDQESKFLQEELEELEKTENVSTICTELLQNIDTRPDPLLPEVHGPVNLLWDRWFEGPQDPQA

SEQ ID NO: 1124 - protein, 244 aa, Glycine max
MGRGRVQLKRIENKINRQVTFSKRRSGLLKKAHEISVLCDAEVALIVFSTKGKLFEYSSDPCMERILERYERYSYAERQLVASDQPQTENWTLEHAKLKARLEVLQKNQRNFMGQDLEGLSIKELQNLEHQLDSALKHIRSRKNQIMHESISELHKKDKVLQEQNNTLAKKIKEKEKALAQHAQMEQRGDEMDLTSSALVPHPLETSNIRESSQIRGEGDNEGTPTPTRANAILPSWMLRPSNE

SEQ ID NO: 1125 - protein, 239 aa, Glycine max
MGRGRVDLKRIENKINRQVTFSKRRSGLLKKAREISVLCDADVALIVFSTKGKLFDYSNEPCMKRILERYERYSYAERQLAGDDQAPNENWVIEHEKLKARVEVLQRNQRNFMGEDLDSLNLRGLQSLEQQLDSALKLIRSRKNQAMNESISALQKKDKSLREHNNLLSKKIKDKEKELAPQEQDGLQNNMDVTSVLVTQPPESLTIGGFPEAKCNEETPTSSRPKTILPPWMPLPTNE

SEQ ID NO: 1126 - protein, 245 aa, Zea mays
MGRGKVQLKRIENKINRQVTFSKRRSGLLKKAHEISVLCDAEVALIIFSTKGKLYEYSTDSCMDKILDRYERYSYAEKVLISVESETQGNWCHEYRKLKAKVETIQKCQKHLMGEDLETLNLKELQQLEQQLESSLKHIRTRKSQLMLESISELQRKEKSLQEENKVLQKELAEKQKAQRKQVQWGQTQQQTSSSSSCFMIREAAPTTNISIFPVAAGGRLVEGAAAQPQARVGLPPWMLSHLSS

SEQ ID NO: 1127 - protein, 266 aa, Zea mays
MGRGKVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLESSLKHIRSRKSHLMAESISELQKKERSLQEENKALQKELAERQKAVASRQQQVQRDQQTHAQAQTSSSSSSFMMRQDQQGLPPPHNICFPPLTMGDRGEELAAAAQQQPLPGQAQPQLRIAGLPPWMPSHLNA

SEQ ID NO: 1128 - protein, 266 aa, Zea mays
MGRGKVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLESSLKHIRSRKSHLMAESISELQKKERSLQEENKALQKELAERQKAVASRQQQVQWDQQTHAQAQTSSSSSSFMMRQDQQGLPPPHNICFPPLTMGDRGEELAAAAQQQPLPGQAQPQLRIAGLPPWMLSHLNA

SEQ ID NO: 1129 - protein, 424 aa, Arabidopsis thaliana
MDPEGFTSGLFRWNPTRALVQAPPPVPPPLQQQPVTPQTAAFGMRLGGLEGLFGPYGIRFYTAAKIAELGFTASTLVGMKDEELEEMMNSLSHIFRWELLVGERYGIKAAVRAERRRLQEEEEEESSRRRHLLLSAAGDSGTHHALDALSQEDDWTGLSEEPVQQQDQTDAAGNNGGGGSGYWDAGQGKMKKQQQQRRRKKPMLTSVETDEDVNEGEDDDGMDNGNGGSGLGTERQREHPFIVTEPGEVARGKKNGLDYLFHLYEQCREFLLQVQTIAKDRGEKCPTKVTNQVFRYAKKSGASYINKPKMRHYVHCYALHCLDEEASNALRRAFKERGENVGSWRQACYKPLVNIACRHGWDIDAVFNAHPRLSIWYVPTKLRQLCHLERNNAVAAAAALVGGISCTGSSTSGRGGCGGDDLRF

SEQ ID NO: 1130 - protein, 345 aa, Zea mays
MISFNNLFWSSLQPSFKFYRKCLTNCPYFALTMHSTTKPLGSSMPVKRAHLKPHAADIKRNPHVHELYKLVYRLPENLSWLLAPPEIPKRPASKKKKQKDEIVAGNSFGVILEWEGVVVDDDDPDLEPRVWYVLSLEEGKSFPPDALLKKIEGMRTDQAIAEVLCWSEDPAEIQRLATHKEVIYQKLQGGYYQLRPHVLDFLNTLVGFDIPIAIAAPRSRKSLEEGIKTVGLQGYFDAIVALEDFCLGKPDGEMFEVAAEQLGLEPDACVVFGNSNLTTESAHNAGMRCVAVAGRHPAYELQSANHVVRWLDQLSIVDLQRLANGEVIGRRGRESDMDMEIVIEE

SEQ ID NO: 1131 - protein, 377 aa, Glycine max
MVESIAATSLLGHRPICGGNLTRDVSVKRKSLNTVRFPTTEFLGGGRIVVSLALPKSDKQDRFVFSSIKALAVELTREAHAYREEKLPNRDTKIDRGFDQRPDSWPPANRADKPSLRNPLLRHERMGCGWLGAIFEWEGVLIEDNPDLEKQAWLALSQEEGKPSPPAFILKRIEGMKNEQAISEVLCWSRDPAQLRRMANRKEEIYQSLQGGIYRFLSGSKEFVSVLMHYKIPMALVSTRPRKALESAIGEIGIEDTFSVIVAAEDVHRGKPDPEMFVYAAQLLNFIPERCIVFGNSNLTVEAAHEARMKCVAVASKHPVYELGAADLVVRRLDELSVVDLKNLADIEMTEFGSVEPEMELEVEKDYGSSSVDDNFW

SEQ ID NO: 1132 - protein, 350 aa, Oryza sativa
MIFSVSLFGSSHQSIHKLYRKCWSSNSHSTLNVLSLAKTVGQSMRMKRIRVKPHATDLKNRPQAHEDNVFYKLVYRLPENLSWLLASPEMARRPPSKKKLKKEEMVSSNQFGVILEWEGVVVEDDDPDLEPRVWYVLSLEEAKSFPPDAVLKEIEGMRTDQAILEVLHWSEDPQEVQRLAARKEVIYKTLRGRFYQLRPGVLDFLNTLVDFDIPIAITTPRPRLSLEEGIKAVGLQGYFDAIVAAEDFCRGKPEGEMFEVTAGQLGLEPDVCLVLGNSNSTIESAHTAGMRCVAVASRYPAYELQAANHVVRWLDQLSVADLQRIANGEILGLRGRRSDMDMDMEIVIEE

SEQ ID NO: 1133 - protein, 124 aa, Glycine max
MEDLKEKVNEGEPTQIKYRGVRRRPWGKFAAEIRDSARHGARVWLGTFNTAEEAARAYDRAAFEMRGATAILNFPDEHPPCNVTSLSKKSSSSNTEIGKQVVVFECLDDKLLEELLDCDGENHQ

SEQ ID NO: 1134 - protein, 474 aa, Zea mays
MNLAVAAALPSVTPRTGVVLPRSSRRHCPRGVVPRAASSSVSSFTSPSAAAAPIYTPTPQDRSLRTPHSGYHFDGTARPFFEGWYFKVSIPECRQSFCFMYSVENPLFRDGMSDLDKLLYRPRFTGVGAQILGADDKYICQFSEKSNNFWGSRHELMLGNTFISNKESTPPQGEVPPQDFSRRVLEGLQVTPIWHQGFIRDDGRSNYVPNVQTARWEYSTRPVYGWGDVKSKQLSTAGWLAAFPFFEPHWQICMARGLSTGWIEWDGERFEFENAPSYSEKNWGGGFPRKWYWIQCNVFPGASGEVSLTAAGGLRKIGLGDTYESPSLIGIHYEGQFFEFVPWTGTVSWDIGLWGLWKMSGENKTHLVEIEATTAESGTALRAPTIEAGLVPACKDTCYGDLRLQLWEKKYDGSKGEMILDATSNMAALEVGGGPWFNGWKGTTVVNEVVNNIVGTPVDVESLLPIPFLKPPGL

SEQ ID NO: 1135 - protein, 422 aa, Oryza sativa
MVAAPVYAPTPRDRALRTPHSGYHYDGTARPFFEGWNFKVSIPECRQSFCFMYFCLKPFVIWNRFIHGSRFTGVGAHILGAFDKYICQFTEKFNNFWGSRHELMLGNTFIPNNGSTPPEGEVPPREFSSRVLEGFQVTPIWHQGFIRDDGRQSKYVPNVQTARWEYSTRPVYGWGDVTSKQKSTAGWLAAFPFFEPHWQICMAGGLSTGWIEWDGERFEFENAPSYSEKNWGAGFPRKWYWVQCNVFSGAFGEVALTAAGGLRKIGLGETYESPSLIGIHYEGKFYEFVPWTGTVSWDIAPWGHWKLSGENKNHLVEIEATTKEPGTALRAPTMEAGLVPACKDTCYGDLRLQMWEKRNDGGKGKMILDATSNMAALEVGGGPWFNGWKGTTVSNEIVNNVVGTQVDVESLFPIPFLKPPGL

SEQ ID NO: 1136 - protein, 488 aa, Arabidopsis thaliana
MEIRSLIVSMNPNLSSFELSRPVSPLTRSLVPFRSTKLVPRSISRVSASISTPNSETDKISVKPVYVPTSPNRELRTPHSGYHFDGTPRKFFEGWYFRVSIPEKRESFCFMYSVENPAFRQSLSPLEVALYGPRFTGVGAQILGANDKYLCQYEQDSHNFWGDRHELVLGNTFSAVPGAKAPNKEVPPEEFNRRVSEGFQATPFWHQGHICDDGRTDYAETVKSARWEYSTRPVYGWGDVGAKQKSTAGWPAAFPVFEPHWQICMAGGLSTGWIEWGGERFEFRDAPSYSEKNWGGGFPRKWFWVQCNVFEGATGEVALTAGGGLRQLPGLTETYENAALVCVHYDGKMYEFVPWNGVVRWEMSPWGYWYITAENENHVVELEARTNEAGTPLRAPTTEVGLATACRDSCYGELKLQIWERLYDGSKGKVILETKSSMAAVEIGGGPWFGTWKGDTSNTPELLKQALQVPLDLESALGLVPFFKPPGL

SEQ ID NO: 1137 - protein, 363 aa, Nostoc sp. PCC 7120
MRSPTMFKTLQTPHSGYHWDGSSRRFFEGWYYRVTLPDCGQTFAFMYSIEDPIGGKAYSGGAAQVLGADDEYICRTFPDVNKFWASPDVLALGHWGETNLNTKPIYLLPAEFERHVQQGYQATATINQGIIADPATGNYCRWRYEIQPIYGWGNQDGIQQSTAGWLSFLQIFEPGWQILMAHGLATGWIDWNGKIYQFQNAPAYGEKNWGGAFPEKWFWLNCNSFDGEPDLALTAGGGRRGVLWWMESVAMIGLHYQGKFYEFVPWNSKVEWNIQPWGRWQMKAKNLDYEVELTGTTHLPGTDLRAPTVQGLQYCCRDTMQGKLDVELRQIRGKNPLVILKAHSYLCGLEIGGDSWSNSWQSS

SEQ ID NO: 1138 - protein, 363 aa, Synechocystis sp. PCC 6803
MKFPPHSGYHWQGQSPFFEGWYVRLLLPQSGESFAFMYSIENPASDHHYGGGAVQILGPATKKQENQEDQLVWRTFPSVKKFWASPRQFALGHWGKCRDNRQAKPLLSEEFFATVKEGYQIHQNQHQGQIIHGDRHCRWQFTVEPEVTWGSPNRFPRATAGWLSFLPLFDPGWQILLAQGRAHGWLKWQREQYEFDHALVYAEKNWGHSFPSRWFWLQANYFPDHPGLSVTAAGGERIVLGRPEEVALIGLHHQGNFYEFGPGHGTVTWQVAPWGRWQLKASNDRYWVKLSGKTDKKGSLVHTPTAQGLQLNCRDTTRGYLYLQLGSVGHGLIVQGETDTAGLEVGGDWGLTEENLSKKTVPF

SEQ ID NO: 1139 - protein, 365 aa, Nostoc punctiforme
MLTIPLNFLQSTQTPHSGYHWDGTSRRFFEGWYYRITLPEIEQTFAFMYSIEDPIGGKPHSGGAAQILGPDDEYLCRTFPDVKKFWGSRDVLGLGHWGKTDLQIAPLYLLPAEFEHHVQEGYQATATLNQGIIRELATNNYCRWEYEIQPIYGWGNKNSIQQSTAGWLSFSQIFEPGWQILMAHGLASGKIDWNGKIYEFTNVPAYGEKNWGGAFPQKWFWINCNCFEGEPDLALTAGGGRRGVLWWMESVAMIGLHYQDKFYEFVPWNSQVDWEIQPWARWQMKATNSNYEIELTGTTDLAGTPLRAPTAEGLRYCCRDTMQGKLTLELREINGRKSQIILKAESFLCGLEVGGGSWHNVWQSR

SEQ ID NO: 1140 - protein, 449 aa, Zea mays
MYRAKRAALSPKVKRRVGKYELGRTIGEGTFAKVRFAKNTENGEPVAIKILDKEKVKRHRLVEQIKREICIMKLVRHPNVVRLFEVMGSKARIFIVLEYVTGGELFEIIATNGRLKEDEARKYFQQLINAVDYCHSRGVYHRDLKLENLLLDAAGNLKVSDFGLSALTEQVKADGLLHTTCGTPNYVAPEVIEDGGYDGATADIWSCGVILFVLLAGYLPFEDDNIIALYKKISEAQFSCPSWFSAGAKNMITRILDPNPTTRITISQILEHPWFKKGYKPPVFDEKYQTSLDDVDAAFGDSEDRHVKEETEDQPTSMNAFELISLNQALNLENLFEAKEEYKRETRFTSQCPPKEIITKIEEAAKPLGFDVQKKKYKMRMENPKAGRKGNLNVATEVFQIAPSLHVVELKKAKGDTLEFQKFYRSLSTQLKDVVWKCDGEVDGNSAAA

SEQ ID NO: 1141 - protein, 788 aa, Zea mays
MEPSRGGVGGGGRRWGEAEGDAAEEGRRGEDGGEVSLREWLDRPGRAVEAAECVHVFRQVAEAVAVAHAQGVAVGSARPSCFVVSPPFARVAFIESASGSDASGSCSGSDASEDADGDPDPDPDASPPLRRRDSAVPGEERAGRSFPLKSVLAMELSWYTSPEDADDSAATFASDVYRLGVLLFELFYTFETMEDKMRAMANLRHRVLPPQLLFKWPKEASFCQLLMHPVPETRPKMSEVLQSEFLNQSRNSLEEHEAALRLREEIEEQELLLDFLQQLQKRKQDIADSLQGTIAFLSSDINEVPHQQSAIGHCENFLSDWDKEVCSGTVEEQSDCGSRKRFRPELQGVDMEENNRSVEECSRTVPSSELIQESVLSKSSRLMKNFKKLETAYFLTRSKLMKQVGSQISSCDRVVKNTTGSAVGTEGSSLDDFSLERQYGTRQRGWVNSFLEGLCKYLSFSKLKVQAELKHCDLLNSSNLVCSVGFDRDREFFATAGVNKKIKVFEYNMIVNEHRDIHYPVVEMSNRSKLSCICWNSYMKSHIASSDFEGIVQVWDVTRSQVFVGMREHERRVWSVDFSIVDPTKLVSGSDDGSVKLWDMNQAGSIGTIRTRANVCSVQFQPDTARSIAIGSADHKIYCYDLRNIRAPYCTLVGHTKTVSYVKYLDASTILSASTDNSLKLWDLSMNPGRIIDSPVQTFTGHTNTKNFVGLSISDGYIATGSETNEVFVYHKEFPMPVLAYKFSVTDPISGQEIDDQSQFISCVCWRGQSSTLLSANSSGNIKILEMD

SEQ ID NO: 1142 - protein, 592 aa, Zea mays
MGLCHGKPTQIPEAEAGEDPHVASGAGDSGDGPTSPSAAAPTAKPGTPKQPKFPFYLPSPLPPSSYKGSPANSSVASTPARGGFKRPFPPPSPAKHIRALLARRHGSVKPNEASIPEGGEPELGLDKSFGFSKHFFAKYDLGEEVGRGHFGYTCSAKAKKGEHKGQDVAVKVIPKAKMTTAIAIEDVRREVRILSSLTGHSNLVQFYDAFEDEDNVYIVMELCKGGELLDRILARGGKYSEEDAKVVMVQILSVVSFCHLQGVVHRDLKPENFLFSSKDENSPLKVIDFGLSDFVKPDERLNDIVGSAYYVAPEVLHRSYATEADMWSIGVIAYILLCGSRPFWARTESGIFRAVLKAEPSFDEAPWPTLTAEAKDFVKRLLNKDYRKRMTAAQALSHPWIRNSQQVKVPLDMIIYKLMRAYISSSSLRKSALRALAKTLTTDQLFYVREQFELLGPNKNGYISLQNLKSALAKNSTDAMKDSRVVDFVNTVCALQYRKLDFEEFAASAISVYQMEALETWEQHARRAYELFDKEGNRPIVIEELASELGLGPSVPLHVVLQDWVRHADGKLSFLGFIKLLHGVSSRSIPKA

SEQ ID NO: 1143 - protein, 229 aa, Zea mays
MAARRLGSPASRWLRPSALLLLVASALLSAPSPARALRFDLESGHTKCVSDEIKVNAMAVGKYHIVGPDPNSPDAQLPESHRISLRVTSPYGNSMHYAENVQSGHFAFTAAEAGDYLACFWAPDHKPPVTIGFEFDWRSGVSAKDYPSVAKKGKVDMMELELKKLEETIKNIHEEMLYLREREEEMQDVNRRTNSRMAWLGFLSLGVCLSVAGLQLWHLKTFFERKKLL

SEQ ID NO: 1144 - protein, 173 aa, Zea mays
MARVYVGNLDSRVTSGELEDEFRVFGVLRSVWIARKPPGFAFIDFDDRRDAEDAIRDLDGKNGWRVELSRNSSGRGGRDRYGGSESKCYECGETGHFARECRLRIGSGGLGSGRRRSRSRSRSRSRSRSRSRSRSPRYRRSPSYSRRSYSPRYRSPRRRSPSPTRARSYSRSP

SEQ ID NO: 1145 - protein, 550 aa, Oryza sativa
MAAPAAESAVVGVGVDSATSAAVRDGFAELERQQQLLATCTRLYQQLTEHFGSLERRLAARSETLRTKRRFLDVRTSRRLEALRRREASIDGSVSLALSRLDSLAKGDAGTTGSASADAAGIAEGLRSLCASMDSAGFFTFVVARRKEVDALRAELPDALKRCVDPARFAMDAVSEVFPIDKRAVRSPTDLAWACVLILEAVVPSLADPDPEIGAARPMVPQAARERARGMAREWKDAAEKKGGVEGAKPPDAHAFLQHVATFAVAEKEDKELYRRIVVSFSWRRQMPRLAITLGLEDEMDDIIEELITKGQQLDAVNFAYEAGLQEKFPPAPLLKAYLEDSKKIPSNSDNLSTSTGQSGSNANKKEQSALRAVIKCVEDHKLEAEFPLEDLRERLEELEKAKTEKKKAASSSSSGGSSGPANKRIRASTGGPMPPAKAGRLTDYTGTPSSPATTTTNATFIRSPSHASYGTASPYSYDRPAAHPLYCGQNTLAMREPYAYHHPSEVSSVGLGMSYPSPPMTYPAYAGYSNGIGYSNAMAPAFHHQAYYR

SEQ ID NO: 1146 - protein, 1049 aa, Oryza sativa
MLSGNLIKKVVMPPGAISLDDVDIDQVSVDYVLNCAKKGEALDLGDAIRLFHDSLDYPYVNNSGTVEEFFLLTKPEYSGPAPAREPPPVPAIAPSPVVIPAPIVDPPPVAVHSPVSTTNLSKSQSFDSPTEKELTIDDIEDFEDEEDEFDSRRASRRHQSDANDLSLRLPLFETGITDDDLRETAYEILVAAAGASGGLIVPQKEKKKEKRNKLMRKLGRSKSESTQSQTQRQPGLVGLLETMRAQLEITESMDIRTRQGLLNAMVGKVGKRMDNLLIPLELLCCISRAEFSDMKAYLRWQKRQLNMLEEGLINHPVVGFGELGRKVNELRNLFRKIEESESLQPSAVEVQRTECLRSLREVATSLSERPARGDLTGEIHYQLQEVEEILELLKSTWRILGITETIHDTCYAWVLFRQFVFTGEQGLLKVVIEHLRKIPLKEQRGPQERLHLKSLRSSVDAEDSFQDFTFFQSFLSPVQKWVDKKLNDYHLHFSEGPSMMADIVTVAMLIRRILGEENNKGMESPDRDQIDRYITSSVKSAFVKMAHSVEAKADTSHEHVLASLAEETKKLLKKDTTVFSSVLSKWHPQSAVVSASLLHKLYGSKLKPFLEHAEHLTEDVVSVFPAADALEQYIMSVMASVVGDDGLDSICRQKLAPYQIESKSGTLILRWVNGQLERIETWVKRAAEQETWDPISPQQRHGASIVEVYRIIEEVPMRTGELNSLCRGFDKAFQVYTQLVTGPIVDREDLIPPVPVLTRYKKELGIKAFVKKEIHEVRTVDERKASEIIQLTMPKLCVRLNSLYYGISQLSKLEDSINERWARRKSESINIRRSMSEKSKSAVSSQKNQFDGSRKEINAAIDRICEFTGLKVIFWDLQQPFIDNLYKNNVSQARLDAIMEVLDTVLNQLCNVIVEQLRDRVVTGLLQASLDGLLRVILDGGPTRVFSPSDATLLEEDLEILKEFFISGGDGLPRGTVENLVSRVRPVIDLIKQETRVLIDDLREVTQGAKSKFGTDSKTLLRVLCHRNDSEASHYVKKQFKIPSSAPAT

SEQ ID NO: 1147 - protein, 584 aa, Zea mays
MDLDARHRHTPDSSSSPHAASDMGLPLAGAAYQPYVSELLSFSIERLHKEPELLRVDAERVRRQMQEVAVENYGAFIAASEALSFVRAQLESFDGHLEAMIEEIPNLTSGCTEFVESAQQILEERKLNQTLLANHTTLLDLLEIPPLMDTCIRNGNYDEALDLEAFVSKISKLHPDLPVVQGLAAEVKKTVQSLISQLLQKLRSNIQLPECLRIVAHLRRIGVFSESELRLQFLRCREAWLSGILEDLDQRNVYDYLKGMVTCHRVHLFDVVNQYRAIFNNDKSGNDENSEGGLLFSWAMQQVSNHLATLQVMLPSITEGGSLSNILEQCMYCAMGLGLVGLDFRGLLPPIFEDAVLNLFSKNMSMAVENFQVVLDSHRWVPMPSVGFVANGVVDDTSDDVTPPSVLMEHPPLAVFVNGVSAAMNELRPCTPLSLKVVLAQEVVKGLHAVSDSLVRYKAMRMLRGNESALFLSLCQAFIEVVHPYCAACFGRCYSNGATLISECQGTLDAVRQLLTIPARSNSSSIERKQSGAIERKQSVESSGTAVTYNELSADGPGLEINDAATTTTPPVEDDVSTHPPGSK

SEQ ID NO: 1148 - protein, 415 aa, Zea mays
MGQMISGDKSDEQTARDDGIIKNGREILFQAFNWESNKHNWWSILEEKVTDLAESGFTSVWLPPPTQSLSREGYLPQNLYCLDSCYGSLHELKLLLHKMSEHNVRAMADVVINHRIGTTQGSNGMYNRYDGIPVSWDEHAVTSCSGGKGNKSTGDNFDGVPNIDHTQPFVRKDIIEWLIWLRKSVGFQDFRFDFTKGYAAKFVKEYIEESKPLFAVGEYWDSCEYSPPDYRLNYNQDIHRQRIINWIDNTGGLCAAFDFTTKGILQEAVKGELWRLRDSEGKPPGVMGWWPSRSVTFIENHDTGSTQGHWPFPSDHIMEGYAYILTHPGIPTVFYDHFYDQGVPLHDEIAKLMQIRKCQDIHSRSSIKILEVGSDLYSAIIDDKLCMKIGDGSWCPSDPEWRLAVSGDRYAVWHK

SEQ ID NO: 1149 - protein, 336 aa, Oryza sativa
MAGMDPGGGGAGAGSSRYFHHLLRPQQPSPLSPLSPTSHVKMEHSKMSPDKSPVGEGDHAGGSGSGGVGGDHQPSSSAMVPVEGGSGSAGGSGSGGPTRRPRGRPPGSKNKPKPPIIVTRDSPNALHSHVLEVAGGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEGEEEEVAAPAAGGEAQDQVAQSAGPPGQQPAASQSSGVTGGDGTGGAGGMSLYNLAGNVGGYQLPGDNFGGWSGAGAGGVRPPF

SEQ ID NO: 1150 - protein, 501 aa, Oryza sativa
MAASSADLADDGFPAPRLFSQGVSYTYDDVIFLPGYIGFPADAVDLSTRLSRRIPLSIPCVASPMDTVSEAAMAAAMASLGAAAVVHCNTEPHLQASIVRAAKSRRLPFVSSVPLFSPASTPSLSDFAGHDYGLVTERGDSLSKLVGVAVAAETSSRQAPLPVSEYMRPAPRSVSASFDFEQAAAFLADEGLDYAPLVSDDSEVIDLITVNDVERIRSYPKLGKPSLGADGKFVVAASIGTREDDKRRLEQLVKAGANAIVVDSSQGNSIYQIDMIKYAKKMYPEVDLIGGNVVTIAQAQNLVASGVDGLRVGMGSGSICTTQEVCAVGRGQATAVYKVASYAKDHNVPVIADGGISNSGHIVKALSLGASTVMMGSFLAGSHEAPGTYEYKDGHRVKKYRGMGSLEAMTKGSDARYLGDTLKLKVAQGVVGAVADKGSVLRFIPYTMQAVKQGFQDLGASSLQSAHELLRSETIKLEVRTGAAQVEGGIHGLVSYEKKAF

SEQ ID NO: 1151 - protein, 523 aa, Saccharomyces cerevisiae
MAAIRDYKTALDFTKSLPRPDGLSVQELMDSKIRGGLTYNDFLILPGLVDFASSEVSLQTKLTRNITLNIPLVSSPMDTVTESEMATFMALLGGIGFIHHNCTPEDQADMVRRVKNYENGFINNPIVISPTTTVGEAKSMKEKYGFAGFPVTTDGKRNAKLVGVITSRDIQFVEDNSLLVQDVMTKNPVTGAQGITLSEGNEILKKIKKGRLLVVDEKGNLVSMLSRTDLMKNQNYPLASKSANTKQLLCGASIGTMDADKERLRLLVKAGLDVVILDSSQGNSIFELNMLKWVKESFPGLEVIAGNVVTREQAANLIAAGADGLRIGMGTGSICITQEVMACGRPQGTAVYNVCEFANQFGVPCMADGGVQNIGHITKALALGSSTVMMGGMLAGTTESPGEYFYQDGKRLKAYRGMGSIDAMQKTGTKGNASTSRYFSESDSVLVAQGVSGAVVDKGSIKKFIPYLYNGLQHSCQDIGCRSLTLLKNNVQRGKVRFEFRTASAQLEGGVHNLHSYEKRLHN

SEQ ID NO: 1152 - protein, 488 aa, Escherichia coli
MLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLREVKELTERNGFAGYPVVTEENELVGIITGRDVRFVTDLNQPVSVYMTPKERLVTVREGEAREVVLAKMHEKRVEKALVVDDEFHLIGMITVKDFQKAERKPNACKDEQGRLRVGAAVGAGAGNEERVDALVAAGVDVLLIDSSHGHSEGVLQRIRETRAKYPDLQIIGGNVATAAGARALAEAGCSAVKVGIGPGSICTTRIVTGVGVPQITAVADAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCGTIDELRTKAEFVRISGAGIQESHVHDVTITKESPNYRLGS

SEQ ID NO: 1153 - protein, 501 aa, Agrobacterium tumefaciens
MARIIQTPTGLDALTFDDVLLQPGHSEVMPGQTNIATRIARDIDLNLPILSSAMDTVTEGRLAIAMAQAGGIGVIHRNLTPIEQAEEVRQVKKFESGMVVNPVTIGPDATLAEAQALMKAHGISGIPVVENGGAGGHKNGRLVGILTNRDVRFASDPQQKIYELMTRENLVTVKESSVDQQEARRLLHKHRIEKLLVVDGKGNCVGLITVKDIEKSQLNPNATKDAQGRLRAAAAISVGADAIERAERLIDAGVDLLVVDTAHGHSQRVLDAVAQVKKMSNSVRIIAGNVATADGTKALIDAGADAVKVGIGPGSICTTRIVAGVGVPQLAAVMAAVEAASLADIPVIADGGIKFSGDLAKAIAAGASAVMIGSLLAGTDESPGEVFLYQGRSFKAYRGMGSVGAMARGSADRYFQAEVRDTLKLVPEGIEGQVPYKGPVSGVLHQLAGGLKAAMGYVGGSNIKEFQERATFVRISSAGLRESHAHDVTITRESPNYPGAV

SEQ ID NO: 1154 - protein, 307 aa, Zea mays
MEGTAAARKRSRPETANGAAAAGKRSKDTESFQTGLSSKSKPCTKFFSTIGCPFGEGCHFLHFVPGGYPAVAKMLNLSSSAVSAPSRTHVDHAALTGASHPASTVKTRMCTKYNTTEGCKFGDKCHFAHSERELAKPAYMSQEGPPMGGRYGRAEPMQPAAMGPPAGNFGASATAKISVDASLAGGIIGKGGVNTKQISRITGVKLSIRDHESNPNLKNIELEGNFDQIKQASDLVRDLIATISASMPAKNPSAAAAPAGGGRGGGPGGKSSNYKTKLCENFLKGACTFGDRCHFAHGETEQRRGAA

SEQ ID NO: 1155 - protein, 676 aa, Zea mays
MRPEERDAAVGRVRDQFPVGMRVLAVDDDPVCLKVLENLLRRCQYHVTTTNQAVVALSMLRQNRDLFDLVISDVHMPDMDGFKLLELVGLEMDLPVIMLSVNGETKTVMKGITHGACDYLLKPVRLEELRNIWQHVVRRKFSNCDRANNDGYEECNRPSNADFDLAHSQITAGPPDQSGRPSKKRKEYHSEEEDEGEESNGQDNDDPSAPKKPRVVWSVELHRKFVAAVNQLGIDKAVPKRILELMNVERLTRENVASHLQKYRLYLKRLSAVASQQASIVAALGGNDPFMRMSAFEGLHGYQSFVSSAALPSFSPQGLLNRNNPASFAIQGVSASRPIQIATGNTTMSHSIGDPNNKYHLSLPGTSSLQGNLAQGLPTPVGQVQLPQKWIHEETDDLSTILSASGQANNGVPGTLQSVTNSHLLQQGFVERRQDKVVIQPSSSASSDRPEGTVGVSSSLMDSCASHQRVVPLSAFSSSAAPMNGSFCSNGVAELGAASSGGTSIFPSNDLRIERDSKVGASSFGSVILLSPDTVPNQKYLNFGGGSDLRPNMEGGNAGNLLNPKLLWSCLPASQPPNLIGSHHPMSQRLNLGGSMVRQTTASASAAAPQTRIDMFISGDAPKSASDLSFPKVHSELSSSSCSFDGLLNSIIKVEKDDASFSDDLGCDLYSLGACI

SEQ ID NO: 1156 - protein, 473 aa, Zea mays; identical to SEQ ID NO: 685

SEQ ID NO: 1157 - protein, 593 aa, Saccharomyces cerevisiae
MTISNKSWRSYFPHLRKLPEDDQYLYSDDTNSSIIAEEELHHSVDKSSKTDVTAETTAVEPHPHNLRHDLPYEVRDEAGRKWWKYFDEFEYRVNKEYKKSRKWYEFLYPNHTTQTKAERRLLYKLDIIIALYFFMLCWSKSVDLNNYTNAYVSNMKEDLNMKGNDYVYTSTIANVGAIVFQLPFMYLLPRFPSHIILPVMDLGWTWFTFACYRANSLAELRAYRFILSAFGAAYYPVSQYILGCWYAPDEINSRVCLFFCGQQLGSVTSGLLQSRIFKSLNGVHGLAGWRWMFLIDAIAISLPTAIIGFFVIPGVPSKCYSLFLTDEEIRIARARNKRNQIKDGVDKSKLAPLWSRKLWKKVFCTPAFWVLVVFDTCSWNNMTAYSGSYTLWLKSNTKYSIAQVNNLSVIPACLGFAYVIFCAFGADLFRCKWIFMVFAAIMNTVSCALLIKWDIPSKAKWYAFFTTYFSVAASPCLWSFINDFLRFDPQVKAITWIAIYSFSQSTYAWIPTLAWPTVESPRFKTGYTVSLIFGAIYGLWTFVVLFFYKRNEKKHALGNGIILYDSNKGEELPEFVKKNMEERDGYYYLKRSS

SEQ ID NO: 1158 - protein, 509 aa, Arabidopsis thaliana
MGALEAERAANNATALETQSSPEDLSQPSPLRKIISVASIAAGVQFGWALQLSLLTPYIQLLGIPHKWSSYMWLCGPISGMIVQPIVGYHSDRCESRFGRRRPFIAAGVALVAVSVFLIGFAADMGHSFGDKLENKVRTRAIIIFLTGFWFLDVANNTLQGPCRAFLADLAAGDAKKTRVANACFSFFMAVGNVLGYAAGSYTNLHKMFPFTMTKACDIYCANLKTCFFLSITLLLIVTFSSLWYVKDKQWSPPQGDKEEKTSSLFFFGEIFGAVRHMKRPMVMLLIVTVINWIAWFPFILYDTDWMGREVYGGNSDGDERSKKLYDQGVQAGALGLMFNSILLGFVSLGVESIGRKMGGAKRLWGCVNFILAIGLAMTVLVTKSAEHHREIAGPLAGPSSGIKAGVFSLFTVLGIPLAITYSIPFALASIFSTNSGAGQGLSLGVLNIAICIPQMIVSFSSGPLDAQFGGGNLPSFVVGAIAAAISGVLALTVLPSPPPDAPAMSGAM

SEQ ID NO: 1159 - protein, 138 aa, Glycine max
MEEESKEKKKDTKEEPRYRGVRRRPWGKFAAEIRDPARHGARVWLGTFLTAEEAARAYDRAAYEMRGALAVLNFPNEYPSCSSMNSSSTLAPSSSSSNSMLKSDHGKQVIEFECLDDKLLEDLLDCDDYAYEKDLPKN

SEQ ID NO: 1160 - protein, 131 aa, Zea mays
MEDDKKEGKYRGVRKRPWGKFAAEIRDPERGGSRVWLGTFDTAEEAARAYDRAAFTMKGATAVLNFPTSGGSAAAAPGGRTSGGGSSSSTTSSAPASRGRARVPDSEKVELECLDDRVLEELLAEDKYNKN

SEQ ID NO: 1161 - protein, 497 aa, Zea mays
MVLSHASSGRDDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVC

SEQ ID NO: 1162 - protein, 271 aa, Zea mays
MATTTDLGFEATELRLGLPGGGGGGEPALGGEGRSSSSASGKRGFAETIDLKLKLEPAAVVEAEEEEEDHGVAVALEKEEEAGKMKRSPSQSSVAAAAAAVLADPAEKPRAAKAQVVGWPPVRSFRKNIMSVQSDKGAAAANGDKSSPAAGGGAAFVKVSLDGAPYLRKVDLKMYRSYQQLSKALENMFSSFTIGSCGSQGMNGMNESKLVDLLNGSEYVPTYEDKDGDWMLVGDVPWEMFVESCKRLRIMKGSEAIGLAPRAMEKCKNRS

SEQ ID NO: 1163 - protein, 345 aa, Zea mays
MKRKENSEHSAPPLNRPRGKRKALAELPKSNGLNMNHDSAPRPSKPRTRSAARAEAEAEAAMKRRKAGDAARWPMDTRQPDAEAAVAPYVGDIDRYLRSLEVEPLRRPSHSYFQDIQKNICPKMRAILVDWLVEVAEEFKLHAETLHLAVSYVDRFLTMNVVARNKLQLLGVTALLVAAKYEEIESSKMKVVKMETDLLKSLSFQIGGPTVTTFLRQFIASCRGGNSASRGKLEFVCSYLAELSLLDYDCISYLPSVVAAACLFVARFIIHPKTRPWNLSLEQSTGYRVFDLQKSIYVIHELQLTIRCPNQVAIREKYKDPKFGCVSTMVSPREIPTSFLEGCHK

SEQ ID NO: 1164 - protein, 373 aa, Zea mays
MAARKKKPLLIACQATSARITRSQAAANSTRSGLAPSVPVPLKTEHNHPAKKKMKREASDENASADAGASAPLPKRRTVLKNVTNISCAKISKRCTAVTGLKLGPSQKAGQSINKQCTNKISMLLPLAVGGSSLVDDSNNAEETQMVDLLAQKEKQIVLLKEAQPLQNTEQNKGGACDEASVEERNAMNVHETAALKAGVSNGLNIVDIDKNNGDPQMCVTYVAEIYRNLMASEVSDEYKLVADTLYLTVYLIDQFLSQNCIQTHKLQLLGITSMLIASKYEEYSAPSAEEFCNITAGTYAKAEVLEMEQQVLNDLGFHLSVPTTNTFLRRFLRAAQASRTVRSVPKPHCNESFQSICIVLNTKLASYISRLI

SEQ ID NO: 1165 - protein, 669 aa, Zea mays
MKVANGLSLRKSNGRFKSKLMMELVKQWREHQANMRCMNLSKRNNNIYVGAEGANITSPNDSNIWPTSALVAKNSNPRYVLASKCASQPPTMWLENSLNTSSGFKCSKLSIVRNALPSKTPKASVSWKSKDDSNAIPRHLEQSHCKKTSRATRTHFKAMPNLIHKAKNVDTSNLNDGTSGSSWRGQSDSYKGEDINIGKECTKTSELLKSREASRKSNILVVDRKDPNKDEPDKVKGIQDEVMTKEEGVKGHTCEGRATCWSCLKQANTTKTNDAPNLGSLLVGNEHMQGLMSNLRDNSSHLFEKNHSRHQRDDPCEYRETNLKFPNRIQSVGGNGKTNDVTSRRKRLLLEEKASAHVQNDLTYGPMKRRRYIEANEDEEEQNDLTYGPMKRRRYIEANEDEEDYVGDHHPVHIEDATTELTPQDSISKHCVERQCYCCSKPIDIPRWSGTFKIDGKEHISLAGHLSSKSCEKVWKLSSLPKVVQVTKVPRMAVWPKIFKASEPSGDNIGLYFFPPEMRHDEELDQLVNEVMDKDLILRAIIGEAEMLIFPSVLLPERYQTFQTKHYLWAAFKAKEDKGDAIVEEEVEKGNCVSNQPDKVQSDNASFPSNHGLDRPSMEAPPQSSSSVFGIVVRQAPNLEPEVKRFIQEMERKGALVTVMRGEAIGGGP

SEQ ID NO: 1166 - protein, 448 aa, Arabidopsis thaliana
MMMETRDPAIKLFGMKIPFPSVFESAVTVEDDEEDDWSGGDDKSPEKVTPELSDKNNNNCNDNSFNNSKPETLDKEEATSTDQIESSDTPEDNQQTTPDGKTLKKPTKILPCPRCKSMETKFCYYNNYNINQPRHFCKACQRYWTAGGTMRNVPVGAGRRKNKSSSSHYRHITISEALEAARLDPGLQANTRVLSFGLEAQQQHVAAPMTPVMKLQEDQKVSNGARNRFHGLADQRLVARVENGDDCSSGSSVTTSNNHSVDESRAQSGSVVEAQMNNNNNNNMNGYACIPGVPWPYTWNPAMPPPGFYPPPGYPMPFYPYWTIPMLPPHQSSSPISQKCSNTNSPTLGKHPRDEGSSKKDNETERKQKAGCVLVPKTLRIDDPNEAAKSSIWTTLGIKNEAMCKAGGMFKGFDHKTKMYNNDKAENSPVLSANPAALSRSHNFHEQI

SEQ ID NO: 1167 - protein, 373 aa, Arabidopsis thaliana
MQMVHTSRSIAQIGFGVKSQLVLTIGLERPPGQVKDQTMSKEAEMSIAVSALFPGFRFSPTDVELISYYLRRKIDGDENSVAVIAEVEIYKFEPWDLPEESKLKSENEWFYFCARGRKYPHGSQSRRATQLGYWKATGKERSVKSGNQVVGTKRTLVFHIGRAPRGERTEWIMHEYCIHGAPQDALVVCRLRKNADFRASSTQKIEDGVVQDDGYVGQRGGLDKEDKSYYESEHQIPNGDIAESSNVVEDQADTDDDCYAEILNDDIIKLDEEALKASQAFRPTNPTHQETISSESSSKRSKCGIKKESTETMNCYALFRIKNVAGTDSSWRFPNPFKIKKDDSQRLMKNVLATTVFLAILFSFFWTVLIARN

SEQ ID NO: 1168 - protein, 371 aa, Arabidopsis thaliana
MMEGVSREAQMSIAASSMFPGFRFCPTDEELISYYLRKKLEGHEESVQVISEVELCKYEPWDLPAKSFIQSDNEWFFFSPRGRKYPNGSQSKRATECGYWKATGKERNVKSGSNIIGTKRTLVFHLGRAPKGERTEWIMHEYCINDKSQESLVICRLKRNTEFRLSDASNRASSSQRHPVNSHESGCAISGGGIDQRDACEQDKEVGCSSKRDSSSYGSPSMEQIDSVSESNQRPVNEATFTESSGQPKEGYEEDCYAEILKDDIIKLDESSVLVESHTRPQDPTQMQPAPQGTAQRRIRLRVGNSKHSRAVVRFPSTMHSSKNTFFARTTNSLVVLAFFVFTLMVLYFLSLVRGQKQDKYCGEFSGVNHD

SEQ ID NO: 1169 - protein, 482 aa, Zea mays
MMMMMMAGEHVLAALGTLLLASLLTLVLNHFLPLLLNPKAPRGSFGWPLLGETLRFLTPHASNTLGGFLEDHCSRYGRVFKSHLFCTPTVVSCDQDLNHFILQNEERLFQCSYPRPIHGILGKSSMLVVLGEDHKRLRNLALALVTSTKLKPSYLGDIEKIALHVVGAWRRHGGVRVVAFCEEARKFAFSVIVKQVLGLSPEEPVTARILEDFLAFMKGLISFPLYIPGTPYAKAVRARERISSTVKGIIKERRSAGSWNKQGDFLDVLLSSNELSDEEKVSFVLDSLLGGYETTSLLISMVVYFLGQSAQDLDLVKREHDSIRSNKGKEECLTSEDYKKMEYTQQVINEALRCGNIVKFVHRKALKDVKYKEYLIPSGWKVLPVFTAVHLNPSLHGDAQQFQPCRWEGTSQGTSKRFTPFGGGPRLCPGSELAKVETAFFLHHLVLNYRWRIDGDDIPMAYPYVEFQRGLPIEIEPTSPES

SEQ ID NO: 1170 - protein, 1294 aa, Oryza sativa
MVSNSFWLFILLVSFIPISAWAESRDISTLFTLRDSITEGKGFLRNWFDSETPPCSWSGITCIGHNVVAIDLSSVPLYAPFPLCIGAFQSLVRLNFSGCGFSGELPEALGNLQNLQYLDLSNNELTGPIPISLYNLKMLKEMVLDYNSLSGQLSPAIAQLQHLTKLSISMNSISGSLPPDLGSLKNLELLDIKMNTFNGSIPATFGNLSCLLHFDASQNNLTGSIFPGITSLTNLLTLDLSSNSFEGTIPREIGQLENLELLILGKNDLTGRIPQEIGSLKQLKLLHLEECQFTGKIPWSISGLSSLTELDISDNNFDAELPSSMGELGNLTQLIAKNAGLSGNMPKELGNCKKLTVINLSFNALIGPIPEEFADLEAIVSFFVEGNKLSGRVPDWIQKWKNARSIRLGQNKFSGPLPVLPLQHLLSFAAESNLLSGSIPSHICQANSLHSLLLHHNNLTGTIDEAFKGCTNLTELNLLDNHIHGEVPGYLAELPLVTLELSQNKFAGMLPAELWESKTLLEISLSNNEITGPIPESIGKLSVLQRLHIDNNLLEGPIPQSVGDLRNLTNLSLRGNRLSGIIPLALFNCRKLATLDLSYNNLTGNIPSAISHLTLLDSLILSSNQLSGSIPAEICVGFENEAHPDSEFLQHHGLLDLSYNQLTGQIPTSIKNCAMVMVLNLQGNLLNGTIPVELGELTNLTSINLSFNEFVGPMLPWSGPLVQLQGLILSNNHLDGSIPAKIGQILPKIAVLDLSSNALTGTLPQSLLCNNYLNHLDVSNNHLSGHIQFSCPDGKEYSSTLLFFNSSSNHFSGSLDESISNFTQLSTLDIHNNSLTGRLPSALSDLSSLNYLDLSSNNLYGAIPCGICNIFGLSFANFSGNYIDMYSLADCAAGGICSTNGTDHKALHPYHRVRRAITICAFTFVIIIVLVLLAVYLRRKLVRSRPLAFESASKAKATVEPTSTDELLGKKSREPLSINLATFEHALLRVTADDILKATENFSKVHIIGDGGFGTVYKAALPEGRRVAIKRLHGGHQFQGDREFLAEMETIGKVKHPNLVPLLGYCVCGDERFLIYEYMENGSLEMWLRNRADALEALGWPDRLKICLGSARGLAFLHHGFVPHIIHRDMKSSNILLDENFEPRVSDFGLARIISACETHVSTDIAGTFGYIPPEYGLTMKSTTKGDVYSFGVVMLELLTGRPPTGQEEVQGGGNLVGWVRWMIARGKQNELFDPCLPVSSVWREQMARVLAIARDCTADEPFKRPTMLEVVKGLKMTHGMECGPLVVTVSRDM

SEQ ID NO: 1171 - protein, 1110 aa, Oryza sativa
MDILIPLLLSSIYVSSSAAAAETDAAALLRFKAFVHKDPRGVLSSWVDPGPCRWRGVTCNGDGRVTELDLAAGGLAGRAELAALSGLDTLCRLNLSGNGELHVDAGDLVKLPRALLQLDLSDGGLAGRLPDGFLACYPNLTDVSLARNNLTGELPGMLLASNIRSFDVSGNNMSGDISGVSLPATLAVLDLSGNRFTGAIPPSLSGCAGLTTLNLSYNGLAGAIPEGIGAIAGLEVLDVSWNHLTGAIPPGLGRNACASLRVLRVSSNNISGSIPESLSSCHALRLLDVANNNVSGGIPAAVLGNLTAVESLLLSNNFISGSLPDTIAHCKNLRVADLSSNKISGALPAELCSPGAALEELRLPDNLVAGTIPPGLSNCSRLRVIDFSINYLRGPIPPELGRLRALEKLVMWFNGLDGRIPADLGQCRNLRTLILNNNFIGGDIPVELFNCTGLEWVSLTSNQITGTIRPEFGRLSRLAVLQLANNSLAGEIPRELGNCSSLMWLDLNSNRLTGEIPRRLGRQLGSTPLSGILSGNTLAFVRNVGNSCKGVGGLLEFAGIRPERLLQVPTLKSCDFTRLYSGAAVSGWTRYQTLEYLDLSYNSLDGEIPEELGDMVVLQVLDLARNNLTGEIPASLGRLRNLGVFDVSRNRLQGGIPDSFSNLSFLVQIDISDNNLSGEIPQRGQLSTLPASQYAGNPGLCGMPLEPCGDRLPTATMSGLAAAASTDPPPRRAVATWANGVILAVLVSAGLACAAAIWAVAARARRREVRSAMMLSSLQDGTRTATTWKLGKAEKEALSINVATFQRQLRKLTFTQLIEATNGFSTASLIGSGGFGEVFKATLKDGSCVAIKKLIHLSYQGDREFMAEMETLGKIKHKNLVPLLGYCKIGEERLLVYEFMSHGSLEDTLHGDGGRSASPAMSWEQRKKVARGAARGLCFLHYNCIPHIIHRDMKSSNVLLDGDMEARVADFGMARLISALDTHLSVSTLAGTPGYVPPEYYQSFRCTVKGDVYSFGVVLLELLTGRRPTDKDDFGDTNLVGWVKMKVGDGAGKEVLDPELVVEGADADEMARFMDMALQCVDDFPSKRPNMLQVVAMLRELDAPPPATAI

SEQ ID NO: 1172 - protein, 1121 aa, Oryza sativa
MDSLWAAIAALFVAAAVVVRGAAAADDAQLLEEFRQAVPNQAALKGWSGGDGACRFPGAGCRNGRLTSLSLAGVPLNAEFRAVAATLLQLGSVEVLSLRGANVSGALSAAGGARCGSKLQALDLSGNAALRGSVADVAALASACGGLKTLNLSGDAVGAAKVGGGGGPGFAGLDSLDLSNNKITDDSDLRWMVDAGVGAVRWLDLALNRISGVPEFTNCSGLQYLDLSGNLIVGEVPGGALSDCRGLKVLNLSFNHLAGVFPPDIAGLTSLNALNLSNNNFSGELPGEAFAKLQQLTALSLSFNHFNGSIPDTVASLPELQQLDLSSNTFSGTIPSSLCQDPNSKLHLLYLQNNYLTGGIPDAVSNCTSLVSLDLSLNYINGSIPASLGDLGNLQDLILWQNELEGEIPASLSRIQGLEHLILDYNGLTGSIPPELAKCTKLNWISLASNRLSGPIPSWLGKLSYLAILKLSNNSFSGPIPPELGDCQSLVWLDLNSNQLNGSIPKELAKQSGKMNVGLIVGRPYVYLRNDELSSECRGKGSLLEFTSIRPDDLSRMPSKKLCNFTRMYVGSTEYTFNKNGSMIFLDLSYNQLDSAIPGELGDMFYLMIMNLGHNLLSGTIPSRLAEAKKLAVLDLSYNQLEGPIPNSFSALSLSEINLSNNQLNGTIPELGSLATFPKSQYENNTGLCGFPLPPCDHSSPRSSNDHQSHRRQASMASSIAMGLLFSLFCIIVIIIAIGSKRRRLKNEEASTSRDIYIDSRSHSATMNSDWRQNLSGTNLLSINLAAFEKPLQNLTLADLVEATNGFHIACQIGSGGFGDVYKAQLKDGKVVAIKKLIHVSGQGDREFTAEMETIGKIKHRNLVPLLGYCKAGEERLLVYDYMKFGSLEDVLHDRKKIGKKLNWEARRKIAVGAARGLAFLHHNCIPHIIHRDMKSSNVLIDEQLEARVSDFGMARLMSVVDTHLSVSTLAGTPGYVPPEYYQSFRCTTKGDVYSYGVVLLELLTGKPPTDSADFGEDNNLVGWVKQHTKLKITDVFDPELLKEDPSVELELLEHLKIACACLDDRPSRRPTMLKVMAMFKEIQAGSTVDSKTSSAAAGSIDEGGYGVLDMPLREAKEEKD

SEQ ID NO: 1173 - protein, 561 aa, Oryza sativa
MADLQEPLVRPKRKKVLVDYLVKFRWILVIFVVLPISALIYFNIYLGDVWSAMKSEKRRQKEHDDNVQKVVKRLKQRNPKKDGLVCTARKPWIAVGMRNVDYKRARHFEVDLSAFRNILEIDRERMVAKVEPLVNMGQITRATCPMNLALAVVAELDDLTVGGLINGYGIEGSSHLYGLFSDTVVAVEVVLADGRVVRATKDNEYSDLFYGIPWSQGTLGFLVSAEIKLIPIKEYMRLTYTPVKGSLKEIAQGYCDSFAPRDGDPAKVPDFVEGMVYTENEGVMMTGVYASKEEAKKKGNKINCVGWWFKPWFYQHAQTALKKGEFVEYIPTREYYHRHTRCLYWEGKLILPFGDQFWFRFLLGWLMPPKVSLLKATQGESIRNYYHDNHVIQDMLVPLYKVGDALEFVHKEMEVYPLWLCPHRLYKLPVKTMVYPEPGFEHHHRQGDTSYAQMFTDVGVYYAPGAVLRGEEFNGALAVHRLEQWLIENHSYQPQYAVSELNEKDFWRMFDASHYEHCRQKYGAVGTFMSVYYKSKKGRKTEKEVQEAEAAILEPAYADEA

SEQ ID NO: 1174 - protein, 562 aa, Zea mays
MADVHEPLVRRKRKKVLVDYLVKFRWILVIFVVLPISTLIYFNIFLGDMWSAMKSEKKRQKQHDENVQKVVKRLKQRNPKKDGLVCTARKPWIAVGMRNVDYKRARHFEVDLSSFRNILEIDKERMVAKVEPLVNMGQITRATCPMNLALAVVAELDDLTVGGLINGYGIEGSSHLYGLFSDTVVAMEVVLADGRVVRATKDNEYSDLFYGIPWSQGTLGFLVSAEIKLIPIKEYMKLTYTPVKGGLKEIAQAYADSFAPRDGDPAKVPDFVEGMVYTESEGVMMTGVYASKEEAKKKGNKINCVGWWFKPWFYQHAQTALKRGEFVEYIPTREYYHRHTRCLYWEGKLILPFGDQFWFRFLLGWLMPPKVSLLKATQGEAIRNYYHDNHVIQDMLVPLYKVGDALEFVHREMEVYPLWLCPHRLYKLPVKTMVYPEPGFEHQHRQGDTSYAQMFTDVGVYYAPGAVLRGEEFNGAEAVHRLEQWLIENHSYQPQYAVSELNEKDFWRMFDASHYEHCRQKYGAVGTFMSVYYKSKKGRKTEKEVQEAEAAILEPAYADEEA

SEQ ID NO: 1175 - protein, 238 aa, Oryza sativa
MAGGGGEYLRQFVEETAWYNEIFLSHVVPGDWWRALPHPLQSWLRNGLGGYLIYFACGFLWCFVIYYWKRHAYIPKDSIPTIEAMKKQIIVASKAMPLYCALPTLSEYMVENGWTQCYVNISEVGWPMYLVYLALYLIFVEFGIYWMHRELHDIKPLYKYLHTYHHIYNKENTLSPFAEAVWTTNIHDCIHGKVWPVMGAGYHTIHHTTYRHNYGHYTVWMDWMFGTLREPEDILKKD

SEQ ID NO: 1176 - protein, 274 aa, Zea mays
MAVHGGDYLRRFVAETEWYNEVVLNAVAPGDWWRGLPHPVQSWMRNCVGGYLLYFISGFLWCFVIYYWKRHAYIPKDAIPTNEAMKKQIAVASKAMPFYCALPTLSEYMIESGWTRCYFNISEMGFSAYLCYMAMYLIFVEFGIYWMHRELHDIKPLYKHLHATHHIYNKENTLSPFAGLAFHPLDGILQAIPHVLALFLLPTHFRTHIALVFLEGVWTTNIHDCIHGKVWPVMGAGYHTIHHTTYRHNYGHYTVWMDWMFGTLREPDDILKKA

SEQ ID NO: 1177 - protein, 276 aa, Zea mays
MEAVARSGDYLWRFVAETEWYNEVVLSAVAPGDWWRGLPHPVQSWMRNCVGGYLLYFISGFLWCFVIYYWKRHAYIPKDAIPTNEAMKKQIVVASKAMPFYCALPTLSEYMIESGWTRCYFNISEIGFSMYLCYMAMYLIFVEFGIYWMHRELHDIKPLYKYLHATHHIYNKENTLSPFAGLAFHPLDGILQAIPHVFALFLFPTHFRTHIALLFLEAVWTTNIHDCIHGKIWPVMGAGYHTIHHTTYRHNYGHYTIWMDWMFGTLNEPEDILKKA

SEQ ID NO: 1178 - protein, 283 aa, Glycine max
MEDPSAATTLLLNSEYSRLFVEDTDLYNRIVLGTLLPHFVWGPLPHFLQTWLRNYLGGVLLYLLSGLLWCFYIYYWKRNVYVPKDAIPSRRAMLLQISVAMKAMPWYTLLPTVSEYLVETGWTKCYPRLYNVGWLAYLVYLAIYLSIVEFGIYWMHRELHDIKPLYKYLHATHHIYNKQNTLSPFAGLAFHPLDGILQALPHSLCLFFMPIHFTTHLVLIFIEGIWTANIHDCIHGKLWPVMGAGYHTIHHTTYRHNYGHYTIWMDWLFGTLHNPEEDEGKAM

SEQ ID NO: 1179 - protein, 471 aa, Oryza sativa
MATRGRIVAAVASVVVAWLAVAVGVNGGGCEAERDRVEALPGQPPVAFAQYAGYVAVSEASGRALFYWLTEAAAAAAATKPRARWLFPGPGCSSIAYGASEEIGPFRIKTNGTGLYLNKYSWNREANLLFLESPAGVGFSYSNTTSDLKTSGDERTAQDALQFLISWMSRFPQYRHRDFYIAGESYAGHYVPQLARKIVEFNKASPYPFINLKGILVGNGVTDNYYDNIGTVTYWWTHAMISDTTYKAIMSSCNFTSANVSRLCNRAMSYAMNHEFGDIDQYSIYTPSCAAAAANATGRRRGKAAVLRFKDTFLRRRSFGYDPCTETYAEKYYNRPDVQKAMHANITGIPYRWTACSDVLIKTWRDSEFSMLPTYKLLMKAGLRIWVFSGDTDSVVPVTATRFALSHLGLKTKIRWYPWYSAGQVGGWSEVYEGLTFASVRGAGHEVPLFQPRRAFRMFQSFLAGEPLPKS

SEQ ID NO: 1180 - protein, 480 aa, Zea mays
MATTRPRGGGGAASGALVMAIVVLLLLPPYGAGAEECEDGGISSRARAGDRVEALPGQPAVAFAQYSGYVAVDRDRGRALFYWLTEAVGDDAAAKPLVLWLNGGPGCSSVAYGASEEIGPFRIKPNGTGLFLNKYSWNREANLLFLESPAGVGFSYANTTSDLKTSGDERTAQDALQFLVSWMSRFPQYRHRDFYIAGESYAGHYVPQLARKIVEYNEASPHPFINLKGILVGNAGTDNYYDNIGTVTYWWTHAMISDRTYKAILRWCNFSSSSISRPCNRAMSYAMNHEFGDIDQYSIYTPSCAAAARAIRLELRFKNTLVRRRRSSGYDPCTETYAERYYNRMDVQRAMHANTTGIPYRWTACSDVLIKTWQDSEFSMLPTYKKLMKAGLRIWVFSGDTDSVVPVTATRFAISHLGLKIKTRWYPWYSAGQVGGWSEVYEGLTFASVRGAGHEVPLFQPRRAFRMFRSFLAGEPLPKS

SEQ ID NO: 1181 - protein, 620 aa, Glycine max
MAVTKEKEDVRNTGKRLKCMRNEEEEVYEEEESELPLKPGFFFYPTTPTSFVVSDALEPDFPIIYVNKVFEISTGYRADEALGRNCRFLQYRDPRAQRRHPLVDPVVVSEIRRCLEEGVEFQGELLNFRKDGTPLVNRLRLAPIHDDDGTVTHVIGIQLFSEANIDLNRVSYPVFKETCNQDFDKTGKYNPKSGQSLYSQHQEMCGILQLSDEVLAHNILSRLTPRDVASIGSVCRRIRQLTKNEHVRKMVCQNAWGKEVTGTLELMTKKLGWGRLTRELTTLEAVCWRKLTVGGAVEPSRCNFSACAAGNRLVLFGGEGVDMQPMDDTFVLNLDAKNPEWRRVSVKSSPPGRWGHTLSCLNGSWLVVFGGCGRQGLLNDVFVLDLDAQQPTWREVCGGTPPLPRSWHSSCTIEGSKLVVSGGCTDAGVLLSDTYLLDLTTDNPTWREIPTSWAPPSRLGHSLSVYGRTKILMFGGLAKSGHLRLRSGEAYTIDLEDEQPQWRQLEYSAFTGLASQSAVVPPPRLDHVAVSMPCGRIIIFGGSIAGLHSPSQLFLLDPSEEKPSWRILNVPGQPPKFAWGHSTCVVGGTRVLVLGGHTGEEWILNELHELCLASRQDSDL

SEQ ID NO: 1182 - protein, 682 aa, Zea mays
MIACANLKFANSAKLDRGPIEASHKLCSLKIVFPGSISPRTKPAKPLAHAEERERGCAGRRPASDDAGRRGVVAVKRMRLWEEEDEEGMEVDGEAEDEPGWPCGAPEAGLGETRPAAILVADAAEVDFPVIYVNAAFEAATGYRAHEVLGRNCRFLQFRDPHAQRRHPLVDPMVVSEIRRCLSEGIEFQGELLNFRKDGAPLHNRLRLVPMHGDDGYVTHVIGIQLFSEANIDLSSVSYPVYKQKSSSRPSIQDLNSSPHEHAPKIQSADHCGMLQLSDEVLAHNILSRLSPRDVASIGSVCTRMHELTKNDHLRKMVCQNAWGRDVTVRLEMSTKMVGWGRLARELTTLEAASWRKFTVGGRVEPSRCNFSACAVGNRLVLFGGEGVNMQPMDDTFVLNLEAATPEWRRVKVSASPPGRWGHTLSWLNGSWLVVFGGCGQQGLLNDVFVLDLDAQQPTWREVASEGPPLPRSWHSSCTLDGSKLVVSGGCAESGVLLSDTFLLDLTKEKPAWREIPTSWSPPSRLGHTTSVYGATKLFMFGGLAKSGSLRLRSSDAYTVDVSEDSPQWRQLATTTGFPNVSPPPRLDHVAVSLPCGRIIIFGGSIAGLHSPAQLFLIDPAEEKPIWRILNVPGQPPKFAWGHSTCVVGGTRVLVLGGHTGEEWILNELHELCLASRPDEDG

SEQ ID NO: 1183 - protein, 386 aa, Saccharomyces cerevisiae
MSAATVGKPIKCIAAVAYDAKKPLSVEEITVDAPKAHEVRIKIEYTAVCHTDAYTLSGSDPEGLFPCVLGHEGAGIVESVGDDVITVKPGDHVIALYTAECGKCKFCTSGKTNLCGAVRATQGKGVMPDGTTRFHNAKGEDIYHFMGCSTFSEYTVVADVSVVAIDPKAPLDAACLLGCGVTTGFGAALKTANVQKGDTVAVFGCGTVGLSVIQGAKLRGASKIIAIDINNKKKQYCSQFGATDFVNPKEDLAKDQTIVEKLIEMTDGGLDFTFDCTGNTKIMRDALEACHKGWGQSIIIGVAAAGEEISTRPFQLVTGRVWKGSAFGGIKGRSEMGGLIKDYQKGALKVEEFITHRRPFKEINQAFEDLHNGDCLRTVLKSDEIK

SEQ ID NO: 1184 - protein, 369 aa, Escherichia coli
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFDLARRFGATDCINPNDYDKPIKDVLLDINKWGIDHTFECIGNVNVMRAALESAHRGWGQSVIIGVAVAGQEISTRPFQLVTGRVWKGSAFGGVKGRSQLPGMVEDAMKGDIDLEPFVTHTMSLDEINDAFDLMHEGKSIRTVIRY

SEQ ID NO: 1185 - protein, 369 aa, Nostoc sp. PCC 7120
MEVKAAIAYGAGKPLTIETVQLEGPKAGEVLVEVKASGVCHTDAYTLSGNDPEGLFPAILGHEGAGVVVDVGAGVTSVKPGDHVIPLYTPECRQCAYCLSFKTNLCQAIRGTQGRGVMPDGTSRFSINGQMIHHYMGTSTFANYTVLPEIAVAKIREDAPFDKVCYIGCGVTTGIGAVIYTAKVEAGANVVVFGLGGIGLNVIQGARMVGANMIVGVDINPSKRALAEKFGMTHFVNPQEVEGDLVAYLVDLTKGGADYSFECIGNVNVMRQALECCHKGWGVSVIIGVAGAGQEISTRPFQLVTGRVWKGSAFGGARGRTDVPKIVDWYMDGKINIDDLITHVMPIEKINDAMDLMHRGESIRSVVTF

SEQ ID NO: 1186 - protein, 381 aa, Oryza sativa
MASSTQGQVITCKAAVAWEANKPMTIEDVQVAPPQAGEVRVKILFTAFCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 1187 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSIMRAALECSDKGWGTSVIVGVAASGQEISTRPFQLVTGRVWKGTAFGGFKSRTQVPWLVDKYMKKEIKVDEYITHNMNLADINDAFHLLHEGGCLRCVLAMQI

SEQ ID NO: 1188 - protein, 386 aa, Zea mays
MSDTAGKTITCKAAVAWEAGKDLVVEDIEVLPPRAHEVRIQVYYTGVCHTDAYMLSGKDPEGAFPVIAGHEGAGIVESVGEGVTNVKVGDTVVALYTPECKECKFCKSGKTNLCGKIRATQGKGVMPDGTSRFKCKGKDLLHFMGCSTFSQYTVLADISVVAVTPDAPMDRTCLLGCGITTGYGAAVITAGRGGVEKGSNVAIFGAGCVGLSVIQGAVKQGASKIIVVDVNDAKKEWAKKFGATDFVNPAKDLKEGENIQSRLIDMTDGGCDYTFDCTGNVHVMRSALEACHKGWGESIIIGVAAAGQEISTRPFQLVTGRVWKGCAFGGVKGRSQMGQLVQDYMDNKLKVDEFITHRQPLGGINEAFHDMHAGDCIRCVVDMRKV

SEQ ID NO: 1189 - protein, 379 aa, Zea mays
MATAGKVIKCRAAVAWEAGKPLSIEEVEVAPPQAMEVRIKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 1190 - protein, 379 aa, Glycine max
MSTAGQVIKCRAAVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 1191 - protein, 370 aa, Oryza sativa
MSSATDGAASRLGVAGALGMSVTSSVAIVICNKYLISTLGFFFATTLTSWHLMVTFCTLYVAQRLRFFEAKPIDAQTVISFGLLNGISIGLLNLCLGFNSVGFYQMTKLAIIPFTMLLETIFLSKKFSRSIKISLMVLLLGVGIASVTDLQLNLLGSIIAVLTIAATCVSQILTNQIQRRLKVSSTQLLYQSSPYQSAVLLVTGPFVDKLLTNRDVFAFTYTFQVVAFIVLSCSIAVCVNFSTFLVIGTTSPVTYQVLGHLKTCLILSFGYVLLRDPFTFRNVAGILVAIFGMGLYSFFSVSESRDKKLADGPSPPLPISSSQMAEMKDSEPLLGGGGGAAAKSSPWNEVKGLQSFDEVPRTAKSAFSRP

SEQ ID NO: 1192 - protein, 356 aa, Oryza sativa
MGVTGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIQLSLSVLLFGVGVATVTDLQLNAVGSVLSLLAIITTCIAQIMTNTIQKKFKVSSTQLLYQSCPYQALTLFIVGPFLDGFLTNQNVFAFDYTSQVVFFIVLSCLISVSVNFSTFLVIGKTSPVTYQVLGHLKTCLVLAFGYVLLHDPFSWRNILGILIAVIGMVSYSYFCTKEAPPKPTEASPQLNQVKESESDPLISDSLSTAENGGNAGDDEALKVPMWSSKYSKA

SEQ ID NO: 1193 - protein, 340 aa, Zea mays
MTAGFQLGVIGSLTLSVASSVAIVICNKALISTLGFPFATTLTSWHLMVTFCTLHVAQRLRFFEPKAIDGQTVVLFGLLNGTSIGLLNLSLGFNSIGFYQMTKLAIIPFTVLLETIFLKKRFSETIKFSLLVLLLGVGIASVTDLKLNCLGSVLSGLAIATTCVGQILTNTIQRKLKVSSTQLLYQSAPYQAAILFATGPFVDHLLTGRSVFAHRYTFPVVGFIVLSCLIAVSVNFSTFLVIGTTSPVTYQVLGHLKTCLVLSFGYTLLHDPFTVRNILGILVAIFGMALYSIFSVREGKKKSAGDALPVSQMPDKETEPLLATKDNSDTKKANGVAHDC

SEQ ID NO: 1194 - protein, 577 aa, Oryza sativa
MSATTSNSRRLCNGRGQVIPGPTLPEAVKMGPHAIRIVVGGLGEGELSTATTVHGPERASSSSAPPEMASAALPEAVAPKKKGNVRFAFACAILASMTSILLGYDIGVMSGASLYIKKDFNISDGKVEVLMGILNLYSLIGSFAAGRTSDWIGRRYTIVFAAVIFFAGAFLMGFAVNYAMLMFGRFVAGIGVGYALMIAPVYTAEVSPASARGFLTSFPEVFINFGILLGYVSNYAFSRLPLNLGWRIMLGIGAAPSVLLALMVLGMPESPRWLVMKGRLADAKVVLEKTSDTAEEAAERLADIKAAAGIPEELDGDVVTVPKRGSGNEKRVWKELILSPTPAMRRILLSGIGIHFFQQASGIDSVVLYSPRVFKSAGITDDKHLLGTTCAVGVTKTLFILVATFFLDRVGRRPLLLSSTGGMILSLIGLGAGLTVVGQHPDAKIPWAIGLSIASTLAYVAFFSIGLGPITWVYSSEIFPLQVRALGCSLGVAANRVTSGVISMTFLSLSKAITIGGSFFLYSGIAALAWVFFYTYLPETRGRTLEEMSKLFGDTAAASESDEPAKEKKKVEMAATN

SEQ ID NO: 1195 - protein, 352 aa, Glycine max
MAPSFDFASSLLCTEDSTVFDESHNNGGTMMTAMGVYEDTRSPRRRHFDEEPDELPLLSDESLVMMVEKECQHWSGLRYLNKFQTGDLDFGARMEAIDWIHKVRSHFGFGPLCGYLSINYLDRFLFAYELPKGRVWTMQLLAVACLSLAAKLDETEVPLSLDLQVGESKFLFEAKTIQRMELLVLSTLKWRMQAITPFTFLDYFLCKINDDQSPLRSSIMRSIQLISSTARGIDFLEFKPSEIAAAVAMYVMGETQTVDTGKAISVLIQHVEKERLLKCVQMIQELSCNSGSAKDSSASVTCLPQSPIGVLDALCFNYKSDDTNASSCVNSSHNSPVAKRRKLNKTCGAEQL

SEQ ID NO: 1196 - protein, 267 aa, Oryza sativa
MDPKLVEVTQLFSRFKAAFARNDFDTCVDLLSQLKVRLTKFPSLPPSFQQTPNAVEELKIARDIYEHAVVLSVKIEDQDAFERDFCQLKPYYMDTCGIIPPSPQEYPILGLNLLRLLVQNRIAEFHTELELLPVTALENPCIKHAVELEQSFMEGAYNRVLSARQAVPHETYVYFMDLLAKTVRDELAGCSEKGYDYMSIAEARQVLMFSSDKELHQYIAEEHPEWEVKDGSVFFQKAKETQPCKEIPSLQVINQTLSYARELERIV

SEQ ID NO: 1197 - protein, 274 aa, Saccharomyces cerevisiae
MPSLAELTKSLSIAFENGDYAACEKLLPPIKIELIKNNLLIPDLSIQNDIYLNDLMITKRILEVGALASIQTFNFDSFENYFNQLKPYYFSNNHKLSESDKKSKLISLYLLNLLSQNNTTKFHSELQYLDKHIKNLEDDSLLSYPIKLDRWLMEGSYQKAWDLLQSGSQNISEFDSFTDILKSAIRDEIAKNTELSYDFLPLSNIKALLFFNNEKETEKFALERNWPIVNSKVYFNNQSKEKADYEDEMMHEEDQKTNIIEKAMDYAISIENIV

SEQ ID NO: 1198 - protein, 267 aa, Zea mays
MDPKMTEVTQMFARFKAAYTRNDLDACVTLLSQLKVHLTKFPSLPPSFEQTPKAVEELKLARDIYEHAVVLSVKLEDQDAFERDFCQLKPYYMDTCGIIPPSPEEYPILGLNLLRLLVQNRIAEFHTELELLPVKALEHPCIKHAVELEQSFMEGAYNRVLSARQAVPHETYVYFMDLLAKTVRDEIAGCSEKGYDSLSVSDAKQMLMFSSDQDLHEYITEEHPEWELKNGAVFFQKAKESQPYKEIPSLQLINQTLSYARELERIV

SEQ ID NO: 1199 - protein, 267 aa, Glycine max
MDPKLKEVSQLFDRFKASFIRNDFDTCSNLLSQLKVLLTGFRSLPPLFADTPNAVHELTIARDIYEHAVVLSVKNEDQDAFERDFFQLKPYYTDACNRLPPSPQEYPILGLNLLRLLVQNRIAEFHTELELLSSAALENPCIKHAVELEQSFMEGAYNRVLSARQTVPHDTYVYFMDLLAKTVRDEIAGCSEKAYDYLSIKDAKQMLLFSSDQELLEYIKEEHPEWEIKNGSVFFQKAKESAPCKEIPSLQLINQTLSYARELERIV

SEQ ID NO: 1200 - protein, 394 aa, Sorghum bicolor
MGGAGGGGEAKRSEIYTYEAAWHIYAMNWSVRRDKKYRLAIASLLEQVTNRVEVVQLDEASGDIAPVLTFDHQYPPTKTMFMPDPHALRPDLLATSADHLRIWRIPSPDDADDGAASANNNNGSVRCNGTPQPGIELRCELNGNRNSDYCGPLTSFDWNDADPRRIGTSSIDTTCTIWDVEREAVDTQLIAHDKEVYDIAWGGAGVFASVSADGSVRVFDLRDKEHSTIIYESGSGGGGGGSNSGAGDGGTASPTPLVRLGWNKQDPRYMATIIMDSPKVVVLDIRYPTLPVVELHRHHAPVNAIAWAPHSSCHICTAGDDMQALIWDLSSMGTGSNGSGNGNGNAAAAAAAEGGLDPILAYTAGAEIEQLQWSATQPDWVAIAFANKLQILRV

SEQ ID NO: 1201 - protein, 416 aa, Zea mays
MGGVGEGDAWADQEQGNGGGSRGVGGGGGEAKRSEIYTYEAAWHIYAMNWSVRRDKKYRLAIASLLEQVTNRVEVVQLDEASGDIAPVLTFDHQYPPTKTMFMPDPHALRPDLLATSADHLRIWRIPSSDDAEDGAASANNNNGSVRCNGTQQPGIELRSELNGNRNSDYCGPLTSFDWNDADPRRIGTSSIDTTCTIWDVEREAVDTQLIAHDKEVYDIAWGGAGVFASVSADGSVRVFDLRDKEHSTIIYESGSGGSSGGGSNSGAGDGGTASPTPLVRLGWNKQDPRYMATIIMDSPKVVVLDIRYPTLPVVELHRHHAPVNAIAWAPHSSCHICTAGDDMQALIWDLSSMGTGSNGSGNGNGNTAAGAAAEGGLDPILAYTAGAEIEQLQWSATQPDWVAIAFANKLQILRV

SEQ ID NO: 1202 - protein, 974 aa, Zea mays
MGGKYRAARTKRWWRGLAAAGWVLTAVVCSAVMHWTLRRDSMDRAEERLVSMCEERARMLQEQFGVTVNHVHAIAILISTFNFEKSPPAIDQDTFAKYTARTSFERPLLNGVAFAQRVFHHEREMFESQQGWVMNTMQREPAPPQVEYAPVIFSQDTVSYLARIDMMSGEEDRENIFRARTTGKAVLTNPFRLLGSNHLGVVLTFAVYRPDLPADASVEQRVEATIGYLGGAFDVESLVENLLSKLAGNQDIVVNVYDVTNASDAMVLYGPSSLDEQVPFLHVSMLDFGDPFRKHEMRCRYRQKLPMPWSAITNPLGTFVIWMLLGYSIAAAYSRYDKVTEDCRKMEELKTQAEAADVAKSQFLATASHEIRTPMNGVLGMLDMLLGTDLTMTQKDYAQTAQMCGRALITLINDVLDRAKIEAGKLELEAVPFDLRSLMDDVVSLFSSKSREKCIELAVFVCDNVPKVVIGDPWRFRQILTNLVGNAVKFTERGHVFVRVCLAENSNMEANQVLHGAMNGKGGRVESTANGAFNTLSGFEAADRRNSWQYFKLLLSDKESLLDDLESENSNQSDSDRVTLAISIEDTGVGIPLQAQDRVFTPFMQADSSTSRNYGGTGIGLSISKCLAELMGGQISFTSHPSVGSTFTFSATLKHSHKDISGDSSRSLTEALPTAFKGMKAILVDGRPVRSAVTRYHLKRLGILLQVVNNMNAVVKAFPGQNGAAGSREKASILFIESDFWRPETDVQLLNHLREQKNGQLSDGHKVVLLVTSEADKDKYGSIFDIVMCKPIRASTIASSIQQLLKVEIAERKDNQNRPSFLRSLLVGKNILVVDDNKVNLRVAAAALKKYGANVSCVESGKDAISLLQPPHRFDACFMDVQMPEMDGFEATGQIRQMELKANEERKNKLASIEGSTTAEYHLPVLAMTADVIQATYEECIKSGMDGYVSKPFDEEQLYQAVSRLVVGTTDSAV

SEQ ID NO: 1203 - protein, 1080 aa, Arabidopsis thaliana
MRRDFVYNNNAMFNPLTTHYSSDMNWALNNHQEEEEEPRRIEISDSESLENLKSSDFYQLGGGGALNSSEKPRKIDFWRSGLMGFAKMQQQQQLQHSVAVKMNNNNNNDLMGNKKGSTFIQEHRALLPKALILWIIIVGFISSGIYQWMDDANKIRREEVLVSMCDQRARMLQDQFSVSVNHVHALAILVSTFHYHKNPSAIDQETFAEYTARTAFERPLLSGVAYAEKVVNFEREMFERQHNWVIKTMDRGEPSPVRDEYAPVIFSQDSVSYLESLDMMSGEEDRENILRARETGKAVLTSPFRLLETHHLGVVLTFPVYKSSLPENPTVEERIAATAGYLGGAFDVESLVENLLGQLAGNQAIVVHVYDITNASDPLVMYGNQDEEADRSLSHESKLDFGDPFRKHKMICRYHQKAPIPLNVLTTVPLFFAIGFLVGYILYGAAMHIVKVEDDFHEMQELKVRAEAADVAKSQFLATVSHEIRTPMNGILGMLAMLLDTELSSTQRDYAQTAQVCGKALIALINEVLDRAKIEAGKLELESVPFDIRSILDDVLSLFSEESRNKGIELAVFVSDKVPEIVKGDSGRFRQIIINLVGNSVKFTEKGHIFVKVHLAEQSKDESEPKNALNGGVSEEMIVVSKQSSYNTLSGYEAADGRNSWDSFKHLVSEEQSLSEFDISSNVRLMVSIEDTGIGIPLVAQGRVFMPFMQADSSTSRNYGGTGIGLSISKCLVELMRGQINFISRPHIGSTFWFTAVLEKCDKCSAINHMKKPNVEHLPSTFKGMKAIVVDAKPVRAAVTRYHMKRLGINVDVVTSLKTAVVAAAAFERNGSPLPTKPQLDMILVEKDSWISTEDNDSEIRLLNSRTNGNVHHKSPKLALFATNITNSEFDRAKSAGFADTVIMKPLRASMIGACLQQVLELRKTRQQHPEGSSPATLKSLLTGKKILVVDDNIVNRRVAAGALKKFGAEVVCAESGQVALGLLQIPHTFDACFMDIQMPQMDGFEATRQIRMMEKEAKEKTNLEWHLPILAMTADVIHATYEECLKSGMDGYVSKPFEEENLYKSVAKSFKPNPISPSS

SEQ ID NO: 1204 - protein, 1176 aa, Arabidopsis thaliana
MSITCELLNLTSKKAKKSSSSDKKWLKKPLFFLILCGSLVIVLVMFLRLGRSQKEETDSCNGEEKVLYRHQNVTRSEIHDLVSLFSDSDQVTSFECHKESSPGMWTNYGITCSLSVRSDKQETRGLPWNLGLGHSISSTSCMCGNLEPILQQPENLEEENHEEGLEQGLSSYLRNAWWCLILGVLVCHKIYVSHSKARGERKEKVHLQEALAPKKQQQRAQTSSRGAGRWRKNILLLGILGGVSFSVWWFWDTNEEIIMKRRETLANMCDERARVLQDQFNVSLNHVHALSILVSTFHHGKIPSAIDQRTFEEYTERTNFERPLTSGVAYALKVPHSEREKFEKEHGWAIKKMETEDQTVVQDCVPENFDPAPIQDEYAPVIFAQETVSHIVSVDMMSGEEDRENILRARASGKGVLTSPFKLLKSNHLGVVLTFAVYDTSLPPDATEEQRVEATIGYLGASYDMPSLVEKLLHQLASKQTIAVDVYDTTNTSGLIKMYGSEIGDISEQHISSLDFGDPSRNHEMHCRFKHKLPIPWTAITPSILVLVITFLVGYILYEAINRIATVEEDCQKMRELKARAEAADIAKSQFLATVSHEIRTPMNGVLGMLKMLMDTDLDAKQMDYAQTAHGSGKDLTSLINEVLDQAKIESGRLELENVPFDMRFILDNVSSLLSGKANEKGIELAVYVSSQVPDVVVGDPSRFRQIITNLVGNSIKFTQERGHIFISVHLADEVKEPLTIEDAVLKQRLALGCSESGETVSGFPAVNAWGSWKNFKTCYSTESQNSDQIKLLVTVEDTGVGIPVDAQGRIFTPFMQADSSTSRTYGGTGIGLSISKRLVELMQGEMGFVSEPGIGSTFSFTGVFGKAETNTSITKLERFDLAIQEFTGLRALVIDNRNIRAEVTRYELRRLGISADIVSSLRMACTCCISKLENLAMILIDKDAWNKEEFSVLDELFTRSKVTFTRVPKIFLLATSATLTERSEMKSTGLIDEVVIKPLRMSVLICCLQETLVNGKKRQPNRQRRNLGHLLREKQILVVDDNLVNRRVAEGALKKYGAIVTCVESGKAALAMLKPPHNFDACFMDLQMPEMDGFEATRRVRELEREINKKIASGEVSAEMFCKFSSWHVPILAMTADVIQATHEECMKCGMDGYVSKPFEEEVLYTAVARFFEPC

SEQ ID NO: 1205 - protein, 1036 aa, Arabidopsis thaliana
MSLFHVLGFGVKIGHLFWMLCCWFVSWFVDNGIEDKSGLLVGSVGDLEKTKMTTLKKKNKMWFWNKISSSGLKIPSFSYQFLGSVKFNKAWWRKLVVVWVVFWVLVSIWTFWYFSSQAMEKRKETLASMCDERARMLQDQFNVSMNHVQAMSILISTFHHGKIPSAIDQRTFSEYTDRTSFERPLTSGVAYAMRVLHSEREEFERQQGWTIRKMYSLEQNPVHKDDYDLEALEPSPVQEEYAPVIFAQDTVSHVVSLDMLSGKEDRENVLRARSSGKGVLTAPFPLIKTNRLGVILTFAVYKRDLPSNATPKERIEATNGYLGGVFDIESLVENLLQQLASKQTILVNVYDITNHSQPISMYGTNVSADGLERVSPLIFGDPLRKHEMRCRFKQKPPWPVLSMVTSFGILVIALLVAHIIHATVSRIHKVEEDCDKMKQLKKKAEAADVAKSQFLATVSHEIRTPMNGVLGMLHMLMDTELDVTQQDYVRTAQASGKALVSLINEVLDQAKIESGKLELEEVRFDLRGILDDVLSLFSSKSQQKGVELAVYISDRVPDMLIGDPGRFRQILTNLMGNSIKFTEKGHIFVTVHLVDELFESIDGETASSPESTLSGLPVADRQRSWENFKAFSSNGHRSFEPSPPDINLIVSVEDTGVGIPVEAQSRIFTPFMQVGPSISRTHGGTGIGLSISKCLVGLMKGEIGFSSTPKVGSTFTFTAVFSNGMQPAERKNDNNQPIFSEFRGMKAVVVDHRPARAKVSWYHFQRLGIRVEVVPRVEQALHYLKIGTTTVNMILIEQEIWNREADDFIKKLQKDPLFLSPKLILLANSVESSISEALCTGIDPPIVIVKPLRASMLAATLQRGLGIGIREPPQHKGPPALILRNLLLGRKILIVDDNNVNLRVAAGALKKYGADVVCAESGIKAISLLKPPHEFDACFMDIQMPEMDGFEATRRIRDMEEEMNKRIKNGEALIVENGNKTSWHLPVLAMTADVIQATHEECLKCGMDGYVSKPFEAEQLYREVSRFFNSPSDTES

SEQ ID NO: 1206 - protein, 524 aa, Zea mays
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYIAVRFLIGFSLATFVSCQYWMSTMFSSKIIGTVNGLAAGWGNMGGGATQLIMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCGQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 1207 - protein, 533 aa, Oryza sativa
MDSSTVGAPGSSLHGVTGREPAFAFSTEVGGEDAAAASKFDLPVDSEHKAKTIRLLSFANPHMRTFHLSWISFFSCFVSTFAAAPLVPIIRDNLNLTKADIGNAGVASVSGSIFSRLAMGAICDMLGPRYGCAFLIMLAAPTVFCMSLIDSAAGYIAVRFLIGFSLATFVSCQYWMSTMFNSKIIGLVNGLAAGWGNMGGGATQLIMPLVYDVIRKCGATPFTAWRLAYFVPGTLHVVMGVLVLTLGQDLPDGNLRSLQKKGDVNRDSFSRVLWYAVTNYRTWIFVLLYGYSMGVELTTDNVIAEYFYDRFDLDLRVAGIIAASFGMANIVARPTGGLLSDLGARYFGMRARLWNIWILQTAGGAFCLLLGRASTLPTSVVCMVLFSFCAQAACGAIFGVIPFVSRRSLGIISGMTGAGGNFGAGLTQLLFFTSSRYSTGTGLEYMGIMIMACTLPVVLVHFPQWGSMFLPPNAGAEEEHYYGSEWSEQEKSKGLHGASLKFAENSRSERGRRNVINAAAAAATPPNNSPEHA

SEQ ID NO: 1208 - protein, 516 aa, Oryza sativa
MEAKPVAMEVEGVEAAGGKPRFRMPVDSDLKATEFWLFSFARPHMASFHMAWFSFFCCFVSTFAAPPLLPLIRDTLGLTATDIGNAGIASVSGAVFARLAMGTACDLVGPRLASASLILLTTPAVYCSSIIQSPSGYLLVRFFTGISLASFVSAQFWMSSMFSAPKVGLANGVAGGWGNLGGGAVQLLMPLVYEAIHKIGSTPFTAWRIAFFIPGLMQTFSAIAVLAFGQDMPGGNYGKLHKTGDMHKDSFGNVLRHALTNYRGWILALTYGYSFGVELTIDNVVHQYFYDRFDVNLQTAGLIAASFGMANIISRPGGGLLSDWLSSRYGMRGRLWGLWTVQTIGGVLCVVLGIVDFSFAASVAVMVLFSFFVQAACGLTFGIVPFVSRRSLGLISGMTGGGGNVGAVLTQYIFFHGTKYKTETGIKYMGLMIIACTLPVMLIYFPQWGGMLVGPRKGATAEEYYSREWSDHEREKGFNAASVRFAENSVREGGRSSANGGQPRHTVPVDASPAGV

SEQ ID NO: 1209 - protein, 1013 aa, Zea mays
  unsure (1)..(1013): unsure at all Xaa locations
MGVGGGGGGGGGEAAAAVAVEGDEAGKGRRWWRVKVKLSTVAVVAWVLASAALWAGLHWRFRRAALHKAEEALVCMCEERARMLQDQFAVSVNHVHALAILVATFHYDKHPPALDQDTFAVYAARTSFERPLLSGVAYAQRVVHADRESFERQQGWIIKTMKHEPSPAQDEYAPVIYSQETISYIEGLDVMSGEEDRENILRARATGKAVLTRPFRLMSNHLGVVLTFPVYLVDLPNDTAVEDRVAATAGYLGGAFDVESLVENLLRQLAGNQELVVNVYDVTNHSNPLVMYGSEVPLGIPSPSHTYTLDFGDPLRKHQMVCRYRNKLHVSWSAITTPSGVFVICMLVGYIIYAAWSRYDNVKEDCRKMEALKKRAEAADIAKSQFLATVSHEIRTPMNGVLGMLDMLLDTELKSTQRDYAQTAQVCGKALISLINEVLDRAKIEAGKIDLESVPFDLRSILDDVISLFSSKSREKGIELAVYVSERVPEILLGDPGRFRQIITNLVGNSIKITIFTLSQFTERGHIFVQVHLADHSNLATEAKIEPVVNGMNGHKDEAIAIPTSGSHNTLSGFEAADSRNNWENFKLLLSYEKNEMPYESDSDKVTLVVSVEDTGIGIPLHAQGRVFTPFMQADSSTSRNYGGTGIGLSISKCLVEIMGGQINFVSRPLVGSTFTFTAVLRRCDKNAISDSKTVALHPLPSSFKGLSALLVDKRPVRATVTKYHLQRLGITSEVVGTIDPTFGVLSGRNGSSLTSIGKKQPCMLLIESDSWGPQMDVSLHARLQEMKQSDRIHVLPKVFLLSAAESDKVKKIHAVDSVIPKPLKASALAACLFQALGITQPSHEKRDDSGSLHGRDGSGSLHGLLLGKNILVVDDNKVNLRVAAGTLKKYGAKVECVESGKDALSLLQVPHKFDLCLMDIQMPXMDGFEATRQIRAMEGKANEQADDSESGSEIAAKTAKWHLPILAMTADVIQATHEECTKCGMDGYVSKPFEEKQLFQAVQKFLGPCVSS

SEQ ID NO: 1210 - protein, 585 aa, Arabidopsis thaliana
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWRLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 1211 - protein, 610 aa, Zea mays
MGAGATARDEETATGRHHGRKPHGAAAEYAQDGSVDLRGNPVLRSQRGGWTACSFIVVYELFERMAYYGISSNLIIYLTDRLHQGTVEASNNVTNWSGTVFLTPLLGAYVADAYLGRYWTFVVGSAIYLLGMVLLVLSVSVPALKPPPCGAGGVCPQASALQLGAYFGGLYIVALGNGGTKPNISTIGADQFDEFDPRERTHKLSFFNWWMFTIFLGILFSSTVLVYLQDNVSWSVGYGIPTLGLMVSISVFLAGTRLYRHRVPQGSPFTSMGRVLAAALWKWSVPVPADAKELHELDVEEYARKRKFRMDSTDAMAFLNKAAAVPSGGPAATPAWSLCTVTQVEETKQILRLVPLLVAMIVPCTLIAQTNTLFVKQGTTMDRHMGPRFEIPAASLGAFVTLTMLVAVVVYDRVFVRAVRRYTKDPRGITILRRMGTGMLLQVATMAVASAIESRRLAYARSHGLDATGGQLGLTIFALLPQFVLMGLADAFLVVGKIEFFYDQAPESMKSLGTAMSLTAYGIGNFLSSFLLSTVTRVTRDRGHAWVTNNLNASNLDYYYAFLTALGVVNFVAFLALSARYRYKAQSTDTIDAAVGLETEKAKLQAEPLG

SEQ ID NO: 1212 - protein, 580 aa, Zea mays
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGENDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 1213 - protein, 593 aa, Oryza sativa
MAEVTVVRAEREEESTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVGASFRKWNVHVPEDSSRLYELPDGASAIEGSRQLEHTDELRCLDKAATITDLDVKADSFTNPWRICTVTQVEELKILVRMFPVWATTIVFSAVYAQMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 1214 - protein, 580 aa, Oryza sativa
MGEVAEDIYTQDGTVDVKGNPATKKNTGNWRACPYILANECCERLAYYGMSTNLVNYMKTRLGQESAIAANNVTNWSGTCYITPLLGAFLADAYMGRFWTIASFMIIYILGLALLTMASSVKGLVPACDGGACHPTEAQTGVVFLALYLIALGTGGIKPCVSSFGADQFDENDEGEKRSKSSFFNWFYFSINIGALVASSVLVYVQTHVGWGWGFGIPAVVMAVAVASFFVGTPLYRHQRPGGSPLTRIAQVLVASARKWGVEVPADGSRLHETLDRESGIEGSRKLEHTGQFACLDRAAVETPEDRSAANASAWRLCTVTQVEELKSVVRLLPIWASGIVFATVYGQMSTMFVLQGNTLDASMGPHFSIPAASLSIFDTLSVIVWVPVYDRLIVPAVRAVTGRPRGFTQLQRMGIGLVISVFSMLAAGVLDVVRLRAIARHGLYGDKDVVPISIFWQVPQYFIIGAAEVFTFVGQLEFFYDQAPDAMRSMCSALSLTTVALGNYLSTLLVTIVTHVTTRNGAVGWIPDNLNRGHLDYFFWLLAVLSLINFGVYLVIASWYTYKKTADSPDDKAEHAGAN

SEQ ID NO: 1215 - protein, 270 aa, Arabidopsis thaliana
MELNRSEADEAKAETTPTGGATSSATASGSSSGRRPRGRPAGSKNKPKPPTIITRDSPNVLRSHVLEVTSGSDISEAVSTYATRRGCGVCIISGTGAVTNVTIRQPAAPAGGGVITLHGRFDILSLTGTALPPPAPPGAGGLTVYLAGGQGQVVGGNVAGSLIASGPVVLMAASFANAVYDRLPIEEEETPPPRTTGVQQQQPEASQSSEVTGSGAQACESNLQGGNGGGGVAFYNLGMNMNNFQFSGGDIYGMSGGSGGGGGGATRPAF

SEQ ID NO: 1216 - protein, 55 aa, Synechocystis sp. PCC 6803
MAKRRNLKKEKAERNRAYARQFRSASRTQNRRYSGGQRQQGDSNGSSNNGAASDV

SEQ ID NO: 1217 - protein, 71 aa, Synechocystis sp. PCC 6803
MFKPSLLLSLLVVGCLLTVTGCGGGNQREEGQPTQQNIEQQENNNGNANTNDDDNDNNDDDEEDDNKDGDD

SEQ ID NO: 1218 - protein, 88 aa, Triticum aestivum
MRMAKACLLRGVGLVVCALLLLSPSFMAAEATGRKWDHGREATVAVMPMAGGRFARKVLREEMVQADGDVDIAGSKRKSPGGPDPQHH

SEQ ID NO: 1219 - protein, 132 aa, Zea mays
MASRMGMVAILSLFVCALVASTSVNANVWQTDEDAFYSTNKLGVNGNMEMAQQQGGFIGHRPRLALFNRASKQLDREKRPVPSGPDPIHHSIPSHAPQHPPSYGKAPYEDDKSIASPGLSNPIGPPPFLDRY

SEQ ID NO: 1220 - protein, 954 aa, Saccharomyces cerevisiae
MDGQIDKMEKRYSMTKLENRLRTFQDGVALEKKKLKWSFKVIPYQAMAKLGFYFDPVIDPKTSKLKKDSVRCCYCHRQTYNVRDCRSKRKDVLETLSNIMRQHLTVTDNKQVCLLIYLRNKLLTDYSFHMGVSDWKNDKYFSNPDDENVINLRKFTFQDNWPHSGSQNEHPLGIEKMVNAGLMRYDSSIEGLGDPSMDKTLMNDTCYCIYCKQLLQGWSINDDPMSRHYKVSQNGNCYFFQTRNRFERIKNDNDSITKNCEVSPTLGENGKREVINTKTASQRQCPLFESPPSSTGPQLDDYNEKTDISVIQHNISVLDGAQGENVKRNSVEEKEQINMENGSTTLEEGNINRDVLADKKEVISTPTAKEIKRPNVQLTQSSSPIKKKRKFKRISPRKIFDEEDSEHSLNNNSANGDNKDKDLVIDFTSHIIKNRDVGRKNAILDDSTDEFSFSNQGHNTFDIPIPTSSHLLKGIDSDNDNVIREDDTGINTDTKGASSKHEKFSVNSEEDLNFSEVKLTGRDSSTNILIRTQIVDQNLGDIDRDKVPNGGSPEVPKTHELIRDNSEKREAQNGEFRHQKDSTVRQSPDILHSNKSGDNSSNITAIPKEEQRRGNSKTSSIPADIHPKPRKNLQEPRSLSISGKVVPTERKLDNINIDLNFSASDFSPSSQSEQSSKSSSVISTPVASPKINLTRSLHAVKELSGLKKETDDGKYFTNKQETIKILEDVSVKNETPNNEMLLFETGTPIASQENKSRKLFDEEFSGKELDIPIDSSTVEIKKVIKPEFEPVPSVARNLVSGTSSYPRNSRLEEQRKETSTSLADNSKKGSSFNEGNNEKEPNAAEWFKIDENRHLVKNYFHDLLKYINNNDATLANDKDGDLAFLIKQMPAEELDMTFNNWVNLKVQSIKREFIDDCDKKLDILRRDYYTATNFIETLEDDNQLIDIAKKMGIL

SEQ ID NO: 1221 - protein, 270 aa, Arabidopsis thaliana; identical to SEQ ID NO: 1215

SEQ ID NO: 1222 - protein, 196 aa, Saccharomyces cerevisiae
MVDNRRTFTAPQSLLETNLTFPNDEPSLTTITVTRERCVDPSLIDSFLRFLRHGSDDIIRQKLNNYRKGSINGKNKCKEFLKQELYPNWQIRNNIISFCEKEAAEMKNETDQQCGNNKKTTAEPLIDARIDPYAARERAEKQEAQYKDWTKVTEWVANNRKIEQILTSTTEGILRQNCEQNNDYLKEFTQFCKDNS

SEQ ID NO: 1223 - protein, 137 aa, Saccharomyces cerevisiae
MNDGQFLFQRNDPIILYTFLLKSNYTVFRSIDERLCDFVFYIDHFLNKRISYRIPILIRNNNTNILNNCPSSFPPLVDLVGHRLVAAEDNPVAVDLVDNNLVVVDLVDNNLAVGVLVGSNLVVGSLVFALLTCFEDG

SEQ ID NO: 1224 - protein, 206 aa, Saccharomyces cerevisiae
MSLYFTTLFLLLTVEVVMLFIFVLPLPFRIRRGIFSTYNQLTAKQQIKTIIFITGCLVGLLFIDSWKRSQIRVSLYHNDNSGSIGSSAVTPIQALASRAYNQRNMYISGFILYFSICIPTVMSIVKRLVKYQGLINEQEKQKLNKPSSNSKKDSNEADSTKLQEELRKKQISLEGLQKQVKNLEKYFDEKNQPGNVAAAEASKKGN

SEQ ID NO: 1225 - protein, 118 aa, Saccharomyces cerevisiae
MQHTLTRTASLPERSSSAHSAATALPALRRPPDSCETLVPLLCIFWFVFVSMSPLPPARANKSDNKGLISADRNNKATLLLTIPRCTSKSYTNDLSPLKMTLLSAGKHPRPFRQEHRC

SEQ ID NO: 1226 - protein, 103 aa, Saccharomyces cerevisiae
MLFFTGLVILSYLLGGKKDWLLIMYEASDYLEFLNRLSSMLFKFELFEHLSSTFLIFSHSKRAVKLLEIYRSRHISIYNVFLLRHPKYFQSVDIALYLTRSQT

SEQ ID NO: 1227 - protein, 838 aa, Saccharomyces cerevisiae
MSEYLAQTPCKFTIWSSEIDLIRTNLLVNAHPLSTVGRLLQYIHYQIYKQLRAIYQPEEQCTNSEIPHTPLNSINTYFLSYEGRELSATCLLKDITSSSHPDSNHFIRLQLEKRTSPSGSAFDLEYDMEGEFNSMNIQFEINTLSSQRIFNSMEPNLPIGTTLARLEKLALERIKDFEKSAGNLCGIKEDHSVSDLQGFIIKGKQTPMFLNYGSDSDYYKDLNLVDLIGIDFAPAHNSFFTFLFKMNHEQNSHIANDEERFVLEFISDATLSITQMNVKPDTTVKQVKDFICSVYTHSLNLRRNDIKLIYKGQLLHENNFAGNSSKISEYIKEPHEVKVHVQINQEYTESGPGFWNEVFNNPNIFQFMPPDTRSQSPVSFAPTQGRSPAAIRGEERGIPYVTESGNDIVPTDELYRKCIINGDEVVFIPVSELNPQSSYLSVIKGDYGEIKIPISSNDYRINGDNILLSPSAIEQLESALNFKIERPRDSTLLHPSGEHVRAADNTSSANDNNTVENDESAWNRRVVRPLRNSFPLLLVLIRTFYLIGYNSLVPFFIILEFGSFLPWKYIILLSLLFIFRTVWNTQEVWNLWRDYLHLNEIDEVKFSQIKEFINSNSLTLNFYKKCKDTQSAIDLLMIPNLHEQRLSVYSKYDIEYDTNTPDVGQLNLLFIKVLSGEIPKDALDELFKEFFELYETTRNMNTLYPQDSLNELLLMIWKESQKKDINTLPKYRRWFQTLCSQIAEHNVLDVVLRYIIPDPVNDRVITAVIKNFVLFWVTLLPYVKEKLDDIVAQRARDREQPAPSAQQQENEDEALIIPDEEEPTATGAQPHLYIPDED

SEQ ID NO: 1228 - protein, 219 aa, Saccharomyces cerevisiae
MLKLTTTSVTFHVLRYFQLGLSVTNLLLASFAIITNYKVDRILRLSLAVSIISSVYFGIVRFLPVLLIFVMEIVQTVLWFTAFVTLASKFGSMSCSSMPRGINFDYSGSCKIAKIDILPEAVLFILFLATTYASYITVLSQAKENGSSTRSVLKACVKALRDTVDRLETSLEESEPLLDLEVQEDARTETESIEDSTDSEDNANIEQEKVIDGSIEHSS

SEQ ID NO: 1229 - protein, 699 aa, Glycine max
MRGPLGAVIGRYPSSDGVTQMGGIIRHNRKCRDITVLVIFIAFWIAMIVRVGFGFNQGNPLRLTYGLDYKGNVCGDKHAHPGLSELELRYWQNPNQVYQSGLKDSQFKLADARSICLSECPMPSEDSLNWVCDYPEGDIRLSMKDWINRNYDYFEFLTPEMRNSSLQLQGPCYPVIFPTVNVYWSCQFIARASNTSLKHWQQMGGVNINEDIVIDKSIHKSINSRSAVLERYMADIGKAWPVLIVCGGILPLFLSVIWLMMIRHFVAAMPWITVVLFNVLIISVTMFYYLKAGWIGNDAISPIIGEHDPYISVYGRELTHIRVVTILMTFIMVVAILTSIAIVRRILMATSVLKVAAKVIGEVQALIIFPLIPYTVLAVFYMFWISAALHLFSSGQVVQNNCNSNCCTYDLIAKRVNCDRCCGYSIHYTPHIGVAILFHLFGCYWATQFFIACSSTVIAGSVASYYWARGETSPEIPFLSVFSSMKRLMRYSLGSVALGSLIVSFVESIRFLLEAIRRKLKVSSHGHDSCLGKAAYQFSQCFLRCIEWTIKSVNRNGYIMIAITGKSFFSASFIATELIMNNILKIGRLNVIGDVILFLGKLCVSLSCALFAFLMLDTHKYNSAHNKTSSPLLPVVVCWALGYIVATLFFAVVEMSIDTIVLSFCQDSEEHQGTAQYAPPLLVETLSDQNEMQRLTQGP

SEQ ID NO: 1230 - protein, 154 aa, Glycine max
  unsure (1)..(154): unsure at all Xaa locations
LESPHAAPARSTRPDDYSNDNVVRPKEYWDYKTFNVQWGEQDDNXAVRKVGRGKYSEVLEGAHCTDGEKCVIKILKPVKNNKINREIIILHNLCGGPNIVQVLDIVRDQQAKTPRLIFEYANNTDMKVLYPTLANYELRFYFYELLKALYYCLS

SEQ ID NO: 1231 - protein, 165 aa, Glycine max
  unsure (1)..(165): unsure at all Xaa locations
WNPLLLPPRFSSLRHFSTTTRLVAHNSVSETVPIHKEKEQLPSVKPTYSPTPSPRAPRAPPSGYPFDGTTRKFFEGWYFKVSIPERRQSFCFMYSVESSPRFXDPLTPLELAQYGPRFTGVGAQILGADDKYICQYSPQSQFFWGSTHFLSTLLCSFNFLYYFLE

SEQ ID NO: 1232 - protein, 202 aa, Glycine max
MENSLGKYGKELNLEATELRLGLPGSDEPEKRSAVRSNKRSSPEASEEECISKGNMNSSDGSDITSDDQDNVVPPAKAQVVGWPPVRSYRKNSLQQKKEEQAEGAGMYVKVSMEGAPYLRKIDLKVYKSYPELLKALENMFKCTFGQYSEREGYNGSEYAPTYEDKDGDWMLVGDVPWNMFVSSCKRLRIMKGSEAKGLGCF

SEQ ID NO: 1233 - protein, 130 aa, Glycine max
SGITASTHASALPQVLAQATEMLYMRLDTMNTTCVDRFINWFSHHLSNFQFRWSWEDWSDCLSQDPESPTPKLVREVLDKCMRLFYHQRILDIVHLTFSALCAANPTCIYKYGDERSHFLPGDVVAFLHN

SEQ ID NO: 1234 - protein, 572 aa, Glycine max
MMNYFPDEVIEHIFDYVVSHSDRNALSLVCKSWYRIERCTRQRVFIGNCYSITPERLIQRFPGLKSLTLKGKPHFADFSLVPYDWGGFVHPWIEALAKNKVGLEELRLKRMVVSDESLELLSRSFTHFKSLVLVSCEGFSTDGLAALAANCRFLRELDLQENEVEDHKGQWLSCFPDNCTSLVSLNFACLKGEVSLGALERLVARSPYLKSLKLNRSVPFDALQRIMMRAPQLSDLGIGSFVHDPESEAYIKLKNTILKRKSITSLSGFLEVAPHCLAAIYPICPNLTSLNLSYAAGIQGSDLIKLIRHCVKLQRLLIMDCIGDKGLDVVATSCKDLQELRVLPSVPFGNPAAVTEKGLVAISMGCPKLHSLLYFCHQMTNAALITVAKNCPNFIRFRLCILDATKPDPDTMQPLDEGFGAIVQSCRRLRRLSLSGQLTDQVFLYIGMYAEKLEMLSIAFAGEGDKGMLYVLNGCKKLRKLEIRDCPFGDMALLTDVGKYETMRSLWMSSCEVTVGACKLLAKKMPRLNVEIFNENEQEDCSLEDGQKVEKMYLYRTLAGKRKDAPEYVWTL

SEQ ID NO: 1235 - protein, 294 aa, Glycine max
MDQYEKVEKIGEGTYGVVYKARDRATNETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEDTWPGVTSLPDFKSTFPKWPSKDLANVVPNLDAAGLNLLSSMLCLDPSKRITARSAVEHEYFKDIKFVP

SEQ ID NO: 1236 - protein, 294 aa, Glycine max
MEQYEKVEKIGEGTYGVVYKARDRVTNETIALKKIRLEREDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEDTWPGVTSLPDFKSTFPKWPSKDLANVVPNLDAAGLNLLSSMLCLDPSKRITARSAVEHEYFKDIKFVP

SEQ ID NO: 1237 - protein, 110 aa, Glycine max
  unsure (1)..(110): unsure at all Xaa locations
NTGQMEANKPERXKITEPKTPYHPMIDDDRQLSHVRRSFDAYIDDQHHTMHAEAIWSAVNDVDFSSRRSTGQSGGXTSSEDVSETLEHDDDDRNLSYKEHRKAHYDEFLK

SEQ ID NO: 1238 - protein, 268 aa, Glycine max
LRMWNFASSLIAGSVGLKNDSPKPTHSASEFSDDETSMVSREERLECPICWESFNIVENVPYVLWCGHTLCKNCILGLQWAVVNFPTLPIRLPLFISCPWCNLLSLRLVYQGNLKFPHKNYFLLWMGENMNGDRVKSHSTVCGDHQPVWPIIDSLTNGSQVSHDSLQGGQVCHPESSSSNHYHGDTSNYLSIETLHTSLRKSLVLFVHLTAKFPLIIIFLLIVLYAIPVIAAILALYILVTILFALPSFLILYFAYPSLDWLVREIIT

SEQ ID NO: 1239 - protein, 414 aa, Glycine max
  unsure (1)..(414): unsure at all Xaa locations
MVAMAAATASTQLIFSKPCSPSRLCPFQLCVFDTKQVLSSSSGRRRHVGGSGVRCMAVGEAATTGTKKRSGYELQTLTSWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDPTVSLLDTTEQRCIVXNVCQPGSNLLAAGYCMYSSSIIFVLTLGNGVFVFTLDPMYGEFVLTQENXQSLRAGKIYAFNEGNYQLWDEKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 1240 - protein, 285 aa, Glycine max
MLQQRSVPAPFLTKTYQLVEDPGTDEVISWGESGNTFVVWKHADFAKDLLPKYFKHNNFSSFVRQLNTYGFRKIVPDKWEFANEHFKRGQKELLSEIKRRKTVPQSSTHSPDAGKPGAEGNSPSNPGGCDDAGSTSTSSSSSGSKNQGSVETNTTPSHQLSSENEKLKKDNETLSCELARARKQCDELVAFLRDRLMVGPDQIDRIMRQGSCGSENAVGEGGGGGHCLKLFGVWLKGDTLTDKRNNHKRGREDQMGFGGPRLKESKPVVDFSRNRMMMINEKGKG

SEQ ID NO: 1241 - protein, 282 aa, Glycine max
MSQRSVPAPFLTKTYQLVEDQGTDQVISWGESGNTFVVWKHADFAKDLLPKYFKHNNFSSFVRQLNTYGFRKIVPDKWEFANEHFKRGQKELLSEIKRRKTVPQSSAHPPEAGKSGGDGNSPLNSGSDDAGSTSTSSSSSGSKNQGSVETNTTPSHQLSSENEKLKKDNETLSCELARARKQCDELVAFLRDRLMVGPDQIDRIMRQGSCGSENVVGEGGGGDCLKLFGVWLKGDTLTDKRNNHKRGREDQMGFGGPRLKESKPVVDFGAVNIMMKSNRVCN

SEQ ID NO: 1242 - protein, 180 aa, Glycine max
  unsure (1)..(180): unsure at all Xaa locations
LFCGAEAMEVQSLSFENNILWVGSFVEALVLDTFLATAKSLACFVILTGSLLTDVNNLVSPMVDGRFPLDQLCKGKHTFEENKDASDTEDDDDDDDVNDGEDXDDDDEDDEDFSGDDGGEEADSDDDPEANGGGGSDDDDEDDDDDDDDNDEDDGDEDDDDEGDDDEDEESPQPPSKKRK

SEQ ID NO: 1243 - protein, 88 aa, Glycine max
  unsure (1)..(88): unsure at all Xaa locations
CDKSLNLISTKKDNPAMGTVESLKFVVWSEYIRDRATLVVAYGISINLVEVTXKSKLKAQFPSPIEYAGFTGDFAPAPGIATFRGMRC

SEQ ID NO: 1244 - protein, 60 aa, Glycine max
MSDSSRDENVYNAKLADHVDRYDEMVEFMDNVPDTVEVEELTVDETNLLSVAYNNVIGAM

SEQ ID NO: 1245 - protein, 146 aa, Glycine max
MTDAAVSFAGDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFWRYFAGNLASGGAAWATSLCFVYPLDFARTRLASDVG

SEQ ID NO: 1246 - protein, 515 aa, Glycine max
SRADSARVTLEVGGDQIYSSRQQGTQNDAQSKKHDSSRSSGFPGTKGPSDEMWDVMEPSVEQGQVAKETDISKETGKAVVTRTGRSLWGMIGDIVQLRWGSRAGSSTSAGRSAERNSPNKSDSDTWFSGQEHEETTKTNVLKKTSVPPQVMTSDKLKPGKHYTQSEGEVSDNTKLKDKGKNVEVGLSSPNTLESGSMLVGVSYTSGEENASWTEDREDLKATTSGTQNMELPISVPARGPSIVGEIVSIGGSDMSGAESVVPIKESVAPGRSELSGSERKDGELKQRKFQRNRQVLREDDRRGEEAYQRELEQRRVDEMFMKEALLEAKKAADTWEVPVGAVLVQHGKIIARGCNLVEELRDSTAHAEMICIREASNLLRSWRLSDTTLYVTLEPCPMCAGAILQARVDTVVWGAPNKLLGADGSWIRIFPDGGENVSEQRDIPPAPVHPFHPNMKIRRGVLATECADAMQQFFQLRRKKKKEEPPNGPSSLPVTHHPSKLLNKIHDVFHIMFCL

SEQ ID NO: 1247 - protein, 67 aa, Glycine max
  unsure (1)..(67): unsure at all Xaa locations
RLVKAMPSLVFTSVLEDNCTSRTCAICLEDYCVGEKLRILPCRHKFKAACVDXWANLRENLCPIWKP

SEQ ID NO: 1248 - protein, 81 aa, Glycine max
  unsure (1)..(81): unsure at all Xaa locations
NVVTSVGIRLVNKALMATYGFNFATXLTALHHSTTTLLTLTLKSISYIHTSHLPLSDIIKFVSFAYFFIVVINVILMLNSY

SEQ ID NO: 1249 - protein, 103 aa, Glycine max
  unsure (1)..(103): unsure at all Xaa locations
LTGVRVLKNCVARLMEIHRGDSSKAKLVTNXKVLDHTMCCSGITYYALFERKLYSLEWERLYDYCDLLQLHKLSSAHLIFLSRDYCKFKPMLMYDIVVKNMYA

SEQ ID NO: 1250 - protein, 354 aa, Glycine max
MGAERFSHDHAPLILGLQPSALVDNVATVDWSLLHRIPGERGGSIPVQIEELESILREVKSKSHDDIKTLAGGSVANTIRGLSRGFGISTGIIGAYGDDHQGQLFLTNMTFNSVDLSRLRQKKGHTAQCVCLVDDMGNRTMRPCLSNAVKVQAQELVKEDFKGSKWLVLRYAVLNLEVIQAAIHLAKQEGLLVSLDLASFEMVRNFKLPLLKLLESGNIDLCFANEDEAAELLRDEQKDDPIAAVEFLSKYCQWAVVTLGANGCIAKHGKEMIQVPAIGETKATDATGAGDLFASGFLYGVVKGLSLEECCKVGTCSGGSVIRSLGGEVTSENWQWMYKQMQINGLPTPPGLCK

SEQ ID NO: 1251 - protein, 375 aa, Glycine max
MGSDKILPSHVVANGHAPLDSGHARLKELGYKQELKRDLSVISNFAFSFSIISVLTGVTTLYNTGLNYGGPVSLVYGWFLASAFTMIVALSMAEICSSYPTSGGLYYWSAKLAGPRWAPFASWITGWFNIVGQWAVTTSVDYSLAQLIQVIILLSTGGKNGGGYEASKYVVIAFHGGILFLHGIINSLPISLLSFLGQLAAIWNVIGVFVLMIVIPSVATERASAKFVFTHFNTENGEGINSKPYIFLLGLLMSQYTLTGFDASAHMTEETKDADRNGPKGIISAVGISIVVGWGYILGITFAVTDILYLLSEDNDAGGYAIAQVFYQAFKKRYGHGTGGIICLVIVAVAIFFCGMSSVTSNSRYINVLPLSAFI

SEQ ID NO: 1252 - protein, 371 aa, Glycine max; identical to SEQ ID NO: 1168

SEQ ID NO: 1253 - protein, 40 aa, Glycine max
QFDNLYGCRHSLPDGLMRATDVMIAGKVAVVAGYGDVGKG

SEQ ID NO: 1254 - protein, 93 aa, Glycine max
  unsure (1)..(93): unsure at all Xaa locations
SLDFPFIQQFMILTSLSLSNSTPYLGGVLLLIVSAWLASAKSLYTQFTSLRKEXELYKEIERASSVKIPIISYTDSVNCFFATVSPLNPFSCY

SEQ ID NO: 1255 - protein, 71 aa, Glycine max
GKGQALAFLLEKLKADEQGPINTLVWGDSRNDAELVTGPEGNGVLVNNAQEKLVQWVSKNSRGNPPIIHST

SEQ ID NO: 1256 - protein, 111 aa, Glycine max
MAEEKHHHHFHHHKGDDVPGEVDYKKEEKHHKHLEHLGELGAAAAGAYALHEKHEAKKDPEHAHRHKVEEEIAAAATVGAGGFVLHEHHEKKEVKKEDEEAHGKKHHHLFG

SEQ ID NO: 1257 - protein, 84 aa, Glycine max
VLFLLPPYEGKPEEEPGARIDRFTAALTPKAIQTLSEDFSARAIKKNVRIHGHHKNAKHMCARVTGDNLGIRERSADLILQNRL

SEQ ID NO: 1258 - protein, 482 aa, Glycine max
MHIQMSSFLLASLALLFCISSLEKSFAFQATKESNNLRQYHSVHLNSLFPSSSCSSSAKGPKRKASLEVVHKHGPCSQLNHSGKAEATISHNDIMNLDNERVKYIQSRLSKNLGGENRVKELDSTTLPAKSGRLIGSGDYYVVVGLGTPKRDLSLTFDTGSYLTWTQCEPCAGSCYKQQDPIFDPSKSSSYTNIKCTSSLCTQFRSAGCSSSTDASCIYDVKYGDNSISRGFLSQERLTITATDIVHDFLFGCGQDNEGLFRGTAGLMGLSRHPISFVQQTSSIYNKIFSYCLPSTPSSLGHLTFGASAATNANLKYTPFSTISGENSFYGLDIVGISVGGTKLPAVSSSTFSAGGSIIDSGTVITRLAPTAYAALRSAFRQGMEKYPVAYGTRLFDTCYDFSGYKEISVPRIDFEFAGGVKVELPLVGIFYGESAQQLCLAFAANGNGNDITIFGNVQQKTLEVVYDVEGGRIGFGAAGCN

SEQ ID NO: 1259 - protein, 504 aa, Glycine max
  unsure (1)..(504): unsure at all Xaa locations
MDFTPPPIEDGFTAEKLFTQGFSYTYDDVIFLPHYIDFAADVVDLSTRLTRRLPLAVPFVASPMDTVSXESAMASAMASLGGIAVVHSNVPAAVQAAILRKAKSRRVPILSEIRHQAPSAVVEHDDAFGASPFLLVTDTGTSAGKLLGYVAKSDWTNHTDKGLRVGDYMAPPPKPVPWNADLNKINEIFESEKSGAVALEKDGEVVDLVVREEVERVKGYPKLVAPATVGADGEFMVGAAVGTREDDKERLEHLVKAGLNVVVLDSSQGNSIYQLEMVKYVKRVYPELDVIGGNVVTMYQAENLIQAGVDGLRVGMGSGSICTTQEVCAVXGRGQATAVYKVSSIAYKSGVPVIADGGISNSGHIVKALSLGASTVMMGSFLAGSLEAPGAYVYQNGQRVKKYRGMGSLEAMTKGSDARYLGDTAKLKIAQGVVGAVKXKGSVLNFIPYTLQAVRQGFQDIGANSLQSAHDLLRSRVLRLEVRSGAAQVEGGIHGLVSYEKKYF

SEQ ID NO: 1260 - protein, 575 aa, Glycine max
MEFARTMFCSSPPFPPRTHHPWSTLPSSSSTSSVLMLHEQASPTVASWSSNFSAQNFPASVLLPEQRDEYRPLLHMSKEDKTSQAMLSTRQMDTVTVHEENNTENADQVVLDFRKHLHHWPNLQYLLTSSQIGEVAASSTLEHVSVDLERRPNGVQFNGVSLAKKALSTSKQESSVVEDLKSIKADDDSIPFGLASTGLADPSIGRNKTVRSTRLLERRSKQRKVPKSKVIDDETYLARKDDAQEKLRAEKKKNEELDQDDPLRLFLWGPETKQLLTLEQESQLISQIQDLLRLEEVKTNLQSQFGREPTMAEWAEGAGLNCRLLQSQLHSGNRSREKLIQANLRMVVHVAKSYQGRGLSLQDLLQEGSMGLMKSVEKFNPLAGSRFGNYAFWWIRQAIRKAVFRHSRTIRLPEKVFILLGKVMEAKKLYIQEGNLHPTKEELARRVGVTVEKIDKLLFSARIPISMQQTVWADQNTTFQEITADPTVEATDVTVEKQLMRRHVLNVLSVLHPKERRIIRLRYGFEDGEQKSLSEIGDIFGLSKERVRQLEIRALYKLKKCLVKQGLDAYVDLLL

SEQ ID NO: 1261 - protein, 506 aa, Glycine max
  unsure (1)..(506): unsure at all Xaa locations
MDFTPPPIEDGFTAEKLFTQGFSYTYDDVIFLPHYIDFAADVVDLSTRLTRRLPLAVPFVASPMDTVSESAMASAMASLGGIAVXVHSNVPAAVQAAILRKAKSRRVPILSDPAFAAPSAVVEHDDAFGASPFLLVTDTGTSAGKLLGYVARSDWTNHTDKGLRNGDYMAPPPKPAPWNADLNKINYFRESEKSGAVALERDGEVXVVDLVVREEVERVRGYPKLVAPATVGADGEFMVGAAVGTREDDKERLEHLVKAGLNVVVLDSSQGNSIYQLEMVKYVKRVYPELDVIGGNVVTMYQAENLIQAGVDGLRVGMGSGSICTTQEVCAVGRGQATAVYKVSSIAYKSGVPVIADGGXISNSGHIVKALSLGASTVMMGSFLAGSLEAPGAYVYQNGQRVKKYRGMGSLEAMTKGSDARYLGDTAKLKIAQGVVGAVKDKGSVLNFIPYTLQAVRQGFQDIGASSLQSAHDLLRSRELRLEVRSGAAQVEGGVHGLVSYEKKYF

SEQ ID NO: 1262 - protein, 364 aa, Glycine max
  unsure (1)..(364): unsure at all Xaa locations
MEHADKGKESSNSINEVEVTNSPIICGLPDDISLMCLARIPRKYHSVMKCVSKRWRNLICSEEWFCYRRKHKLDETWIYALCRDKSNEIFCYVLDPTLSRRYWKLIEINSHFILXTNRKGMGFEALGNXLKLLGGCSGFLDSTDEAYSYDAGSNCWVEAASLSNARCYFACEVLDEKLYAIGGLVSNSSDNSWDTFDPLTKCWTFHIDPNIASDIEDSVVLDGKIYTRCARHTDVASHAFAVVYEPSSGTWQYADADMVSGWTGPAVVVYGTLYVLDQSLGTRLMMWHKERREWIPVGKLSPLLTRPPCQLVAVGKSIFIVGKTLSTVVVDVGDLGNEGQVMMGSSIPGLLSDFNVISCKCLSI

SEQ ID NO: 1263 - protein, 43 aa, Glycine max
MDQLPVEVIGNILSHLRAARDVVIASATCRKWRQACCKHLHTL

SEQ ID NO: 1264 - protein, 108 aa, Glycine max
  unsure (1)..(108): unsure at all Xaa locations
SHMSSAAAYVEGGNQESCDDACSICLEEFDASDPLSVTTCEHEFHLQCILQWCQRSSYSPMCWHPISLKDPTKXEVDEGVQQRRSLTATPSRNAAVLHHPAFGDIEMQ

SEQ ID NO: 1265 - protein, 399 aa, Glycine max
MEDQNGSGKLSQGLRKVKPYLAILSLQFGYSGMYIITMVSFKHGMSHWILSVYRHVVAAIIIVPFALVLERKIRPKMTLPIFLRIVALGFLEPVLDQNLYNMGMKMTSTTFASATVNVLPAITFVMALIFRLEKVNLRKFHSVAKVIGTLITVSGAMVMTLYKGPAFQIIKGGGAISNHSNSSSTSTTEPSDQHWIVGTVYLISSCASWAGFFILQSFTLKKYPAELSLTAWICVMGIIEGSIASLIFERDFSVWAIGWDSRLLACVYSGVICSGMAYYVQGVVTRERGPVFVTSFSPLCMIITAALGSLVLAEQVHLGSIFGAILIVCGLYTVVWGKSKDRKSTTEIEKGESQELPIKNGTKSASDIFDGIEINVPSEVLKKGGGKNVPPATTTTTTS

SEQ ID NO: 1266 - protein, 140 aa, Glycine max
MASHRQSYEAGQTKGRTEEKTNQTMGNIGEKAQAAKEKTQEMAQAAKEKTQQTAQAAKDKTCDTSQAAKEKTQQNTGAAQQKTSEMGQSTKESAQSGKDNTQGFLQQTGEKVKGAAQGATEAVKQTLGLGEHDQDNRRNY

SEQ ID NO: 1267 - protein, 239 aa, Glycine max
MGRGRVDLKRIENKINRQVTFSKRRSGLLKKAREISVLCDADVALIVFSTKGKLLDYSNQPCTERILERYERYSYAERQLVGDDQPPNENWVIEHEKLKARVEVLQRNQRNFMGEDLDSLNLRGLQSLEQQLDSALKHIRSRKNQAMNESISELQKKDRTLREHNNLLSKKIKEKEKELTPQEQEGLQNNMDVSSVLVTQPLESLTIGGSPEVKSNEETPTSCRPKTILPPLMPLPTNE

SEQ ID NO: 1268 - protein, 91 aa, Glycine max
  unsure (1)..(91): unsure at all Xaa locations
FTGKLVDAFFYGLTSTLXIILSCAISLFTNLIHFICIGRFTALTFQFLFHIKTILVLILXFIFFLKYGLNLHFFLFIIILISLIVSYFFSF

SEQ ID NO: 1269 - protein, 214 aa, Glycine max
MVRGKVQLKKIEDTTSRQVTFSKRRSGLLKKAYELSVLCDAEVAVIVFSQNGRLYEFSSSDMTKILERYREHTKDVPGSKFGDDYIQQLKLDSASLAKKIELLEHSKRELLGQSVSSCSYDELKGIEEQLQISLQRVRQRKTQLYTEQIDQLRSQESNLLKENAKLSAMWQRAEKSSQQQWPRHTQAEAEPHCSSSQSLDVDTELFIGLPKQQC

SEQ ID NO: 1270 - protein, 277 aa, Glycine max
  unsure (1)..(277): unsure at all Xaa locations
MLEGLDEEGCVEEPGHHSEKKRRLSVDQVKALEKNFEVENKLEPDRKLKLAQELGLQPRQVAVWFQNRRARWKTKQLERDYGVLKANYESLKLNYDTLQQDHEALLKEIKELKSRLVQEENNNNTESDVSVKEEMLTTTLCETAIXPGSDTKELSYECFNKSDEVGGGSSVFHVDFKDGSSDSDSSAILNEENNNHSPNNNAAISSCGVLQSHGLLLSPSSSSMNNCFQFQKQYQTTTTQYVKMEEHNFLSADEXACNFFSDEQAPTLQWYCSEEWS

SEQ ID NO: 1271 - protein, 315 aa, Glycine max
MKRLGSSDTLGALMTICPPTDEHSPRNNHVYGKEFQSMLEGLDEEGCVEEAGHHSEKKRRLNVDQVKALEKNFEVENKLEPDRKVKLAQELGLQPRQVAVWFQNRRARWKTKQLERDYGVLKANYGSLKLNFDTLQQDNEALLKQIKELKSRLVQEENNNNTESDVSVKEEMIATLQDSNPLCESAIPGSDSKELSYECFNKSDEVGGGSVFPVDFKDGSSDSDSSAILNEENNNHSPNNNAAISSCGVLQSHGLLSSPSSSSMNNCFQFQKQYQTTTQYVKMEEHNFLSADEACNFFSDEQAPTLQWYCSEEWS

SEQ ID NO: 1272 - protein, 312 aa, Glycine max
MKRLGSSDSLGALMTICPPTDEHSPRNNHAYGREFQSMLEGLDEEGCVEEPGHHSEKKRRLSVDQVKALEKNFEVENKLEPDRKLKLAQELGLQPRQVAVWFQNRRARWKTKQLERDYGVLKANYESLKLNYDTLQQDHEALLKEIKELKSRLVQEENNNNTESDVSVKEEMLTTTLCETAIPGSDTKELSYECFNKSDEVGGGSSVFHVDFKDGSSDSDSSAILNEENNNHSPNNNAAISSCGVLQSHGLLLSPSSSSMNNCFQFQKQYQTTTTQYVKMEEHNFLSADEACNFFSDEQAPTLQWYCSEEWS

SEQ ID NO: 1273 - protein, 278 aa, Glycine max
MLEGLDEEGCVEEAGHHSEKKRRLNVDQVKALEKNFEVENKLEPDRKVKLAQELGLQPRQVAVWFQNRRARWKTKQLERDYGVLKANYGSLKLNFDTLQQDNEALLKQIKELKSRLVQEENNNNTESDVSVKEEMIATLQDSNPLCESAIPGSDSKELSYECFNKSDEVGGGSVFPVDFKDGSSDSDSSAILNEENNNHSPNNNAAISSCGVLQSHGLLSSPSSSSMNNCFQFQKQYQTTTQYVKMEEHNFLSADEACNFFSDEQAPTLQWYCSEEWS

SEQ ID NO: 1274 - protein, 286 aa, Glycine max
  unsure (1)..(286): unsure at all Xaa locations
MPTGLPAANSLVAPDEEGWVWGQIKAEARRDAESEPALASYLYSTILSHSSLERSLSFHLGNKLCSSTLLSTLLYDLFLNAFSSDPSLRSAAVADLRAARERDPACVSYSHCLLNYKGFLACQAHRVAHLLWRQSRRPLALALHSRIADVFAVDIHPAARIGKGILFDHATGVVVGEXSGNREQCVDPAPCXLGGTGKVGGDRHPKIGDGVLIGAGATILGNIKIGEGAKVGAGSVVLIDVPPRTTAVGNPARLVGGKEKPSKHEDVPGESMDHTSFISEWSDYII

SEQ ID NO: 1275 - protein, 109 aa, Glycine max
  unsure (1)..(109): unsure at all Xaa locations
MSKARVYTVVNVLRPKEYWVYXCLTAQWGDQDDYEVVRKEGRGKYREVFEGINVHSNERCIINILKPVKRKTIXREIEILQNLCGGPNIVKLLDIGRDQHCKTPSLISE

SEQ ID NO: 1276 - protein, 492 aa, Glycine max
  unsure (1)..(492): unsure at all Xaa locations
MALLVEKTXSGREYKVKDLSQADFGRLEIELAEVEMPGLMACRTEFGPXSQPFKGARITGSLHMTIQTAVLIETLXTALGAEVRWCSCNIFSTQDHAAAAIARDSAAVFAXWKGETLQEYWXWCTERALDWGPGGGPDLIVDDGGDATLLIHEGXSRPDELYEKTGELPDPNSTDNAEFQIVLTIIRDGLKTDPTRYRKMKERLVGVSEETTTGVKRLYQMQANGTLLFPAINVNDSVTKSKFDNLYGCRHSLPDGLMRATDVMIAGKVAVVAGYGDVGKGCACXPLKQAGARVIVTEIDPICALQALMEGLQVLTLEDVVSEADIFVTTTGNKDIIMVDHMKKMKNNAIVCNIGHFDNEIDMXGLENYPGXVKRITIKPQTDRWVFPETNVGIIVLAEGRLMNLGCATGHPSFVMSCSFTNQVIAQLELWKEKSTGKYEKKVYVLPKHLDEKVAALHLGKLGAKLTKLSPAQADYISVPVEGPYKPAHYRY

SEQ ID NO: 1277 - protein, 80 aa, Glycine max
  unsure (1)..(80): unsure at all Xaa locations
WNNPVGPKTINFWAPTFKGGLSFANIAVFXKPPEKLSFPKQLAATVPGFFWSGSRTVLTPKIGTLFRVNFALAGPGFSQL

SEQ ID NO: 1278 - protein, 225 aa, Glycine max
  unsure (1)..(225): unsure at all Xaa locations
MGDREQLLQRARLAEQAERYDDMASAMKAVTELNEPLSNEDRNLLSVAYKNVVGARRSSWRVISSIEQKTMADGNEKKLEKVKAYREKIEKELETVCNDVLALLDKFLIKNCNDFQYESKVFYLKMKGDYYRYLAEVASGEKKNSVVEASEAAYKEAFEISKEHMQPTHPIRLGLALNFSVFYYEIQNAPEQACLLAKQAFDDAIAELDTLNEDSYKDXTLIMQL

SEQ ID NO: 1279 - protein, 218 aa, Glycine max
  unsure (1)..(218): unsure at all Xaa locations
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQPESKVFYLKMKGDYYRYLAEVAAGDDKKGIVDQSQQAYQEAFEISKKEMQPTHPIRLGLALNFSVFYYEILNSPEKACSLXKTAFDEAIAELDTLSEESYKDSTLIM

SEQ ID NO: 1280 - protein, 262 aa, Glycine max
  unsure (1)..(262): unsure at all Xaa locations
AVEAVMSVQVVSAAAAAKVPEVELKDLSPSEAEPQLGLSAAAVGAMVPPAGGGDPEAPAPAPAAERPPAPGPGSGPTAALSPAAGKVPQASAMKRSDPHHQHQRHRDGGEALVSPDGTVTEAPRTVKKIQFADQKQEFNKRPTKIGRRSLSRSISQSSTDSYSSAASYTDSSDDETSPRDKQQKNSKGSSDFCVKNIKQAEFGRREIEIAEQEMPALMAXRKRAQGEKPLAGAKIVGCTHITAQTAVLMETLGALGAQCRWA

SEQ ID NO: 1281 - protein, 250 aa, Glycine max
  unsure (1)..(250): unsure at all Xaa locations
MAAAEGLNREQYVYLAKLSEQAERYEEMVEFMQKVVVGSTPASELTVEERNLLSVAYKNVIGSLRAAWRIVSSIEQKEEGRKNDDHVSLVKHYRSKVENELTQVCASILSLLDSNLVPSASASESKVFYLKMKGDYHRYLAEFKVGDERKTATEDTMLSYKAAQDIASAXLPPTHPIRLGLALNFSVFYYEILNQSDKACAMAKQAFEEAIAELDTLGEESYKDSTLIMQLLRDNLTLWTSDVQVNVTME

SEQ ID NO: 1282 - protein, 195 aa, Glycine max
MARPQQRYRGVRQRHWGSWVSEICHPLLKTRIWLGTFETAEDAARAYDEAARLMCGSKARTNFPYNPNEPHSSSSKLLSATLTAKLHKCHMASLSLQMAKQKPPQSKEPQPSHGSSNPFAFANVIAGSSADTGFRWPDNRHEEFRWLEGNWVGVEGQVEVSHQQFQPVLEDDHIEQMIQELLDYGSIELCSVGLT

SEQ ID NO: 1283 - protein, 500 aa, Glycine max
MGRFTFDAVVSLFVTVHPHETSTLLHSFFCFFFILSAYFVVLPLRDEGAISLGLSNLPGLFVGSLVLTLIAAPFSSLIFSLPNLSKGKALFLIHRFFSVSLILFFILWHSSSAGYSKSNITGSTPLTFPSKEEGKIGAHGSLTSSFGWDNHGWFYISVRIGLFLWVALLNLITISSTWARVTDVMDSESGSRLFGFIGAGATLGQLFGSLFAIGMAFVGPFLLLFAALLMELAAQTSRGINHVTSHVEEQLSPIRKSDSKNENKTDEIQKTEHTPRGFPKSSTLVKLPFWPILEGLWLILSSTYLLHVSLFIWLSAVVSSFFYFQKVSVIATTVTSSLGRRKLFAQINSFIAVFILVGQLSLTGRILTVAGVTTAICSAPFVGLLNLVALAVWPKWVVVAICETLRKVVTYVVTRPGRELLFTVVSEDHKYKAKVCIDVLVQRLGYAAAAGMYKMLFGTLNGNPSTVPLYGLPVCLFWIVTAFSLGRRQVQLSKHQISST

SEQ ID NO: 1284 - protein, 309 aa, Glycine max
MENQQEMMKVEKVCEIYEKISKLEDLNPSNHVNNLFTQLVTICTTPCQIDVTKLSQQVRETIAKLIRLCGKAEGLLENHYSTLIGSYENPLSHMKLFPYYSNYFKLSHLEFTMLTTHITQVPTQLAFVGSGPLPLTSIMLATHYLKHTCFHNYDMDPLANAKAHELVSSDTDLSKRMFFHTCDILNVSNGLKDYYVVFLAALVGMDHKEKGRVISHLAKFMAPGAILLLRSAHGARAFLYPVVDPSSDLKGFEVLSVFHPTDEVINSVIVARKGLYSSPVLASKCSGVEGFNHFNHGNVIEELTVDDQA

SEQ ID NO: 1285 - protein, 164 aa, Glycine max
  unsure (1)..(164): unsure at all Xaa locations
MASADVEYRCFVGGLAWATDDHALEXRAFSQYGEIVETKIINDRETGRSRGFGFVTFXASEQSMKDAIGAMNGQNLXGRNITVNEAQSRGGGGGGGGGGGGYNRGGGGRXYGGRSGGGGGGGGYRSRDGGYGGGYGGGGGGGYGGGRDRGYSRGGDGGDGGWRN

SEQ ID NO: 1286 - protein, 281 aa, Glycine max
  unsure (1)..(281): unsure at all Xaa locations
MVKSTYEKFSKDFVMGGVAAIISKSAAAPIERVKLLLQNQGEMIKRGQLKKPYLGVSDGFKRVFMEEGLIAFWRGHQANIIRYFPTQAXAAGATTSLLLYHLDYARTRLGTDAIECRVTSQRQFKGLIDVYRKTLSSDGIAGLYRGFGISIWGITLYRGMYFGIYDTMKPIVLVGPFEGKFLASFLLGWSITTFSGVCAYPFDTLRRRMMLTSGHPNKYCTAIHAFQEIVRQEGFRALFRGVTANMLLGMAGAGVLAGYDQLNRISSRHSHYNETNQRVLK

SEQ ID NO: 1287 - protein, 379 aa, Glycine max
MSTAGQVIKCRAAVAWEAGKPLSIETIEVAPPQKGEVRLKILFNSLCRTDVYWWDAKGQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPAAPLDKVAVVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 1288 - protein, 253 aa, Glycine max
MEVGLKKENMGFEETELRLGLPGNGGTEEVLIRKRGFSETETGHEDESATTVDLMLNLSSKEAATTAAAAADPTDKHKTLPKEKTLLPADPAKPPAKTQVVGWPPVRSFRKNMLAVQKSVGEENEKNSSSPNASFVKVSMDGAPYLRKVDLKMYKSYRELSDSLGKMFSSFTIGNCESQGMKDFMNESKLNDLLNSSDYVPTYEDKDGDWMLVGDVPWEMFVESCKRLRIMKGKEAIGLGLAPRAMAKSKNRS

SEQ ID NO: 1289 - protein, 254 aa, Glycine max
MEVGLNKKENMGFEETELRLGLPGNVGGTGTEEVLIRKRGFSETETETEEDESATTVDLMLNLSSKEAAAAADPTDKHKTLPKEKTLLPADPAKPPAKAQVVGWPPVRSFRKNMLAVQKSVGEENEKNSSSPNASFVKVSMDGAPYLRKVDLKMYKSYRELSDSLGKMFSSFTIGNCESQGMKDFMNESKLNDLLNSSDYVPTYEDKDGDWMLVGDVPWEMFVESCKRLRIMKGKEAIGLGLAPRAMAKSKNRS

SEQ ID NO: 1290 - protein, 252 aa, Glycine max
MEVGLKKENMGFEETELRLGLPGNGGTEEVLIRKRGFSETETGHEDESATTVDLMLNLSSKEAATTAAAAADPTDKHKTLPKEKTLLPADPAKPPAKTQVVGWPPVRSFRKNMLAVQKSVGEESEKNSSPNASFVKVSMDGAPYLRKVDLKMYKSYRELSDSLGKMFSSFTFGNCESQGMKDFMNESKLNDLLNSSDYVPTYEDKDGDWMLVGDVPWEMFVESCKRLRIMKGKEAIGLGLAPRAMAKCKNRS

SEQ ID NO: 1291 - protein, 322 aa, Glycine max
MKRLSSSDSSSALMTICPSTEEHSPRNSQHMYGREFQSMLDGLDEEGCVEEPGYQSEKKRRLSVDQVKALEKNFEVENKLEPERKVKLAQELGLQPRQVAVWFQNRRARWKTKQLERDYGVLKANYDALKLNFDTLDQDNEALRKQVKELKSRLLQEENTGGSGVSVKEEIITRPADSEDKTMEQSKSDPSSETSNINPSSESEEDHLNYECFNNNDDCVGGTAASLLQVDFKDGSSDSDGSSAILNEDNMYSPLKFNNCSISTSPSSSSMMNCFQFQKPYHHHAQYVKMEEHNFLSADEACNFFSDEQAPTLQWYCPEQWS

SEQ ID NO: 1292 - protein, 600 aa, Glycine max
NYIYNFSFVTNENESYFTYSMYNSSIISRFVMDVSGQVKQFTWLENAQQWNLFWSQPRQQCEVYAFCGAFGSCTENSMPYCNCLPGFEPKSPSDWNLVDYSGGCERKTMLQCENLNPSNGDKDGFVAIPNIALPKHEQSVGSGNAGECESICLNNCSCKAYAFDSNGCSIWFDNLLNLQQLSQDDSSGQTLYVKLAASEFHDDKSKIGMIIGVVVGVVVGIGILLAILLFFVIRRRKRMVGARKPVEGSLVAFGYRDLQNATKNFSEKLGGGGFGSVFKGTLGDSSGVAVKKLESISQGEKQFRTEVSTIGTVQHVNLVRLRGFCSEGAKRLLVYDYMPNGSLDFHLFHNKNSKVLDWKMRYQIALGTARGLTYLHEKCRDCIIHCDVKPENILLDAEFCPKVADFGLAKLVGRDFSRVLTTMRGTRGYLAPEWISGVAITAKADVYSYGMMLFEFVSGRRNSEPSEDGKVTFFPSFAANVVVQGDSVAGLLDPSLEGNAEIEEVTRIIKVASWCIQDNEAQRPSMGQVVQILEGILEVNLPPIPRSLQVFVDNQESLVFYTESDSTQSSQVKSNVSKTSSSHAISNISSASSKSLGGEN

SEQ ID NO: 1293 - protein, 152 aa, Glycine max
  unsure (1)..(152): unsure at all Xaa locations
MTHALPRGGGIRLEFGFLLYPFSNFIHPDAFAEKLLSILGPMFXGPLDIMRXWCFCLFYAMAASRGSEVISALFWAVANHITTMEKAERSHPLVGLAANVTLMFSGRTXDIFCNLRQTSCSGVHGWAISLKAMTNIPAGMGLAVRFLPWWGN

SEQ ID NO: 1294 - protein, 319 aa, Glycine max
MMEHNIIVNNNVIAPFVIKTYNMVNDPTTDKLITWGPANNSFIVLDPLDFSHSLLPTFFKHNNFSSFVRQLNTYGFRKVDPDRWEFANEWFLRGQKHLLRNIVRKKHGGAGRTNSNSHYSHPLKLEELDDEAMVMEIARLKEEQKALEEELHEMNKRLETTEKRPQQMMAFLCKVVEDPQVLSRILREREKKHLGEKKRRLIPPPTTTAATSSSSSSGIKTEFEEDEGNYNIKSSSPETGLEIDNNSNNICSPPPLGCWGEQGCYGYNCASVPAPLTVVAPAFPTMGGGYLRRGGFWGEMAAEGNAVPPYPFSLLEGGF

SEQ ID NO: 1295 - protein, 129 aa, Glycine max
NISCVGIIVYRGLYFGLYDSLKPVLLTGNLANNFHASFLLGWSITIGAGLASYPLDTIRRRMMMTSEEAVKYKSSYHCFQEIIAKEGYKSLFKGAGANVLRAIAEAGVLAGYDQLQMMVFGKTYGSGGG

SEQ ID NO: 1296 - protein, 80 aa, Glycine max
  unsure (1)..(80): unsure at all Xaa locations
SLAAGSNISLIAYQIRGFRPEGGRLKNDSLTDELRXALGEVDHKPXIIPGALGFIAAARHPEATTVVTRIVGCAGLKSTV

SEQ ID NO: 1297 - protein, 114 aa, Glycine max
  unsure (1)..(114): unsure at all Xaa locations
SLAAGSNITRFADQIRTFKPEADGLINDSLIEELREALADADHKPXIIPGALGGTEAARYPDATTVVTGIVGCAXLKPTVAAIVAGKDIALANKETMVAGATFVLPLAHKHNIK

SEQ ID NO: 1298 - protein, 185 aa, Glycine max
  unsure (1)..(185): unsure at all Xaa locations
TRQIASPVEVDSGYGEPIEMLSCPSDGSDCGGAYIIRLPCGPRDRYIPKESLWPHLPEFVDGALGHIVNMARVLGEQVNSGKPTWPYVIHGHYADAGEVAAHLSGALNVPMVLTGHSLGRNKFEQLLKQGRLSREAINATYKIMRRIEAXELGVDAAEMVVTSTRXEIEEQWXLYDGFDLKVERK

SEQ ID NO: 1299 - protein, 491 aa, Glycine max
ARARLYYGDGNVEAMFATLDPLHDMLERGPETLREIAFQQSFGRDLQDARESCRRFQQYGELNDLNQAWDLYYQIFKRIARILPSFSILELQQVSPKLLAARDLELAVPGTYHSGKPIIRISKFAESLDVLTSKQRPRKLKVAGSDGKDHAFLLKGHEDLRQDERVMQLFGLVNTLLSKDPETFKRHLMTIPYPIIPLAPNSGLLGWVDNTDTLHVLVKNYRDSRKILLNIEHRIMLQMAPDYDHMMLIQKMEVFEYALDNTTGQDLYRVLWLKSRNSEAWLDRRTQYTRTLAVMSMVGHILGLGDRHPSNLLLERISGSVVHVDFGDCFEVAMVRDKYPERVPFRLTRMLIQAMEVSGIEGTFRITCENSMRVLRDHKESIMAVLEAFVHDPLINWRLINTGRRGGAGANERGTSKRVGVDESNPLDDETNEALNQRALQVVDRVQQKLTGRDFKPTQVLDVSEQVQKLILQSTSVENLCQTFIGWCAFW

SEQ ID NO: 1300 - protein, 143 aa, Glycine max
FGATDFVNPTKLGNQSVQEKLIEMTDGGCDYTFDCTGNVNVMRAALEACHKGWGESIIIGVAAAGQEIATRPFQLVTGRVWKGCAFGGVKGRTQLPGLVADYMNGDLKVDEFITHRQPLAKINQAFSDMKAGDCIRCVVDMRQ

SEQ ID NO: 1301 - protein, 277 aa, Glycine max
  unsure (1)..(277): unsure at all Xaa locations
QRKGEMIKRGQLKKPYLGVSDGFKRVFMEEGXLGLWRGHQANLIRYFPTQGFPLXYQGYFKSIFGYSKERDGYIKWFAGNVASGSAAGATTSLLLYHLDYARTRLGTDAIECRVTGQRQFKGLIDVSRKTLSSDGIAGLYRGFGISIWGITLYRGMYFGIYDTMKPIVLVGPFEGKFLASFFLGWSITTFSAVCAYPFDTLRRRMMLTSGHPNKYCTAIHAFQEIVRQEGFRALFRGVTANMLLGMAGAGXLAGYDQLNRISSRHSHYNETNQRVLK

SEQ ID NO: 1302 - protein, 231 aa, Glycine max
MINFEETELRLGLPGGSASDHNESTTVKGSGGKRGFSETASVDLKLNLSSSDDSASDSPSSASTEKTTTAAPPPPSRANDPAKPPAKAQVVGWPPVRSFRKNIVQRNKNEEEAAFVKVSMDGAPYLRKVDIKLYKSYQELSDALAKMFSSFTIEKCGSQGMKDFMNETKLIDLLNGSDYVPTYQDKDGDWMLVGDVPWEMFVESCQRLRIMKGSEAIGLAPRAVEKCKNRS

SEQ ID NO: 1303 - protein, 231 aa, Glycine max; identical to SEQ ID NO: 1302

SEQ ID NO: 1304 - protein, 230 aa, Glycine max
  unsure (1)..(230): unsure at all Xaa locations
MINFEETELRLGLPGQRLSTQGKCXAKRGFSETASVDLKLNLSSCINDSASDSPSSMSTEKPKENKTTTAEPPPANDPAKPPAKAQVVGWPPVRSFRKNIVQRNSNEEEAEKSTKNAFVKVSMDGAPYLRKVDIKLYKSYQELSDALGXKMFSSFTIEKCGSQGMKDFMNETNGSDYVPTYEDKDGDWMLVGDVPWEMFVESCKRLRIMKGLRGQSGLAPRAVEKCKNRS

SEQ ID NO: 1305 - protein, 431 aa, Glycine max; identical to SEQ ID NO: 660

SEQ ID NO: 1306 - protein, 164 aa, Glycine max
MSAPSGNPSEVKNASNVVVPAKTAPVAVVQKDSTIVGFLKDFVIGGASGAVAKTITAPIERVKIIIQTQDANPRIISGEVPRYTGIVNCFSRVRSEQGFGAFWRGNMTNVIRYFPTQAFNFAFKDSIKKMFPKYSPKTEFGKFFLVQLASGGLAGAGSLCIVYP

SEQ ID NO: 1307 - protein, 135 aa, Glycine max
  unsure (1)..(135): unsure at all Xaa locations
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNXHQHXLPKKAGSSKASHADDDDN

SEQ ID NO: 1308 - protein, 257 aa, Glycine max
MSDSSREENVYMAKLADEAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDIAGDEIKETSKQQPGE

SEQ ID NO: 1309 - protein, 98 aa, Glycine max
  unsure (1)..(98): unsure at all Xaa locations
MAGAWVFKNGVVRLAENPAGEAVDGSRGGRRKVLVHTASNEGITSYAELEPKLNLLGXERYYDYPVLVQFSQRSTVHLIFLPKNFNKLMPMRMYDIGA

SEQ ID NO: 1310 - protein, 238 aa, Glycine max
MKIQCDVCEKAPATVICCADEAALCAKCDVEVHAANKLASKHQRLLLQCLSNKLPRCDICQDKPAFIFCVEDRALFCKDCDEPIHLASSLSANHQRFLATGIRVALGSNCTKGHEKGNMEPSNPNAQEVPVKTPSQQVPSFTSSWAVDDLLELTDFESPDKKQSLEFGELEWLADAGLFSEQFPHEALVAAEVPQLPVPHTSSVASHKAPKSLVSYKKPRIEVLDEDDDEHCTVPDLG

SEQ ID NO: 1311 - protein, 110 aa, Glycine max
MAAAKLQALWNHPAGPKTIHFWAPTFKWGISIANIADFSKPPEKLSYPQQIAVTATGIIWSRYSTVITPKNWNLFSVNIAMAGTGLYQLSRKLRHDYSSEAEAEVAVTKE

SEQ ID NO: 1312 - protein, 286 aa, Glycine max
MSQQQRSMPAPFLTKSYLLVDDPATDDVVSWSEGGNTFVVWKHADFANDLLPKYFKHNNFSSFVRQLNTYGFRKTVPDKWEFANEYFKRGQKDLLAEIKRRKTVSSVSGKSGSGGNISASHSGGDDMGSTSTGSMEAATATVTTTQCADLSGENEKLKKDNEKLSDELARTKKHCDDLVAFLRDSLNVGPDVIDCIIRQGTCGSSNDDAVRFDATENLNNHNHDDDENAVGECEPEQPKGDNGESLKLFGVWLKGQNGKENSIGSCRKRGRQDPIAATAKELKTLV

SEQ ID NO: 1313 - protein, 176 aa, Glycine max
MSRVYVGNLDPRVSERDLEDEFRIYGVLRSVWVARRPPGYAFIEFDDRRDALDAIQALDGKNGWRVELSHNSKGGGRGGRGRGGEDTKCYECGEPGHFARECRLRIGSRGLGSGRRRSPSPYRRRRSPSYGYDRRSYSPRGRRSPRRRSISPPWGRNYSRSPPYRPRRDSPYANAD

SEQ ID NO: 1314 - protein, 380 aa, Glycine max
MSSTAGQVIKCKAAVSWEAGKPLVIEEVEVAPPQAGEVRLKILYTSLCHTDVYFWEAKGQTPLFPRIFGHEAGGIVESVGEGVTHLKPGDHALPVFTGECGDCPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 1315 - protein, 130 aa, Glycine max
  unsure (1)..(130): unsure at all Xaa locations
YGCEKTTEGDVRIAQQHADTFAAALACEGLKSFCAMYSSFMQRAYDQLVHDVDLQNLPVRFALYRAXLAGAHGPTHXAVQFDVTFMACLRNMVXMAPSDESXLFHLDATGLAIDDRPSWFLYRSGNGFRC

SEQ ID NO: 1316 - protein, 235 aa, Glycine max
  unsure (1)..(235): unsure at all Xaa locations
ITLLQGKMEEVELPFPKVDIIISEWMGYFLLYESMLDTVLYARDRYLAPGGLIFPDKATIFLAGIEDGEYKEEKIGFWDNVWGFDYTPLKKTAMTEPLVDTVDMKAVVTDPSAVFNIDLYTVKAEDLAFKVPFSLNVRRSDFIHAIIAWFDIEFSACHKPIRFSTGPHTKYTHWKQTVFYIDDVLTVQAGEKIVGTLSNKPNEKNKRDLDIEITYKLETXDMHRQSEGIGSYKMC

SEQ ID NO: 1317 - protein, 364 aa, Glycine max
WRSDPATAYNLQSIRPAFSAIRHFSSAAKEITVRDALNSALDEEMSADPKVFLMGEEVGEYQGAYKISKGLLDKYGPERVLDTPITEAGFAGIGVGAAYYGLRPVVEFMTFNFSMQAIDHIINSAAKSNYMSAGQISVPIVFRGPNGAAAGVGAQHSQCYASLYGSCPGLKVLSPYSSEDARGLLKAAIRDPDPVVFLENELLYGESFPVSAEVLDSSFCLPIGKAKIEREGKDVTITAYSKMVGYALKAAETLAKEGISAEVINLRSIRPLDRSTINASVRKTNRLVTVEEGFPQHGVGAEICTSVIEESFGYLDAPVERIAGADVPMPYAANLERMAVPQVEDIVRAAKRACYRSVPLAASA

SEQ ID NO: 1318 - protein, 109 aa, Glycine max
  unsure (1)..(109): unsure at all Xaa locations
LELRCSIHLRWFCRTTRKGYLHYRAVTPREEIMYMAKLVVPAQRYEEMVGYKEIGLRLKXSEELTVEERNLLFVXLRNVIWARRAFWRIITSTVQKGESRGDEEPLLQL

SEQ ID NO: 1319 - protein, 314 aa, Glycine max
  unsure (1)..(314): unsure at all Xaa locations
MAHAPAEKGVSGFLLDFMMGGVSAAVSKTAAAPIERVKLLIQNQDEMIKSGRLSEPYKGIGDCFSRTMKDEGVIALWRGNTANVIRYFPTQALNFAFKDYFKRLFNFKKDKDGYXKWFAGNLASGGAAGAXSLLFVYSLDYARTRLANDAKAAKKGGERQFNGLVDVYRKTIKSDGIAGLYRGFNISCVGIIVYRGLYFGMYDSLKPVVLVGGLQDSFFASFLLGWGITIGAGLASYPIDTVRRRMMMTSGEAVKYKSSLEAFKIIVAKEGTKSLFKGAGANILRAVAGAGVLAGYDKLQLILFGKKYGSGGGG

SEQ ID NO: 1320 - protein, 369 aa, Glycine max
  unsure (1)..(369): unsure at all Xaa locations
MGRWIGIRSMPSVVQKLSGQSYLVSRLAPNHSRNCSTTGSYFNGGLQSSGXGSSHGHTRPAEKGVSGFLLDFLMGGVSAAVSKTAAAPIERVKLLIQNQDEMIKSGRLSEPYKGIGDCFTRTMKDEGVIALWRGNTANVIRYFPTQALNFAFKDYFKRLFNFKKDKDGYWKWFAGNLASGGAAGASSLLFVYSLDYARTRLANDAKAAKKGGERQFNGLIDVYRKTIKSDGIAGLYRGFNISCVGIIVYRGLYFGMYDSLKPVVLVGGLQDSFFASFLLGWGITIGAGLASYPIDTVRRRMMMTSGEAVKYKSSLEAFKIIVAKEGTKSLFKGAGANILRAVAGAGVLAGYDKLQLVLFGKKYGSGGGG

SEQ ID NO: 1321 - protein, 82 aa, Glycine max
ARVTVVINLVIWDKHSTWVGTVGLLICMLGGIMYQQSTSKPKAAKQVSAQENEEEEQKLLEMQVNSETNINNNEVNKPREES

SEQ ID NO: 1322 - protein, 157 aa, Glycine max
  unsure (1)..(157): unsure at all Xaa locations
MSSAKKITLKSSDGEAFEVEEAVAXLESQTIKHMIEDDCADSGIPLPNVTSKILAKVIEYCKKHVEAANPEDKPSEDDLKAWDAEFVKVDQATLFDLILAANYLNIKSLLDLTCQTVADMIKGKTPEEIRKTFNIKNDFTPEEXEEEVRRENQWAFE

SEQ ID NO: 1323 - protein, 196 aa, Glycine max
  unsure (1)..(196): unsure at all Xaa locations
MDIELPAATANESQQQKFALPVDSENKATVFRLFSLANPHMRAFHLSWVSFFACFVSSFAAPPLLPIIRDNLNLTATDIGNAGVASVSGAVLARIAMGTACDLVGPRLASASLILLTAPFVYFTSIINSSTSYLLVRFFTGFSLATFVSTQFWMSSMFSAPVVGSANGFSGGMGNLXGXATQLIMPLVFSLIRDIG

SEQ ID NO: 1324 - protein, 161 aa, Glycine max
  unsure (1)..(161): unsure at all Xaa locations
AGQILAEDFTGSAILKNVGIHGHHTNVKVMCADVTCPNLHISEGSADLILSKWILMYLSDIEDDTLSAMLIXRPKVGGYVLFRLSCVHQSGHSKRNFHPTDYREPIFHTEVFKECRMSDDTMNSLVLWLAGXQCIGAYVRHEKSHTQICWVWTNLRSQADR

SEQ ID NO: 1325 - protein, 458 aa, Glycine max
MVRENAVMGGASEERGVRVTRAMARAVLGGVSASSRPSFKKQHKNNKGFGRVALADVTNISKKGCATSKSQARGGYKKTNTKGASNVSIQVLSTQEDVRAKLAKDLPSISMVQSHDANVAERQEGTEVVQPSMSVMAGPLLSMQDSMKSDEILRSPNKDVDMMITEKLKLSDGLDIVDIDSVELKDPQVWSSYAPDIYNSIFVREFERRPSSDYMDMLQQDITPSMRGILIDWLVEVSEEYKLLPDTLYLTVNLIDRSLSQSLVQKQRLQLLGVTCMLIASKYEEICAPRVEEFCFITDNTYTKAEVLKMESEVLNLLHFQLSVPTTKTFLRRFILASQSSYKVSYVELEFLANYLAELTLVEYSFLQFLPSLIAASAVLLARWTLNQSEHPWNSTMEHYTNYKVSELKTTVLALADLQHDMKGCSLNSIREKYKQQKFRSVANLSPKPVQSLFKAQV

SEQ ID NO: 1326 - protein, 140 aa, Glycine max; identical to SEQ ID NO: 1266

SEQ ID NO: 1327 - protein, 169 aa, Glycine max
  unsure (1)..(169): unsure at all Xaa locations
MGDQLNKKNDLTSFLIDFLMGGVSAAVSKTAAAPIERVKLLIQNQDEMLKTGRLAEPYKGIGDCFKRVIAEEGFGSLWRGNLANVLRYFPTQALNFAFKDQFKRMFGYNKDRDGYWKWFAGNLASGGAAGASSLLFVYSLDYARTRLANDNKSAKXGGERQFNGLLDVY

SEQ ID NO: 1328 - protein, 115 aa, Glycine max
IGLYNSLKPVLLTGSLTISFFASFLLGWGITIGAGLASYPLDTVRRRIMMTSGEAVKYRSSAHAFSEIVKKEGVKSLFKGAGANILRTVAGAGVLAGYDKLQVLVFGKTYGADGG

SEQ ID NO: 1329 - protein, 166 aa, Glycine max
MALALGNAIPLSNLKPCPKLSCCCMKKLFFTHSVPISRIPTTPKRTPTTVVRATSSFGSRLEDTIKKTVAENPVVLYSKTWCSYSSEVKILFKKLGVDPLVFELDEMGPQGPQLHKVLERITGQHTVPNVFIGGKHIGGCTDTLKLYRKGELEPLLSKANAKKTGS

SEQ ID NO: 1330 - protein, 122 aa, Glycine max
IYGSLLAVGELLRNTGEFMMSRYREVAEIVLRYLEHRDRLVRLSITSLLPRIAHFLRDRFVTNYLTICMDHILSVLKVPQDRDSGFIALGEMAGALDGELIHYLPTITTHLREAIAPRRIKP

SEQ ID NO: 1331 - protein, 259 aa, Glycine max
MASTKERENFVYTAKLAEQAERYEEMVEAMKNVAKLNVELTVEERNLLSVGYKNVVGARRASWRILSSIEQKEEAKGNDVSVKRIKEYRQKVESELSNICSDIMTVIDEHLIPSSSAGEPSVFFYKMKGDYYRYLAEFKSGDERKEAADHSMKAYQSASTTAEAELPPTHPIRLGLALNFSVFYYEILNSPERACHLAKQAFDEAISELDTLSEESYKDSTLIMQLLRDNLTLWTSDIPEEGAEEQKVDSARAAGGDNA

SEQ ID NO: 1332 - protein, 240 aa, Glycine max
  unsure (1)..(240): unsure at all Xaa locations
MLWLEMVEAMKNVAKLNVELTVEERNLLSVGYKNVVGARRASWRILSSIEQKEEAKGNDVSVKRIKEYRQKVESELSNICSDIMTVIDEHLIPSSSAGEPSVFFYKMKGDYYRYLAEFKSGDERKEAADHSMKAYQSASTTAEAELPPTHPIRLGLALNFSVFYYEILNSPERACHLAKQAFDEAISELDTLSEESYKDXATLIMQLLRDNLTLWTSDIPEEGAEEQKVDSARAAGGDDA

SEQ ID NO: 1333 - protein, 101 aa, Glycine max
ASAPSPREENVCMAKLAVLGERYEEMEASMEKVYADVDNQERTAEEMNHLCVAYKNEIGARRASWRIISSIEQNEESRGIDDHMYVNRCYLFKIQSELSSI

SEQ ID NO: 1334 - protein, 194 aa, Glycine max
  unsure (1)..(194): unsure at all Xaa locations
EATSLAFVYSLDYARTRLTNDAKGAKNGGQKQXFNGLIDCYKKTLASDGIVGLYRGFVISCVGIIVYRGLYFGMYDSFKPLLPGTMRDSLAANFALGWAVTVVAGLASYPIDTIRRRMMMTSGQAVKYKSSIDAGQQILAKEGFRSFFKGAGANILRAVAGAGVLAGYDKLQLLVFGKKYGGGELFIKSDRMLI

SEQ ID NO: 1335 - protein, 203 aa, Glycine max
QNTANVIRYFPTQALNFAFKDYFKSLFGLKKNDGYWKWFAGNIASGGAAGATSLLFVYSLDYARTRVANDNKSASKGGSRQFNGLVDVYRKTLASDGIAGLYRGFVPSVVGIIVYRGLYFGLYDSIKPVVLVGPLEGNFLASFALGWGVTTGAGLASYPLDTIRRRMMMTSGGSGPHYKSMMDAGSQIVAQEGVKSLFKGAAP

SEQ ID NO: 1336 - protein, 288 aa, Glycine max
ATKLGVPPALDQSTPIASVTRENCIQGVKKHNKQRKKKITKKQIEGKANAGLVAKTKGVLSASHSSSEPEHPHCSNRGEEEHEVKNDCGPVPRDVANFDVGEEESVARDLANSDVSFKSVPVSQGATNSDSGCVEVDGHVYAQPTNEPIWRGSMYFCNGTIRTVSGLLAHISNLACSQVAEETGHFPEVLHAEFLPRDKVWAESFKRGDPTDQDIALFFFPDSEGSEKDFDVLVEDIMICKHVIRFVGKNAELLIFPSTELPVQNWRYEAKYYLWGVFRKKANLRRDK

SEQ ID NO: 1337 - protein, 309 aa, Glycine max
TSCHAYQTCVVHAGLTMEPSLELFQEKFPDRFFDVGMAEQHAVTFASGLACGGLKPFCVIPSSFLQRAYDQVVHDVDQQRIPVRFVITSAGLVGSDGPLRCGAFDINFMSCLPNMIVMAPSDELELMHMVATATRINNQPICFRYPRGALVGEGYTIGDGIPIKIGRGRVLVEGKDVAFLGYGSMVQNCLKAHSLLAKLGIEVTVADARFCKPLDIMLLRQLCKHHSFLVTVEEGSIGGFGSHVAQFIAVNGLLDGRIKWRPIVLPDRYIEHASPNEQLDQAGLSGHHIAATALSLLGRTREALLFMCS

SEQ ID NO: 1338 - protein, 132 aa, Glycine max
  unsure (1)..(132): unsure at all Xaa locations
YQCFNISCVEIIVYRGLXFGMYDSLNLVVLVGGLSHSLSASFFCGWAITIGXGLAFYPLDTVRRRMMMIFGEAVKYKSSLYVFXIIVVNEGAKLLFKGAGANILRAVVGAGVFXGYDKLXLILFGKKYGFGG

SEQ ID NO: 1339 - protein, 147 aa, Glycine max
MAEESQGIKLFGAMITLNRGEVNKGEKGSEYERVEKRAEKIIPCPRCKSMETKFCYFNNYNVNQPRHFCKSCQRYWTAGGALRNVAVGAGRRKVKSPCHGAGVYESTSEDENKFEMGQGHVAMPNTGFRQIFQAKRQRITSAQHQGQ

SEQ ID NO: 1340 - protein, 170 aa, Glycine max
MGFPVGYPELLVPKMFLHALSLLAWLRSLVFALFRLLRISDLLDTDSAASDLPPPPPPREPTLSALLIREFLPVAAFRDLAAADGDPPPSGCAVCLSEFSSEEEIRCMANCKHIFHRWCVDRWVDHDQKTCPLCRTPFVPHHKLEEYNQRLWAASGVSQFYYQDDYTASL

SEQ ID NO: 1341 - protein, 354 aa, Glycine max
  unsure (1)..(354): unsure at all Xaa locations
MVSSLNSIKPLNMSSATKGDRKTALDVASWMFNIVTSVGIILVNKALMATYGFSFATTLTGLHFATTTLLTVFLKWLGYVQTSHLPLPDLIKFVLFANFSIVGMNVSLFLSLEXKLQIAKLSMIPVSCFLEVILDNVRYSRDTKLSISLVLLGVAVCTVTDVSVNAKGFIAAAVAVWSTSLQQYMIFYFYFAXYVHFLQRKYSLGSFNLLGHTAPVQAASLLLVGPFMDYWLTGKRVDAYGYGLTSXLFIILSCTIXVGXNLSQFICIGRFTAVTFQVLGHMKTILVLILGFIFFGKEGLNLHVVLGMIIAIAGMVWYGNASSKPGGKERRSFSLPKTQDYSSLPVSSEPDTKE

SEQ ID NO: 1342 - protein, 103 aa, Glycine max
  unsure (1)..(103): unsure at all Xaa locations
RHQTQAIDIFSLSCVLFFYITGRRHPFKEHIKRNINILKNQIDLFLLEFIPKAKDLIXYLLNPNPDLKPXTTKVLYHPFFXSSKIRLSFLHNTSNEIKLKNRE

SEQ ID NO: 1343 - protein, 311 aa, Glycine max
  unsure (1)..(311): unsure at all Xaa locations
GFLLLDHEFNLKGRWEKPGHSPSFGYDFWYQPQHKTMISSSWGAPAAFTKGFNLQHVSDGLYGRHLHVYSWPXGELRQTLDLGESGLLPLEVRFLHDPSKDTGFVGCALSSNMVRFFKTEDESWSHEVAISVKPLKVQNWILPEMPGLITDYLISLDDRFLYFVNGLXGDIXQYTIEXPKNPVRTGQVWVGGLXQKGSPIVAITEDGNTWHXDVPDILGNKLRAGPQMIQLSLDGKRLYVTNSLFSAWDKQFYPELVEKGSHMLQIDVDTENGGXKINPNFFVDFGAEPGGSCLAHEMRYPGGDCTSDIWI

SEQ ID NO: 1344 - protein, 266 aa, Glycine max
  unsure (1)..(266): unsure at all Xaa locations
MAAAPSPREENVYMAKLAEQAERYEEMVEFMEKVSAAADNEELTVEERNLLSVAYKNVIGARRASWRIISSIEQKEESRGNEDHVSVIRDYRSEIESELSNICDGILKLLDSRLIPSASSGDSKVFYLLMKGDYXHRYLAEFKTGAERKEAAESTLSAYKAAQAIANAELPPTHPIRLGLALNFSVFYYEILNSPDRACTLAKQAFDEAIAELDPLGEESSKDSTLIMQLLRDTLTLWTSDMQDDGADEIKEAAPKPDDXKYFTVN

SEQ ID NO: 1345 - protein, 243 aa, Glycine max
MKTFLLSGKLCCSWFLLGLLALIGSLASATEIHFHEFVIQARPVRRLCKTQNIITVNGQFPGPTVEARNGDFIVIKVVNAAQYNISIHWHGLRMLRNPWADGPSYVTQCPIQPGGSYTYRFRIIDHEGTLWRHAHTGFLRATVYGAFIIYPRLGSPYPFSMPKQEVPLLLGEWFDTDLVLLQRQADFAGLPPNTSVAYTINGQPGDLYRCSSQETVRVPVNAGETIMLSIISRALDHKLCFSL

SEQ ID NO: 1346 - protein, 185 aa, Glycine max
MLQRRLLETELSMPPSYGGSGGNNTRDTFISDANFDTNMVIILAALLCALICALGLNSIARCALRCGRRFGDETAEQAAARLAGTGLKRRELSRIPVAVYGAAGGENTIPATECPICLGEFEKGDKVRMLPKCNHGFHVRCIDTWLLSHSSCPNCRHSLLEKTSAAPESGSGRRSEVVVVVEQAS

SEQ ID NO: 1347 - protein, 92 aa, Glycine max
  unsure (1)..(92): unsure at all Xaa locations
SAPTTREDYEYMAKLADQSTRYEEMEEFMNKVYLSAXSYELTVEERNLLSVAYKNMIGARRASXRIISSIEQKEESRSNXDHCPVIHDYRSR

SEQ ID NO: 1348 - protein, 322 aa, Glycine max
  unsure (1)..(322): unsure at all Xaa locations
MAPKQTKAEKKIAYDAKLCDLMEEYGQILVVNSDNVGSNQLQNIRKGLRGDSVVLMGKNTMMKRSVRMHAEKTGNNAYLNLIPLLVGNVGLIFTTGXTLKEVSEEVAKYKVGAPARVGLVAPIDVVVPPGNTGXLDPSQTSFFQVLNIPTKINKGTVEIITPVELIRKGDKVGSSEAALLAKLGIRPFSYGLVVLSVYDNGSVFSPEVLDLTEDDLIGKFAAGVSMVTSLSLAISYPTLAAAPHMFVNAYKNVLAVAVETDYSFPEADKVKEYLKDPSKFAVAAVAAPAAASGAPAAAAKEEEKKEEPAEESDDDMGFSLFD

SEQ ID NO: 1349 - protein, 321 aa, Glycine max
  unsure (1)..(321): unsure at all Xaa locations
MAPKQTKAEKKIAYDGEXCADLTEEYGQILVVNSDNVGSNQLQNIRKGLRGDSVVLMGKNTMMKRSVRMHAEKTGNNAYLNLIPLLVGNVGLIFTKGDLKEVXEEVAKYKVGAPARVGLXVAPIDVVVPLGNTGLDPSQTSFFQVLNIPTKINKGTVEIITPVELIKKGDKVGSSEAALLAKLGIRPFSYGLVVLSVYDNGSVFSPEVLDLTEDDLIEKFAAGVSMVTSLSLAISYPTLAAAPHMFVNAYKNVLAVAVETDYSFPEADKVKEYLKDPSKFAVAAVAAPAAESGAPAAAKEEEKKEEPAEESDDDMGFSLFD

SEQ ID NO: 1350 - protein, 100 aa, Glycine max
  unsure (1)..(100): unsure at all Xaa locations
IFDEVLGLTETERGRAAGPGNESPFAHVCCDLRPAYASTMEAISAPTEALKSETCVYTGTGLXXPDSSSTADVDPNCPTDSHXMHRVSPPXLGDNLHHTC

SEQ ID NO: 1351 - protein, 241 aa, Glycine max
  unsure (1)..(241): unsure at all Xaa locations
MYGQSCYESDLALLDSIRRHLLGDSEEHRFGAPNVNSGSTPLYSRSSSFGRLYPCLSNDWGELPLMEDDSEDMLLYGVLRDAVNVGWVPSLDASSPESFSSAFMPPVTVKSETDLFPAPEPICNPPVVQGPAPAVVPAKGKHYRGVRQRPWGKFAAEIRDPAKNGARVWLGTFETAEDAALAYXDRAAYRMRGSRALLNFPLRINSGEPEPVRVTAKRASAEPCSSSESGSWVKKRKKVVG

SEQ ID NO: 1352 - protein, 117 aa, Glycine max
  unsure (1)..(117): unsure at all Xaa locations
PARKPRGDPRGTPAVYAHQKGERVKKKRRRGAPEATTKGSEARHXGETAKPKSAQGGGGAEKDKGSGTKGRPYTLQAVRQGQQESGATSPQAGQDQPRPREPTPEARRGATQAEGGD

SEQ ID NO: 1353 - protein, 237 aa, Glycine max
  unsure (1)..(237): unsure at all Xaa locations
SRSLSFTSRCPGLAGGGGGGDAASGGGVEAPRATGKRGFSETVDLKLNLHSKEDLNENLKNVSKEKTLLKDPAKPPAKAQVVGWPPVRSYRKNMMAXKRLSTEDVVREDNKLALLILGVILLKVSMDGAPYLRKVDLTMYKSYXELSDALAKMFSSFTMGNYGAQGMIDFMNESKLMDLLNSSEYVPSYEDKDGDWMLVGDVPWEMFVESCKRLRIMKGSEAIGLAPRAMEKCKSRS

SEQ ID NO: 1354 - protein, 73 aa, Glycine max
PTRPPTRPYGCEKTTEGGLGWERYYDGDPDLYQFHKHSSIDLISLPKDFSKFNSINMYDIVIKNPNVFHVRDK

SEQ ID NO: 1355 - protein, 415 aa, Glycine max
  unsure (1)..(415): unsure at all Xaa locations
MSLKSIVRELKEMRDGIGSMSRRGVESRRWNGRTKSHVAPDVTLTSLEPIQQGHWANLPPELLLDIIRRVEDSETTWPARAVVVYCGSVCKSWRAVTKEIVKTPEQCGRLTFPISLKQPGPRDSPIQCFIRRNRETSTYLLYIGLVPSENETDKLVLSAIKVIRSSVXTANYIWVPIISFHPSTLNQGKLRSNFLGTKFTIYDSQPPHEAAIQPNSQSSRRFHSKQVSPRVPACNYVVSTIAYELNVLRARGPRRMHCTMNSIPVSAVQAGGNAPTPTFPEIIDEPFSXPSPALKEKVPIRDXNNASLPELLPVQSQGSAEPLVFKNKAPRWHEQLQCWCLNFNGRVTVASVKNFQLVAAVDPSHNVSAAEQEKVILQFGKIGKDIFTMDYRYPLSAFQAFAICLSSFDTKPACE

SEQ ID NO: 1356 - protein, 401 aa, Glycine max
MEGAGMEENNIINDDDNNNKSEAHLTSAAAFVEGGIQDACDDACSICLEAFCDSDPSTVTSCKHEFHLQCILEWCQRSSQCPMCWQPISLKDPTSQELLEAVERERNFRFNPSRNATIFHHPTLGDFELQHLPVGASDADLEERIIQHLAAAAAMGRARHIARREGQRNRSSAQGRPHFLVFSTHPNSPPMAPASSSPSQRGDDEPIPTIAVANLSPTPATGEESSQPTLVSPIQAEQVSASGSGTTALATDHQGSSYNNRRSPNQSSPSSQDRAGPSELQSFSESLKSKLNAVSTRYKESISKSTRGWKERWFSRNNTMSDLGSEVRREVNAGIATVSRMMERLETSDNNRSNSNSAPSNIEDGSVQEYNGQTLTPGNEGDGLLRDNNTKASCAAGSSSN

SEQ ID NO: 1357 - protein, 75 aa, Glycine max
  unsure (1)..(75): unsure at all Xaa locations
MSDFSLKENDYRAKLXRSRAERYEEMVEFIEKVAKTVXGEELAVEERNIIYVAYKSLMDAMRALWGIIYYIKVIE

SEQ ID NO: 1358 - protein, 172 aa, Glycine max
MARENPLVIGGVIGDVLNPFTSSVSLTVSINNRAISNGLELRPSQVVNRPRVTVGGEDLRTFYTLVMVDADAPSPSNPVLREYLHWMVTDIPATTNASFGREVVFYESPNPSVGIHRIVFVLFQQLGRDTVITPEWRHNFNSRNFAEINNLAPVAAAYANCQRERGCGGRRY

SEQ ID NO: 1359 - protein, 411 aa, Glycine max
MKIEVLELLKNNYAARNIPKGVFLLPFTFLVVVILLLITNLNESYSYLYGSSVESTENFSCNIFSGNWVPHSKGPYYSNESCPFITYKQNCFMHGRPDREFLKWRWKPDECELPLFDAKQFLKLVRGKSMAFVGDSIGRNQMESLLCLLNSVARPEDITARYTSNDDKYFKWWYYADYKFTVTILWSPFLVKSSQTYLNDTSFSNAENLYVDEADKAWASHIENFDYVIFSGGQWFFRPLTFYENGHVVGCQKCHNLMEDPLNLYGYRHAFRTAFRTVINLKGFKGVVFMVTHSPNHFENGEWNKGGGCNRTLPVTREESAFLRPYGLDEFYQTQVEEFTAAEKEAREKGLRFGLMNITGVMLMRPDGHPHKYGHNLDRNVSVNDCVHWCMPGPVDTWNEFLLHMMKKERL

SEQ ID NO: 1360 - protein, 80 aa, Glycine max
GESPLVREVDQLKKKVDKVGKTQAPLFQKWAEGFKVFQKDKENFLKGLSKEEMELLDGLKMETGEVKKFFGGALPIRKIR

SEQ ID NO: 1361 - protein, 316 aa, Glycine max
  unsure (1)..(316): unsure at all Xaa locations
MGRTPCCDKKGLKKGPWTAEEDEILSSYIKKNGGHGSWRSLPRMAGLLRCGKSCRLRWTNYLRPDIKRGPFTLEEEKLVIQLHGILGNRWAAIASQLPGRTDNEIKNLWNTHLKKRLISMGLDPKTHEPLASSTYPFHKAPASVSTRHMAQXESARLEAEARLSNESSRFSPDTTYNSNSDDNKTTDSDYFLRIWNSEVGEAFRNVHHHKADDDNNNNIITTNTPTSSCHSPLSTGSSSNKCESIATNADLASNAPEIITPSSIVKQEFEWGTRGSDSSSSNDMEDSSDTALQLLLDFPINNDMSFLEGNSFVCPL

SEQ ID NO: 1362 - protein, 153 aa, Glycine max
MGEESQGIKLFGALITLKGGEVKKGEKGSEYERVEKRAEKIIPCPRCKSMETKFCYFNNYNVNQPRHFCKSCQRYWTAGGALRNVAVGAGRRKAKSPCHGAGDFMDGRAYETSEDENRFEMNQGHVAMPNTHFRQIFQAKRQRITSGAQHQGQ

SEQ ID NO: 1363 - protein, 120 aa, Glycine max
  unsure (1)..(120): unsure at all Xaa locations
RATHLIMPLEFSLIRDIGSTKLTAXKIXFGXXGKXXKEXXXXXXXEXXXXXRXXXEXXEXRXXXKGEREREXXXEQRSGGTNERGWILALTYGYCFGVELTIDNIIAEYFYDKFNLKLHT

SEQ ID NO: 1364 - protein, 126 aa, Glycine max
  unsure (1)..(126): unsure at all Xaa locations
SNNADFHIELSIIHAMAMTTDPKRCHNMKDRIVRVSKKTTTGVKRLYQMQANGSILLPAINVYDSVPKTKFDGWCGCRRSLPHGLMRATDVMIAGQVPAECGYXDIGMGXLSAMKQACARVIVTNI

SEQ ID NO: 1365 - protein, 248 aa, Glycine max
  unsure (1)..(248): unsure at all Xaa locations
DSHFQHVAPDSVPTVSSSAYSLLKLLRLSASAARLHSWRCSQLYASLSHDFSTWVSSGCAKPLLQTYXIQHAITAXILPLSALFLHQSSALSHYLXPLAHLLSQHITAQQLQQXLALQNLATYSHHHHFLPFNQXGELNSASYLQQQQLPFSQLPAAYPQQFLPFNQLAALNSPAYLQQQQLLXPFSQLAGVSPATFLIQPQLLPFYQHAAPNAGTLLQLQQLLPFNQLALXNPAAFYQQPIIGGALF

SEQ ID NO: 1366 - protein, 326 aa, Glycine max
MVLLSKATTEQYSYIKNCMPTKFSSTIPIVDLSKPDAKTLIVKACEEFGFFKVINHGVSMEAISELEYEAFKFFSMSLNEKEKVGPPNPFGYGSKKIGHNGDVGWIEYLLLNTNQEHNFSVYGKNPEKFRCLLNSYMSSVRKMACEILELMAEGLKIQQKNVFSKLLMDKQSDSVFRVNHYPACPELVNGQNMIGFGEHTDPQIISLLRSNNTSGLQIFLRDGNWISVPPDHKSFFINVGDSLQVMTNGRFRSVKHRVLTNGFKSRLSMIYFGGPPLSEKIVPLSSLMKGKESLYKEFTWFEYKNLTYASRLADNRLGHFERIVAS

SEQ ID NO: 1367 - protein, 226 aa, Glycine max
MVRGKTQMKRIENATSRQVTFSKRRNGLLKKAFELSVLCDAEVALIIFSPRGKLYEFASSSMQESIERYRRHTKHVNPTTFRSVEQNMQHLKQEAENMMKKIDLLEAAKRKFLGEGLGACSIEELQRIEQQLERSLSNVRARKVQVFKEQIEQLKEKEKALLDENAKLTENARLSEKHDIHLQPATKNQNVNQPQCNAESSSSSDVETELFIGLPDTRARHISHHV

SEQ ID NO: 1368 - protein, 86 aa, Glycine max
  unsure (1)..(86): unsure at all Xaa locations
GKMENGLIENHGFQPQYGVSELSEKNFWRMFDAGLYEPFRGKYGAVGPFMSVYFKSKKGRKTXKEVQKAEQGPLETAYAKVVQPVD

SEQ ID NO: 1369 - protein, 185 aa, Glycine max
  unsure (1)..(185): unsure at all Xaa locations
NRWSFISXMTTAMVPFIGVVHNGTWFLKGLGSNRNVICESYSQETDTWTPVSNGMVNGWRNPSISLNGQLYALDCQDGCKLKVYDRASDSWKKFIDSKLHLGRSRALDAAALVPLNGKLCIIRNNMSISLVDVSSPNRRVESNPQLWENIAGKGHVRSLVRNLWSTIAGRGSLKSHIVHCQVLQA

SEQ ID NO: 1370 - protein, 264 aa, Glycine max
LEPDFWYQPRHNTMISTSWGAPSAFTKGFNLQHLSDGLYGRHLHVYSWPGGELRQTMDLGDSGLIPLEIRFLHDPAKDTGFVGSALTSNMIRFFKTQDESWSHEVAISVKPLKVQNWILPENETTEVIKTQETTPEPVPATEAPATEQAAAEVPAQEEQQATEVPAPESTTEAPKEETTRSANNRNSRNNNYRRSQAQRSLKKLQLRPRRVVTKETEEEKPAAEEKSEEKTEEVKEEAEEPKETTETETESAPAATTEEENKPA

SEQ ID NO: 1371 - protein, 270 aa, Glycine max
  unsure (1)..(270): unsure at all Xaa locations
FRKDRRWPASKDREXFVYIAKLAEQAERYEEMVESMKNXVANLDVELTVEERNLLXLLGTKNVXIGARRASWRILSSIEQKEETKGNELNAKRIKEYRQKVELELSNICNDVMTVIDEHLIPSAAAGESTVFYYKMKGDYYRYLAEFKAGNEKKEAADQSMKAYESATTAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEEAE

SEQ ID NO: 1372 - protein, 269 aa, Glycine max
  unsure (1)..(269): unsure at all Xaa locations
MTASKDRENFVYIAKLAEQAERYEEMVESMKNVANLDVELTVEERNLLSVGYKNVIXGASQSRPWRILSXIEQKEETKGNRVECEAALKEYRQKVELELSNICNDVMXRVIDEHLIPSAAAGESTVFYYKMKGDYYRYLAEFKSGNEKKEAADQSMKAYESATAAAEXADLPPTHPXIRLGLALNFSVFYYEILNSPERACHLAKQAFDEAISELDTLNEESYKDSTLXIMQLLXRDNLTLWTSDIPEDGEDAQKVNGTAKLGGGEDAE

SEQ ID NO: 1373 - protein, 182 aa, Glycine max
MAAFGIQIMLLLAAFLLPLSVEAMVRHYKFNVVQKNTTRLGSTKPIVTINGKFPGPTIYAREDDTVLVKVVNQVKYNVSIHWHGVRQLRTGWADGPAYITQCPILPSQAYVYNFTLTGQRGTLWWHAHILWLRATVHGALVILPKLGVPYPFPKPNMEQVIILSEWWKSDTEAVINEALKSG

SEQ ID NO: 1374 - protein, 115 aa, Glycine max
  unsure (1)..(115): unsure at all Xaa locations
GSRSFVKDAAVYIAVRFLIGLAMATFVSCQYWMSTMFNSLIIGLANGTAAEXGNMGGGATHLIMSLVFELLQGAGAPPFTDGKIAXFVPGLLRPMTRMLVLTFGQNFSKRKQGVS

SEQ ID NO: 1375 - protein, 113 aa, Glycine max
  unsure (1)..(113): unsure at all Xaa locations
MAMMWIRIILLVAVCMLSLSVEAMVRHYKFNVVVKNVTRLCSTKPIVTVNGKFPGPTIYAREDDTVLVKVVNHVXYNVSIHWHGARQLHTVCADWAAYITQWPIQPGQAFVDN

SEQ ID NO: 1376 - protein, 294 aa, Glycine max
MEQYEKVEKIGEGTYGVVYKGRDRSTNETIALKKIRLEQEDEGVPSTAIREISLLKEMQHRNIVRLQDVVHDEKSLYLVFEYLDLDLKKHMDSSPEFAKDPRQLKMFLYQILCGIAYCHSRRVLHRDLKPQNLLIDRSNNALKLADFGLARAFGIPVRTFTHEVVTLWYRAPEILLGSHHYSTPVDIWSVGCIFAEMVNQRPLFPGDSEIDELFKIFRIMGTPNEDTWPGVTSLPDFKSAFPKWQPKDLKIVVPNLKPAGLDLLSSMLYLDPSKRITARSALEHEYFKDIKFVP

SEQ ID NO: 1377 - protein, 294 aa, Glycine max
MEQYEKVEKIGEGTYGVVYKGRDRVTNETIALKKIRLEQEDEGVPSTAIREISLLKEMQHRNIVRLQDVVHDEKSLYLVFEYLDLDLKKHMDSSPEFAKDPRQVKMFLYQILCGIAYCHSHRVLHRDLKPQNLLIDRSTNALKLADFGLARAFGIPVRTFTHEVVTLWYRAPEILLGSRQYSTPVDIWSVGCIFAEMVNQRPLFPGDSEIDELFKIFRIMGTPNEDTWPGVTSLPDFKSAFPKWQPKDLKNVVPNLEPAGLDLLSSMLYLDPSKRITARSALEHEYFKDIKFVP

SEQ ID NO: 1378 - protein, 434 aa, Glycine max
MPSLVAEAFEAKGAEPLSLKPIFSASGVKGKRVTALSAEANALTDFIQAIIADKPDIDSPFSVLDLGVVMGLMDKWACKLPTVQPFYAVKCNPNLSLIGALAALGSSFDCASKAEIESVLSLGVSPDRIIYANPCKSESHIRYAASVGVNVTTYDSLDEVEKIRNCHPTCELLLRIKPPQDSGARTSLGLKYGALPEEVHELLQAAHEAGLKVTGVSFHIGSGGADTRAYDGAISAAKNVFEMASGLGLPRMRVLDIGGGFTSGPPFEAAALKINAAIQASFGNEEGLVVIGEPGRYFAETAFTLATRVIGKRVRGDVREYWIDDGIYGTLNNIVFDYATVTCMPLACTSKPENPTCCRDLNLKTYPSTVFGPTCDSIDTVLRDYQLPELQVNDWLVFPNMGAYTTSSGTNFNGFSSSAKSIFLACSSPEHTMF

SEQ ID NO: 1379 - protein, 117 aa, Glycine max
  unsure (1)..(117): unsure at all Xaa locations
SQDDRGVQSVRRGGPQYHKDILLYERAGGKGLEHRRTRTTKEIXKKKGQKPGQKVLDEERGTGGGDMYMAENFEEEDVGIDRYINIISVAIERAIGLRCCAEFECADCTNRTRAVKT

SEQ ID NO: 1380 - protein, 130 aa, Glycine max
MTVSKDRENFVYMVKLVEQAVRLEEMEVSQKNVANLDVELTVEERNLLSDGYKNVIGARRACWRILPFIEQKEETKGNELNAKRIKEYRLNGELELSNICDDDMRVTDEHLIPSAAGGESTEDYYTMNGD

SEQ ID NO: 1381 - protein, 171 aa, Glycine max
MASSDVEYRCFVGGLAWATDDQALERAFSQYGEIVETKIINDRETGRSRGFGFVTFASEQSMKDAIEGMNGQNLDGRNITVNEAQSRGGGGGGGGGGGGYGGGRGGGYGGGGRGGGGGYNRSGGGGGYGGGGGYGGGGGGGYGGGRDRGYGGGGDRGYSRGGDGGDGGWRN

SEQ ID NO: 1382 - protein, 112 aa, Glycine max
  unsure (1)..(112): unsure at all Xaa locations
RCQQAPRYEKMVEALNNEAKLNVXLTVEERNLLSVGYKNLVGAPWASWRILSSIEQKEKSKGNEDSVNRIEGTYAERGITSKTNMCNACTTVMDEHLMAYSSSDEPTVDFYK

SEQ ID NO: 1383 - protein, 99 aa, Glycine max
FCWIKFTRKNMNHAGRGLVNDTYKMDLILVHPPHLIALACIYIASVLREKDTTAWVEELRVDMNVVKNISMEILDFYESNRMFTDERINAALQKLSLRP

SEQ ID NO: 1384 - protein, 180 aa, Glycine max
  unsure (1)..(180): unsure at all Xaa locations
VWGLGTVGLAVVMGAKKAGASKIVGIDLETAKFEKAKHFGATEFVNPKEVPAEQTLQASLMDKFDGGFDYTFECCGNVQTMRQALEAAHKGWGVSCVIGVAGAGEEIKTRPFQLVTGRTWKGSSFGGWKSRDQIPSLVKEHLDGKLDLDKFITHKFAFSDINXAFECMTKGESLRCVIEI

SEQ ID NO: 1385 - protein, 166 aa, Glycine max
FGSRSDFHFRFGSDKLRHHCRRQWRRSLRLRPRPLLPDQSLSSIPPNQRMTEDQSVVGRRRIYYDQNGGEALICSDSEEETMDDEEEKREFIESEDYILRMTVKEFGLTDIVLESLAQCFSRNISEIKAKYETLSIHDNAGGCSQAGDSEENSQSGNFFLGKGLEA

SEQ ID NO: 1386 - protein, 197 aa, Glycine max
VGYLLGLGDRHPSNLMLHRFSGKILHIDFGDCFEASMNREKFPEKAFVHDPLINWRLFNFNEVPQMSMLTSNHVPPVVNSEESAPNRELPHPQRGARERELLQAVNQLGDANEVLNERAVVVMARMSNKLTGRDFSTCSSVSNNSLQHAVDHSSLISGDTREVDHALSVKLQVQKLIIQASSHENLCQNYVGWCPFW

SEQ ID NO: 1387 - protein, 390 aa, Glycine max
  unsure (1)..(390): unsure at all Xaa locations
SFEWSTTLPLVLFTIFLGFFIFYHYLVVTNKDQNRELNSKSFPPKKKKARKSVKNNINIDNRQDKPMSSAEEDILAHKETNTDTYTQMQVDGRRIGKLFVSNKEIAKGSNGTIVFEGTYEGRVVAVKRLVKAHHDVAHKEIQNLIASDRHPNIVRXENPTICEDQYSNFFKNARIDTRNDMRYLWKANGFPSPLLLKLMRDVVSGLVHLHELXPTRPPTRPXNVLILKEKSLCAKLSDMGISKRLLEDMSSLGHTVTGCGSSGWQAPEQLVQGRQTRAVDLFSLGCILFFCMTGGRHPFGERLERDFNIVKNQKDLFLVEFIPEADDLISCLLNPNPDLRLTAIEVLHHPLFWSSEMRLSFLRDVSDRVELEDREIDSDLLKALESIAPL

SEQ ID NO: 1388 - protein, 89 aa, Glycine max
  unsure (1)..(89): unsure at all Xaa locations
MEDVKLHAIWMDPAGPKPTHCWGPTXKGGISIGHLADHSKRPEQLSYPSRIVGTATGTFWAMYRTVVTPKERDPMSGHIAIAGTGLHQL

SEQ ID NO: 1389 - protein, 503 aa, Glycine max
MAISIPSRQLFIDGEWKVPLLNNRFPIINPATEDIIGHIPAATKEDVDLAVDAAKRAFSHNKGKDWSSAPGSVRARYLRAIASKITEKKDELGKLEAIDCGKPLDEALADLDDVIGCFNYYAELAEGLDAKQNAPVSLPMETFKSYVLKEPIGVVALITPWNYPLLMATWKVAPALAAGCTAILKPSELASVTCLELAEICREVGLPPGVLNIVTGLGNEAGAPLSSHPDVDKISFTGSSATGSRIMTAAAQLTKPVSLELGGKSPIIVFEDVDLDKTAEWTIFGCFFTNGQICSATSRLIVHESIATEFVNRLVKWAKNIKISDPFEEGCRLGPIVSEGQYKKVLNCISTAKSEGATILIGGSRPEHLKKGYFVEPTIITDVTTSMQIWREEVFGPVLCVKTFSTEEEAIELANDTHYGLGSAVMSKDLERCERISKAIQAGIVWINCAQPSFIQAPWGGVKRSGFGRELGEWGLENYLSVKQVTKYISDEPWGWYQSPSKL

SEQ ID NO: 1390 - protein, 512 aa, Glycine max
  unsure (1)..(512): unsure at all Xaa locations
EVRREKWQSPLPSRQLFTKMESGKFPLLNKXRFPIINPATEDIIGHIPAATKEDVDLAVDAAKRAFSHNKGKDWSSAPGSVRARYLRAIASKITEKKDELGKLEAIDCGKPLDEALADLDDVIGCFNYYAELAEGLDAKQNAPVSLPMETFKSYVLKEPIGVVALITPWNYPLLMATWKVAPALAAGXTAILKPSELASVDCLELSEICXEVGLPPRVLNIVTGLGXHEAGAPLAAHPDVDKIAFTGSSATGSKIMTAAAQLIKPVSLELGGKSPIIVFEDVDLDKAAEWTIFGCFWTNGQICSATSRLIVHESIATEFLNRIVKWXKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGLGSAVISNDLERCERITKAFKAGIVWINCSQPCFTQAPWGGIKRSGFGRELGEWGLDNYLSVKQVTQYISDEPWGWYQSPSRL

SEQ ID NO: 1391 - protein, 805 aa, Glycine max
MATDRLTRVHSLRERLDETLTANRNEILALLSRIEAKGKGILQHHQVIAEFEEIPEENRQKLTDGAFGEVLRSTQEAIVLPPWVALAVRPRPGVWEYLRVNVHALVVEELQPAEYLHFKEELVDGSSNGNFVLELDFEPFNAAFPRPTLNKSIGNGVQFLNRHLSAKLFHDKESLHPLLEFLRLHSVKGKTLMLNDRIQNPDALQHVLRKAEEYLGTVPPETPYSEFEHKFQEIGLERGWGDNAERVLESIQLLLDLLEAPDPCTLETFLGRIPMVFNVVILSPHGYFAQDNVLGYPDTGGQVVYILDQVRALENEMLHRIKQQGLDIVPRILIITRLLPDAVGTTCGQRLEKVFGTEHSHILRVPFRTEKGIVRKWISRFEVWPYLETYTEDVAHELAKELQGKPDLIVGNYSDGNIVASLLAHKLGVTQCTIAHALEKTKYPESDIYWKKLEERYHFSCQFTADLFAMNHTDFIITSTFQEIAGSKDTVGQYESHTAFTLPGLYRVVHGIDVFDPKFNIVSPGADQTIYFPHTETSRRLTSFHPEIEELLYSSVENEEHICVLKDRSKPIIFTMARLDRVKNITGLVEWYGKNAKLRELVNLVVVAGDRRKESKDLEEKAEMKKMYGLIETYKLNGQFRWISSQMNRVRNGELYRVICDTRGAFVQPAVYEAFGLTVVEAMTCGLPTFATCNGGPAEIIVHGKSGFHIDPYHGDRAADLLVDFFEKCKLDPTHWDKISKAGLQRIEEKYTWQIYSQRLLTLTGVYGFWKHVSNLDRRESRRYLEMFYALKYRKLAESVPLAAE

SEQ ID NO: 1392 - protein, 816 aa, Glycine max
  unsure (1)..(816): unsure at all Xaa locations
MANHPLTHSHSFRERFDETLTGHRNEILALAVXRLEAKGKGILQHXHQVVAEFEEIPEESRKKLQDGVFGEVLRSTQEAIVLPPFVALAVRPRPGVWEYLRVNVHMLVVDELRPAEYLRFKEELVEGSSNGNFVLELDFEPFNASFPRPTLNKSIGNGVEFLNRHLSAKLFHDKESMQPLXLEFLRLHSYKGKTMMLNDKVQSLDSLQHVLRKAEEYLISVAPETPYSEFENRFREIGLERGWGDTAERVLEMIQLLLDLLEAPDPCTLETFLGRVPMXVFNVVILSPHGYFAQDNVLGYPDTGGQVVYILDQVRALENEMLNRIKQXQGLDITPRILIITRLLPDAVGTTCGQRLERVYDTEYCDILRVPFRTEKGIVRKWISRFEVWPYLETYTEDVALELAKELQAKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDPFDPKFNIVSPGADMGIYFPYTETERRLTEFHSDIEELLYSSVENEEHICVLKDRNKPIIFTMXQGLSRVKNITGLVEWYGKNARLRELVXNLVVVAGDRRKESKDLEEKAEMKKMYGLIETYKLNGQFRWISSQMNRVRNGELYRVICDTRGAFVQPAVYEAFGLTVVEAMTCGLPTFATCNGGPAEIIVHGKSGYHIDPYXHGDHAAEILVEFFEKSXKADPSHWDKISQGGXLKRIHEKYTWQIYSDRLLTLTGVYGFWKHVTNLERRESKRYLEMFYALKYRKLAESVPLAIEE

SEQ ID NO: 1393 - protein, 840 aa, Glycine max
  unsure (1)..(840): unsure at all Xaa locations
GDIHSPLLFTPPSLFCVHSVFQLKSFPSQWATDRLTRVHSLRERLDETLTANRNEILALLSRIEAKGKGILQHHQVIAEFEEIPEENRQKLTDGAFGEVLRSTQEAIVLPPWVALAVRPRPGVWEYLKVNVHALVVEELQPXAEYLHFKEELVDGSSNGNFVLELDFEPFNAAFPRPTLNKSIGNGVQFLNRHLSAKLFHDKESLHPLLEFLRLHSVKGKTLMLNDRIQNPDALQHVLRKAEEYLGTVPPETPYSEFEHKFQEIGLERGWGDNAERVLESIQLLLDLLEAPDPCTLETFLGRIPMVFNVVILSPHGYFAQDNVLGYPDTGGQVVYILDQVRALENEMLHRIKQQGLDIVPRILIITRLLPDAIGTTCGQRLEKVFGTEHSHILRVPFRTEKGIVRQWISRFEVWPYLETYTEDVAHELAKELQGKPDLIVGNYSDGNIVASLLAHKLGVTQCTIAHALEKTKYPESDIYWKKLEERYHFSCQFTADLFAMNHTDFIITSTFQEIAGSKDTVGQYESHTAFTLPGLYRVVHGIDVFDPKFNIVSPGADQTIYFPPTETSRRXLTSFHPEIEELLYSSVENEEHICVLKDRSKPIIFTMARLDRVKNITGLVEWYGKNAKLRELVNLVVVAGDRRKESKDLEEKAEMKKMYGLIETYKLNGQFRWISSQMNRVRNGELYRVICDTKGAFVQPXAIYEAFGLTVVEAMTCXLPTFAXTCNGGPAEIIVHGKSXAFHIDPYHGDRAADLLVDFFEKCKLDPTHWETISKAGLQRIEEKYTWQIYXSQRLLTLTGVYGFWKHVSNLDRRESRRYLEMFYALKYRKLAESVPLAVE

SEQ ID NO: 1394 - protein, 838 aa, Glycine max
  unsure (1)..(838): unsure at all Xaa locations
MTHASDHASASPSPLLLLRSFCFHSEDLLKKWQMHPLTHSHSFRERFDETLTGHRNEILALLXRLEAKGKGILQHHQVVAEFEEIPEESRKKLQGGVFGEVLRSTQEAIVLPPFVALAVRPRPGVWEYLRVNVHMLVVDELLPAEYLRFKEELVEGSSNGNFVLELDFEPFNASFPRPTLNKSIGNGVEFLNRHLSAKLFHDKESMQPLLEFLRLHSYKGKTMMLNDKVQSLDSLQHVLRKAEEYLTSVAPETPYSEFENKFREIGLERGWGDIAERVLEMIQLLLDLLEAPDPCTLXETFLGRVPMVFNVVILSPHGYFAQDNVLGYPDTGGQVVYILDQVRALENEMLNRIKKQGLDITPRILIITRLLPDAVGTTCGQRLERVYDTEYCDILRVPFRTEKGIVRKWISRFEVWPYLETYTEDVALELAKELQAKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDPFDPKFNIVSPGADMSIYFPYTETERRLTEFHPDIEELLYSSVENEEHICVLKDRNKPIIFTMARLDRVKNITGLVEWYGKNARLRELVNLVVVAGDRRKESKDLEEKAEMKKMYGLIETYKLNGQFRWISSQMNRVRNGELYRVICDTRGAFVQPAVYEAFGLTVVEAMTCGLPTFATCNGGPAEIIVHGKSGYHIDPYHGDRAAEILVEFFEKSKADPSHWDKISQGGLKRIHEKYTWQIYSDRLLTLTGVYGFWKHVTNLERRESKRYLEMFYALKYRKLAESVPLAIEE

SEQ ID NO: 1395 - protein, 232 aa, Glycine max
MDSRDSSPRSRDPDADNNNNHHHHRRQPSLDDAPPKVKLMCSFGGSIQPRPHDNHLTYVSGDTKILAVDRHVKFPSLIAKLSSLANNTPSNLSFFKYQLPGEDLDALISVTNDDDLHQMMIEYDRLSRASPRPARLRLFLFPLHNNCNFAPTESKSERQWFVDALNSVHVPEDSPPPPPATANPDFLFGLDKPAAEDALAKDSECFPEDREAEPQIENENNSKQLLQRIMKI

SEQ ID NO: 1396 - protein, 421 aa, Glycine max
SHRAIEQLPGSNTFEVAGGSSNNFGRSSSFMNDARGPHKRKIPKGIRGNSQDFNASSSSSSTAPPNARHANDVAIMDNTQFHIRSLVEVGPHGSEWSRPNESIMVHDHNHLIHGNYLGQHFPPIAPPWLFQQLNSNNNDGHATPWNQSLPMPCVQAPAINGSSLESVSMGLQRYHDPVGNRNGLRFPYHVPVNQQHHSYHHSTLPMQGVRDHSLNFFPTVTTNSFRVPTNPLRNVAIPTQASFEMGPRHVGPAPSSSLRIYRPHRGVVPETTLRHRSLPPMGFLRVNDVALIDEVGNLVDNHRDMRLDIEDMSYEDLIALGERIGNVNTGLSEETITTQLKTKTYLTGATSINMEEEVCDDQGTFSCIICQDEFKNQEKIGVLQCEHEYHADCLRTWLVVKNVCPICKSEALKSTSVSPPT

SEQ ID NO: 1397 - protein, 356 aa, Glycine max
MSDAAMAVVKPEMKSYIWLQTVDGSIQQVEEEVAMFCPMICQEVLQTGMGSSKNYAISLPQRVNPAILGLILDYCRFHQVPGHSNKERKTFDEKFIRMDTKKLCELTSAADSLQLKPLVDLTSRALARIIEGKTPEEIRETFHLPDDLTEEEKLEPLRNITDDPRIRLLNRLYARKRKELKERKKLKDVEVEEEPKDERSVEDLLSFINGADGDMKGTRTNKNKKKNRRRKDHAKDISSENTNENDKELNPLPSAYHDVNFDNALEASASKHSRTQNLPAINFSPKFEFIDGDVDDDLDPAMKEELDREVEDFARRLNSDWPERMQILSLGQDRRLVPISMNSNGSTHLYTGFDQR

SEQ ID NO: 1398 - protein, 281 aa, Glycine max
  unsure (1)..(281): unsure at all Xaa locations
MMEDPTTLLNSEYSRLFGEDTDLYNRIVLGALLPHSVWGPLPRFLQTWLRXNYLGGVLLXFLSGLLWCFYIYYWKRNVHVPKDAIPSVRAMLLQISVAMKAMPWYSLLPTVSEYLVETGWTKCYPRLYNVGWLAYLVYLAIYLIIVEFGIYWMHRELHDIKPLYKYLHATHHIYNKQNTLSPFAGLAFHPLDGILQALPHSLCLFFMPIHFTTHLALIFIEGVWTANIHDCIHGKLWPVMGAGYHTIHHTTYRHNYGHYTIWMDWMFGTLRDPEEDGGKAM

SEQ ID NO: 1399 - protein, 264 aa, Glycine max
LQLPVLIAEIAFAVFVVSIMSITTVLYVRYRLRDCECSKGSGVKKLGGNSSFQNENKVRPDLEELNKIRRAQIFTYEELETATGGFKEESIVGKGSFSCVFKGVFKDGTVVAVKRAIVSPNMQKNSKEFNTELDLLSRLNHAHLLNLLGYCEEGEERLLVYEFMAHGSLHQHLHGTNQVLREQLDWIRRVTIAVQAARGIEYLHGYACPPVIHRDIKSSNILIDEKHNARVADFGLSLLGPADSGSPLAELPAWTLGYLDPEYY

SEQ ID NO: 1400 - protein, 529 aa, Glycine max
FGFSSKRTLNDASDLAVKLPSFSTGISDDDLRETAYEIILGCAGATGGLIVPSKEKKKDKKSSLIRKLGRSKSGSVVSQSQNAPGLVGLLETMRVQMEISESMDIRTRQGLLNALVGKVGKRMDTLLIPLELLCCISRSEFSDKKAFIRWQKRQLKVLEEGLVNHPAVGFGESGRKTNELNSRFRPTRPAEFLPSSTGELQRTECLRSLREIAIPLAERPARGDLTGEICHWADGYHLNVRLYEKLLLSVFDMLDEGKLTEEVEEILELLKSTWRVLGITETIHHTCYAWVLFRQYVITREHGVLLHALEQLNKIPLMEQRGQQERLHLKSLHSKVEGERDMSFLQSFLTPIQRWTDKQLGDYHLHFNEGSATMEKIVAVAMITRRLLLEEPETSTQSLPISDRDQIEIYISSSIKNAFSRTVQVVDRVDMSHEHPLALLAEELKKFLKKESASFLPILSQRHPQATVVSASLVHKLYGHRLKPFLDSAEHLSEDVISVFPAAESLEQFIMALITSVCHEEDAEILLKN

SEQ ID NO: 1401 - protein, 478 aa, Glycine max
MQPLRRKTPLFTTSEMGAMKGRKNNNLSIFVVVFSIFLFGLFMYNEDVKSIAEFPFSSPKAHETQEGGEPNKHVDSVQEDNVVVVQRESEKKDVEDSVTDSDERVDLKTVVEKEKKIEMPRAEEEEEVEEEEEDEKVELPPEDCDLFTGEWVLDYVTHSLYRRDKCEFLTSQVTCMKNGRPDSLYQNWKWKPRDCSLPKFKPKLLFQKKKKRKKKKKKKRRKLSCHQKIVTCSLGSGDKIQEPEHVTTVEFYWAPFLVESNSDDPNMHSILNRIIMPESIEKHGVNWKDVDYLIFNTYIWWMNTFSMKVLRGSFDEGSTEYDEVPRPIAYGRVINTWSKWIDDNIDPNRTKVFFSSTSPLHIKSENWNNPNGIKCAKEITPVLNMSTPLDVGTDRRLFTIANNVTQSMKVPVYFINITSLSELRKDAHTSVYTIRQGKMLTPEQQADPTTYADCIHWCLPGLPDTWNEFLYTRIISQS

SEQ ID NO: 1402 - protein, 134 aa, Glycine max
MASRLTVTALVLIALATVSLQTSASSVGKFIDETITSHKIVIFSKTYCPYCRRAKAVFKELNQVPHVVELDEREDGSKIQDIMINIVGRRTVPQVFINGKHLGGSDDTVEAYESGHLHKLLGIETKDHDDHDDL

SEQ ID NO: 1403 - protein, 391 aa, Glycine max
  unsure (1)..(391): unsure at all Xaa locations
MEDKLATTSEGQPIRCKAAICRKPGSPLSIEEIIVAPPMPREARIRVICTSLCHSDVTFWKMEVPPAICPRILGHEAVGXSEWXVESVGEDVTEVTKGDVVVPIFLPDCGECIDXKSSKSNLCSKFPFEVSPWMPRHATSRFTDLKGDIIHHFLFVSSFSEYTVVDIAHLTKIDPAIPPNRACLLSCGVSTGVGAAWRTAGVEPGSTVVIFGLGSIGLAVAEGARLCGATRIIGVDVNPEKYETGKKFGLTDFVHAGESENKSVSQVIIKMTGGGADYCFECVGMATLVQEAYASCRKGWGKAIVLGVEKPGSMLSLSCNEVLHSGKSLVGCLFGGLKPKSDVPILLKRYMDKELNLDEFVTHEVEFKDINKAFDLLIEGQCLRCVIWMDR

SEQ ID NO: 1404 - protein, 148 aa, Glycine max
KALSGRNLIGFGEPTDPQIISVLRSNNTSGLQMCLRDGTWASIQPDHTSFFVNVGDLLQVMTNGSFKSVKHRVLANSSMSRLSMIYFGGPPLNEKIAPLPSLVSREEESLYRELTWREYKNAAYKSKLSDNRLSLFDKFADHSDKSPL

SEQ ID NO: 1405 - protein, 118 aa, Glycine max
  unsure (1)..(118): unsure at all Xaa locations
VVVIYCAICFLYXRLNNHVPLPTRVKNKKANPNIGSMESLKLLESSKYIRNLATIEVVYRIMMNLGEVPCMSXLNAQFPSPNEHSCFMGDSHTASGIDTFTSDVDNQPRFYTDRCESC

SEQ ID NO: 1406 - protein, 186 aa, Glycine max
MPQRKGCSSLNEPRLVARKFLARPQIEGVGTVVRRSIGGFELKYFDPFIVLDEFSVTAPAGFPDHPHRGFETVTYMLQGAIMHEDFEGHKGTIEAGDLQWMTAGRGIVHSEMPAAQGTQKGLQLWINLASKYKMIEPRYQEVLSKDITKAEDDGIKVRVIAWETLRIKSPIYTRIPTMFLDFFFKP

SEQ ID NO: 1407 - protein, 686 aa, Glycine max
  unsure (1)..(686): unsure at all Xaa locations
LCLPQFCVRVSASGSADEERTIIRKEKVGWKINYSGEKPATPLLDTVNHPIHMKNLSTQDLEQLAAELRADIVHSVSDTGGHLSSSLGVVELSVALHHVFNTPEDKIIWDVGHQAYPHKILTGRRSRMHTIRKSSRLAGFPKRDESVHDAFGCWHFAKGRSADLGMAVARNSXDSARGIISVIGDGALTAGQAYEAMNNAGFLDSNMIVVLNDNKQVSLPTATLDGPATPVGALSSALSKIQASSEFRKLREAAKTITKQIGGQTHQVAAKVDEYARGMISASGSTLFEELGLYYIGPVDGHNIEDLVTIFEKVKAMPAPGPVLIHVVTEKGKGYPPAEKAADRMHGVVKFDPKTGQQFKAKTSTLSYTQYFAESLIKEAENDKKIVAIHAAMGGGTGLNYFHKRFPKRCFDVGIAEQHAVTFAAGLAAEGLKPFCAIYSSFLQRGYDQVVHDVDLQKLPVRFAMDRAGLVGADGPTHCGAFDIAYMACLPNMVVMAPSDEAELMHMVATAAAIDDRPSCFRFPRGNGIGATLPLNNKGTSLEIGKGRILVEGSRVAILGYGSVVQQCRQASEMLKELGIDVTVADARFCKPLDTGLIRLLAKEHEILITVEEGSIGGFGSHVSQFLSLSGILDGPLKWRAMMLPDRYIEHGSPQVQIEEAGLSSKQIAATVLSLMERPNEALLFK

SEQ ID NO: 1408 - protein, 208 aa, Glycine max
MGRGKIEIKRIENSSNRQVTYSKRKNGILKKAKEITVLCDAQVSLIIFAASGKMHDYISPSTTLIDILERYQKTSGKRIWDAKHENLNGEIERLKKENDSMQIELRHLKGEDINSLNYKELMALEDALETGLVSVREKQMDVYRMFRRNDKILEEENRELTFLWQQRLAVEGAREVDNGFDQSVRDYNSHMPFAFRVQPMQPNLQERI

SEQ ID NO: 1409 - protein, 379 aa, Glycine max
MGRRKNNSNNNQCSSSKEDADMNSNHLRFEEADEAVDESSNLDQSMCDIEESDDKTSADYYFDSYSHFGIHEEMLKDSVRTKTYQNVIYQNKFLFKNKVVLDVGAGTGILSLFCAKAGAEHVYAVECSHMADMAKEIVEANGYSNVVTVLKGKIEEIELPVAKVDIIISEWMGYFLLFENMLNSVLYARDKWLVDGGVVLPDKASLHLTAIEDADYKEDKIEFWNNVYGFDMSCIKKQAIMEPLVDTVDQNQIATNCQLLKTMDISKMAPGDASFAAPFKLVAERDDYIHALVAYFDVSFTKCHKLMGFSTGPRSRATHWKQTVLYLEDVLTVCEGEAIVGSMTVAPNKKNPRDVDIMLKYSLNGRRCNVSRVQYYKMR

SEQ ID NO: 1410 - protein, 341 aa, Glycine max
MVSEGTLLGMGNPLLDISAVVDEDFLKKYDITSNNAILAEDKHKPMYQELAEKYNVEYIAGGATQNSIKVAQWMLQVPGATSYMGGIGKDKFGEEMKKNSKLAGVNVHYYEDETTPTGTCAVCIVGGERSLVANLAAANCYKSDHLKRPENWALVEKAKYIYIAGFFLTVSPDSIQLVAEHSAANNKIFSMNLSAPFICEFFRDVQEKALPYTDFVFGNETEARTFSKVHGWETDNVEEIAVKISQWPKASGTHKRITVITQGADPICVAEDGKVKKFPVKLLPKEKLVDTNGAGDAFVGGFLSQLVQEKPIEECVRAGCYAANVIIQRSGCTYPEKPDFH

SEQ ID NO: 1411 - protein, 270 aa, Glycine max
  unsure (1)..(270): unsure at all Xaa locations
HVLIICSRSRSFREADAEENAQDAEIERRIKLETKAEKHIQKLLLLGAGESGKSTIFKQIKLLFQTGFDEAKLKSYIPVIHANVYQAIKVCNNXKEVGKLSENLMLLDKVESSKNVIXTLKSRTFVKCSPAIKENDLTLYEDENKNRMMETKELFEWVLRQPCFEKTSFMLFLNKFDIFEKKVLNVPLNVCEWFKDYQPVSTGKQEIEHAYEFVKKKFEELYFQSTAPDCVDRVFKIYQATALDQKLVKKTFKLVDETLRRRNLFEAGLL

SEQ ID NO: 1412 - protein, 119 aa, Glycine max
VKHIFGREGNGRENVRPVSGEQEVHKGPSVREPAHQERPAEKERKTQGYLAKLAEQAERYEEMVECRKKAGTLVPDLTAEDRNLLSTGYKNVTGAPRASWSMTPSIEHTDESKGNERTV

SEQ ID NO: 1413 - protein, 170 aa, Glycine max
  unsure (1)..(170): unsure at all Xaa locations
MGFPVGYAEVFFPNPFLHTLALLGLLRNLVFFLLHLLGFSDFLETEVAWPDPPPXSDKAAAARPPSASALLIRDLLPVAKFGDSDVGAQQNGLCAVCLFEFSQEEEVRCLRNCKHIFPRTCVDRWIDHDQKTCPLCRTPLVPDDMLDDYNQRLWAASGVNEFYADYTSSF

SEQ ID NO: 1414 - protein, 120 aa, Glycine max
  unsure (1)..(120): unsure at all Xaa locations
VLIQKVSRVVAITHEASPCQGRVPXIQGITLKGGPQMVQLRFHGQRLXYTNSLFSPWDKLFYPELVQKGSPISSRXVVPDQGGXEIDPNLSVHFAVELDGPSIAHDMIYCGGKSTSQIWI

SEQ ID NO: 1415 - protein, 92 aa, Glycine max
  unsure (1)..(92): unsure at all Xaa locations
YIDIHTLPASYLRDEXHHTRCNSCNYXHGDPSYYRPLLIVPALPSCRVYVDDVKTDTWASSLHKAVYPDNIIHNTELSYPRTSHCLASADIR

SEQ ID NO: 1416 - protein, 103 aa, Glycine max
  unsure (1)..(103): unsure at all Xaa locations
MCVDKYYETNEPYLNALFLLRHTAMDSTTPSIERLFHRREGLYXRGFSYTYDDVIXLPHYIDFADEAWDLCTRLTRHLHLAKPFVASPMXDTVSESAMVRPMA

SEQ ID NO: 1417 - protein, 156 aa, Glycine max
  unsure (1)..(156): unsure at all Xaa locations
MKSFRYFDDTFNILTWRISQVDSVSCYCKVDSGLKTVVGARKFVPGSKLCIQPDINPNAHRSKYSRRERTRVQPPLLPGLPDDLAIACLIRVPRVEHGKLRLVCKRXWYHLLSGNFFYSLRRSLGMAEEWVYVIKRDRDGRISLHAFDPIYQLWQS

SEQ ID NO: 1418 - protein, 183 aa, Glycine max
  unsure (1)..(183): unsure at all Xaa locations
MASAPTPHKEIMYMAKLAEQAKRYKDMAEFMETVSSSVESXELTXVEERTLLSVPYNNEIIARQSSWRIMCLIEQMEESRXTNDHVASSETSRPRSKPSSXNICDGMLKLLNTRLVRCDDCGDYKDFYLMMKADYHMHLAEFKTGSNPREADQSTLSCYTASHDIAHTELPTTDPMRLRLALN

SEQ ID NO: 1419 - protein, 131 aa, Glycine max
EKPKMGTMESIKFLVSSKYIRDLATLVVAYGISINLVEVTWKSKLKAQFPSPNEYSSFMGDFSTATGIATFIMMLLSQFIFDKYGWGFGMTPLLAAVYVGAMQNIFSKSAKYSLFDPCKEMAYIPLDEDTK

SEQ ID NO: 1420 - protein, 87 aa, Glycine max
  unsure (1)..(87): unsure at all Xaa locations
CHCSKAHTSGSNSFHEGSLAIXGKXXKRVSSKVWCYYCDREFDXEKILVQHQKAXHFKCHVCXXKLSXAGXMXIHVLXVHKXSVXKY

SEQ ID NO: 1421 - protein, 68 aa, Glycine max
  unsure (1)..(68): unsure at all Xaa locations
MAAXXXXPXXXFVYMXKXAEQAERYEEXVXFMXKVSXSAESXEXTVEEXNLLSXAXKXVIXARRASWX

SEQ ID NO: 1422 - protein, 233 aa, Glycine max
MTMGNKRAVICGVTYGKRKFKLEGTINDVNNMKNLLLDNFKFPIGCIRVLTEEQKDPNLIPTKKNILDSLNWLVKDCQSEDSLVFYFSGHGLQQPEYCKGDEIDGLDETICPVDFLREGMITDNDINSTIVQPLKKGVTLHAVIDACHSGTTLDLMYLCKKEKGSWNWKDSKPPHSKKPMTKTNGGLSICLSACKDSLMAADTAVRILGIYFHLPPPCDEMQCNKFHILNCEY

SEQ ID NO: 1423 - protein, 192 aa, Glycine max
MDPRLIHPHDGIVTQDELQGGAASNLSHAHKGDPCLVLTADPKPRLRWTQDLHERFVDAVTQLGGASKATPKAIMRTMNVKGLTLFHLKSHLQKYRLGKQSGKDVGEGCKDGSYLLESPGADNTSPKLPTPDTNEGYEIKEALRAQMEVQSKLHLQVEAEKHLQIRQDAERRYMAMLERAWQMLADQFISAT

SEQ ID NO: 1424 - protein, 294 aa, Glycine max
  unsure (1)..(294): unsure at all Xaa locations
MGAPKQKWTAEEEAALKAGVLKHGAGKWRTILTDPEFSAILRMRSNVDLKDKWRNINVTAIWGXRQKAKLALKRNLPAPKXDNTIWLEYIVRNDEXLDTKPIAVSGGPLQSPNLKEQISRLVDNHILEAIVNMKEQKGSDKVAIASFIEEKYRSPPNLSKLLSTKLKHMVASGKIVKEKHKYRIAPSSTVSEKRRCSSLVLLEEKPKDPSEVHKNDDVNILSKSQIDAEISKVKGLTAQEAAAAAAKAVAEAEAAIAQAEAAAREAEAAEAEAEAAQVFAKAAMKALKCKMLHI

SEQ ID NO: 1425 - protein, 227 aa, Glycine max
MHKVWWRLILFRSHITKENDNITGRFDYLTEKDCWKMGGCCCSARKPHLHGTPVYYYCPPTLEERESLTSNDGRAMSLTTGLLVSLNLETSTPDTYQSPPAPPPYDMVLGGPASTDSESGRVTVSGSSFETLITCDDLEESDCKAKANSAPISPSKAGLSKSKEFHALVTEEEDGCPICLEEYDVENPKTLTKCEHHFHLSCILEWMERSDSCPICDQEMIFDQTLN

SEQ ID NO: 1426 - protein, 462 aa, Glycine max
MSMSLSLLRIFSSPHLSTSLFFPTPTLSSLCPSFLSKLPNAPSPLIVLCHRDASASKQGHLGVPESAERDSGSEEDDDAVEQPMRASYDDDEDEEEGALSSLVFPERWDVLGLGQAMVDFSGMVDDNFLKNLGLEKGTRKVVNHEERGRVLQAMDGCSYKAAAGGSLSNTLVALARLGSRSEKVPAINVAMTGSVGSDLLGGFYREKLRRANVQFLSAPIKDGTTGTVIVLTTPDAQRTMLAYQGTSSTVNYDASLANAVSKTNILVVEGYLFELPDTIKTITKACEKARSNGALVAITASDVSCIERHFDDFWEIIGNCVDLVFANGNEARALCNFEAKESAASAARYLSHFVPLVSVTDGPTGSYIGVKGEAVYIPPSPCVPVDTCGAGDAYASGILYGLLRGISDLRSIGSLAAKVAATVVGQQGTRLRISDAVKLAESFEFQLDSSSSVGTDHNISSV

SEQ ID NO: 1427 - protein, 86 aa, Glycine max
  unsure (1)..(86): unsure at all Xaa locations
MPDQDICSYINEPRLVARKFLARPQHEGVGAVVRRSIGRFELKYFDPFIVLDEFSVTAPAGFPDHPHRGXETVTYMLQGAITHEDL

SEQ ID NO: 1428 - protein, 636 aa, Glycine max; identical to SEQ ID NO: 630

SEQ ID NO: 1429 - protein, 79 aa, Glycine max
  unsure (1)..(79): unsure at all Xaa locations
SLLEHHXLXATVADXRFCKPLDRSLIRSLAQSHXVLITVEEGSIGXFGSHVXQXXXXXGLLGXXXXSFPCKLAVVPPVI

SEQ ID NO: 1430 - protein, 182 aa, Glycine max
MTSSETLAFMELAIQQAKLALDVLEVPVGCVIVEDGKVIASGRNRTTETRNATRHAEMEAIDVLLGQWQKHGLSMSEVAEKFSNCSLYVTCEPCIMCASALSILGIKEVFYGCSNDKFGGCGSILSLHLSNTAPLNNEVPSGKCFKCTGRIMASEAVLLFRTFYEQGNPNAPKPHRPLARQE

SEQ ID NO: 1431 - protein, 67 aa, Glycine max
  unsure (1)..(67): unsure at all Xaa locations
MAXAXXXXEXFVYMAXXAXXAERXXEMVXFMXKVXASAESEEXTVEEXNXLXVAYXNXIGXRXASWR

SEQ ID NO: 1432 - protein, 176 aa, Glycine max
MEPRLLTIFFVVLSFSPFVQSLVRHYKFSVVLKNTTKLCSTKSFVTVNGQCPGPTLYAREDDTVIVKVTNHVKYNITIHWHGIKQLRTGWSDGPAYVTQCPIQPGQSYVYNFTINGQRGTLLWHAHITWLRATVYGGIVILPKRGISYPFPKPDKEKIIILGEWWKSDVEAILNQA

SEQ ID NO: 1433 - protein, 164 aa, Glycine max
  unsure (1)..(164): unsure at all Xaa locations
MPADTVGKTITCKAAVAWEAGKDLSIEDIEVAPPKAHEVRIEIYYTGVCHTDAYTLSGKDPEGAFPIVLGHEGAGIVESVGEGVTNVKPGDHVVALYTPECRECKFCKSGKTNLCGKIRATQGKGVMPDGASRFSARGXDLLHFMGTSTFSQYTGVADISVVAI

SEQ ID NO: 1434 - protein, 206 aa, Glycine max
MASKIESENSTDTSPSSPKNIYKGPDDGQQRFLLELEFVQCLANPTYIHYLAQNRYFEDEAFIGYLKYLQYWQRPEYIKFIMYPHCLYFLELLQNANFRNAMAHPTNKELAHRQQFYFWKNYRNNRLKHILPRSLPEPATPAAPAPASTPSQAPVSALPPVPATSVAVTAAPSQAPSPMPYVMPPGSGLAKNDMRNPTVDNRRKRK

SEQ ID NO: 1435 - protein, 58 aa, Glycine max
KTKDERCVQRSYWIEHTTDLSVESMMLDSNASDLDKEERPEVLSLLPAYEGKSVVELG

SEQ ID NO: 1436 - protein, 181 aa, Glycine max
  unsure (1)..(181): unsure at all Xaa locations
MGAPIKSFALPAMLLFSMIIIPQLALGGITRHYHFDIKYQNVSRLCHTKSVVTVNGQFPGPRIVAREGDNLLIKVTNHVQNNISIHWHGIRQLRSGWADGPAYVTQCPIQTGQSYVYNYTVVGQRGTLWWHAHISWLRSTXYGPLIILPQYGVPYPXTKPYKEVPIIFGEWWNADPGAVIT

SEQ ID NO: 1437 - protein, 194 aa, Glycine max
MARSQQRYRGVRQRHWGSWVSEIRHPILKTRIWLGTFETAEDAARAYDEAARLMCGTRARTNFPYNPNASQSSSSKLLSATLTAKLHRCYMASLQMTRPSSQPETQRVVASPNVITSSASNFSLKRNQTETMLLPQKRQEEEQEGEGNWVFKKVKVENAQQFKPLEEDHIEQMIEELLHYGSIELCSVIPAQAL

SEQ ID NO: 1438 - protein, 64 aa, Glycine max
  unsure (1)..(64): unsure at all Xaa locations
TTTGREYTVTDLTQADFGRLEIDLADVXMTGLMACRSEYGPSQLFKGARITGSLHMNMQTAVLI

SEQ ID NO: 1439 - protein, 72 aa, Glycine max
MSDLEAPLRPKTYKVWVDYVVQFRSILVMDVVVPISFAICFRAYVGGVRSERRSYDARRIEHDDSVMRAIER

SEQ ID NO: 1440 - protein, 284 aa, Glycine max
MDWAGPTRRLFISLNYIFCYNMKRFVFSLAWVFALLLASSLAHAAVVEHTFNVEDITVQRLCRQQLITAVNGTLPGPTINAREGDTIVVHVFNKSPYNLTLHWHGIIQFLTPWSDGPEFATQCPIASGSSYTYRFNLTGQEGTLWWHAHSSFLRATVYGALLIRPRLGHSYPFPKVYQEIPILVGEWWNANVVEVEQNATETQQPPIESDAYTINGLPSDLYNCSQDGTYQVKVKQGKTYLLRIINSALNNQHFFEVANHTLTVVAIDATYTNHYDTKVVVLAP

SEQ ID NO: 1441 - protein, 292 aa, Glycine max
HASGGIEYLHGYACPPVIHRDIKSSNILIDEEHNARVADFGLSLLGPADSGSPLAELPAGTLGYLDPEYYRLHYLTTKSDVYSFGVLLLEILSGRKAIDMQYEEGNIVEWAVPLIKSGDITAILDPVLKPPPDLEALKRIANVACKCVRMRGKERPSMDKVTTALERGLAQLMGSPCIEQPILPTEVVLGSNRLHKKSSQRSSNRSVSETDVAETEDQRFEFRAPSWITFPSVTSSQRRKSSVSEADVDGKNNNAEGKNMGNVGGGGDVLRSLEEEIGPASPRERMFLQHNF

SEQ ID NO: 1442 - protein, 353 aa, Glycine max
MMQHSGHPTVFDILYTNACTYHTKDDMPPGTKNTVGQYESHTGFTLPGLYRVVHGIDVLYPKFNIVSPGADMSIYFPYSEKQNRLTALHGSIDKLLFDPEQTDEYIGSLKDKSKPIIFSMARLDRVKNITGLVECFGKNSKLRELVNLVVVAGYIDVKKSSDREEIAEIEKLHELMKKYNLNGDFRWIAAQTNRARNGELYRYIADTQGAFIQPAFYEAFGLTVVEAMTCGLPTFATCHGGPAEIIEHGISGFHIDPYHPDQASELLVEFFQKSKEDPDHWKKISNGGLQRIYERYTWKIYSERLMTFAGVYSFWKYVSKLERRETRRYLEMFYILKFRDLANSVPLAKDDAS

SEQ ID NO: 1443 - protein, 241 aa, Glycine max
MGRGRVELKRIENKINRQVTFAKRRNGLLKKAYELSVLCDAEVALIIFSNRGKLYEFCSSSSMLKTLERYQKCNYGAPEANVSTREALELSSQQEYLKLKARYEALQRSQRNLMGEDLGPLSSKELESLERQLDSSLKQIRSTRTQFMLDQLSDLQRKEHLLSEANRSLRQRLEGYQINPLQLNPGVEEMGYGRHPAQTHGEALFQQMECEPTLQIGYQPDPVSVVTAGPSMSNYMAGWLP

SEQ ID NO: 1444 - protein, 86 aa, Glycine max
  unsure (1)..(86): unsure at all Xaa locations
GCEKTTDGTWKSKLKAQFPSLNEYSPILGDFSTATGIATFTMILVSQFICDNYXXAVVAIITPTVLLLTRAGFFPLXLHGGPLAPG

SEQ ID NO: 1445 - protein, 472 aa, Glycine max
CFGFGLSDCVLFLQLHKLLDFLNSITLKNSVISIRNKKLPLMTKQKIRNALLVHLVILFFFSTSVVSARVVSLLQNYGNPIFRSNFHSIYDTSKYGVFQLSNGLGKTPQMGWNSWNFFACNINEMVIKETADALVSTGLADLGYVYVNIDDCWSSVTRNLKGQLVPDHKTFPSGIKALADYVHGKGLKLGIYSDAGVFTCQVRPGSIFHETDDADLFASWGVDYLKYDNCYNLGIPPKERYPPMRDALNATGQKIFYSLCEWGVEDPALWADKVGNSWRTTGDINDSWASMTTIADLNDKWAAYAGPGGWNDPDMLEVGNGGMTYQEYRAHFSIWALAKAPLLIGCDVRNLTAETLEILSNKEVIAINQDSLGVQGRKVQVSGADGCRQVWAGPLSGNRLAVALWNRCSKVATITASWEALGLESGVHVSVRDLWQHKVVTGDAVSSFSARVDIHDCQLYIFAPFTVSHSVE

SEQ ID NO: 1446 - protein, 234 aa, Glycine max
LDQPAGRQLRRPPPPYCPATKCPALSEDDNLYDDFNMDEVDLDLENYEELFGMALSHSEELFENGGIDSLFGTKGMSAGDSNCQEAIAAEGSSVGQVNAMQPACSNAASADSILSTKTEPILCFTGRQTQSNLSFSGVTGESSAGDYQDCGASSMLLMGEPPWFAPCPENSLQSANRSNAVMRYKEKKKTRMFDKKVRYASRKARADVRRRVKGRFVKAGDVYDYDPLSTTRSC

SEQ ID NO: 1447 - protein, 162 aa, Glycine max
  unsure (1)..(162): unsure at all Xaa locations
EMVDAMKKVAKLDVELSVEERNLFSVGYKNVVGSRRASWRILSSIEQKEDSKGNELHVKHIRDYRNKXGDYYRYLAEFKAGNEKKEVADQSLKAYQTASTTAESELQPTHPIRLGLALNFSVFYYEILNSPERACHLAKQAFDDAVSELDTLNEDSYKDSTL

SEQ ID NO: 1448 - protein, 192 aa, Glycine max
MSRVYVGNLDSRVTERDLEDECRVFGVIRSVWVARRPPGYAFIDFDDRRDAQDAIRELDGKNGWRVELSHNSRGGGGGRGGRSGGSDLKCYECGEPGHFARECRMRGGSGRRRIRSPPRFRRSPSYGRSPRGRSPRHRSLSPRGRSYSRSPPYRGREEVPYANGKGLNGRILGMMSDDWSRNGLRERRTSRS

SEQ ID NO: 1449 - protein, 278 aa, Glycine max
MVVQLFNTAIIMDEKVETLKAELQRVREENNTLRLMLEVLNSKCTKLEIHLQEINKAQHKGMSSNQIGSVTVPPMFDTNKRPRLELPTAKKPLQIFVRTHPKDDSLIVKDGYQWRKYGQKVTKDNASPRAYFRCSMAPMCPVKKKVQRCLHDKSIVVATYDGEHNHAAIHESSSSTSKGSSPVVNNLPLMTSILNDKEPMNIGLALSGWSQTDHRRHCEDAMQQNNNNGGSNIRIEEYVSSLIKNPDFSMSLAEAVVRTITGQQKQQDINLNLDLPEE

SEQ ID NO: 1450 - protein, 284 aa, Glycine max
  unsure (1)..(284): unsure at all Xaa locations
TRPVASSMGDGGRWWLLVVSWXLSVSLFWTGAVLCNTVHVVVSGMVFLVLFHGGRDAASIPANSLMKSLQYALTTSFGSICYGSLFTAAIKTLRWEIRGFRSKIGNNERLLCLGDFLFYLVETLVRHLSWFCPLQIAVYGKSFNHSARDAWELFQSTGGXALVAYDCSGAVLLMGTVFGGLITGTCSGVWAWVKWKDRVIMIGYTTMLMGMVLVGLAMVVVESAVTSIYICYAEDPLLIQRWDAEFFNQMSETLHQRLQYRSARAREVLTHNRLDDIVQQNASI

SEQ ID NO: 1451 - protein, 444 aa, Glycine max
MATIVSIKARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVSLAVCKAGASVLKIPLYKHIANIAGNKKLVLPVPAFNVINGGSHAGNKLAMQEFMVLPVGASSFKEAMKMGVEVYHNLKSVIKKKYGQDAINVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 1452 - protein, 628 aa, Glycine max
MAFGNYKQKQQQEEEEQEHRMEEDEDESEEEEEQFWDDWEGEDEEGEQRDSEFVCLFCESRYSSCGSLFDHCASLHRFDFHAIRTTLSLDFYASFKLINFIRSLVAENRCWSCGLTCQSNRDLQNHLHDLVDFNEIKTLWNDDRYLIPFMEDDSLLYSFGDCDEEGEDEQITPIDEDLIKDLMNIEESIHDDQDLVKKVVVDDDKHEIDSVSNNHLNKASSSKKLINGKDSKGHVLCSDKDPEGHLMVNSQNHIAKHIKKINESYFGSYSSFGIHREMLSDKVRMDAYGQAILKNPSLLNSAVVMDVGCGTGILSLFSAKAGASRVIAVEASAKMAAVASQVAKDNGLLLSKSQNGVDGLQKGVIEVVHGMVEEIDKTVELQPRSVDVLLSEWMGYCLLYESMLGSVLYARDRWLKPGGAILPDTATIFVAGFGKGATSLPFWENVCDFDMSCIGNELVIDAARIPIVDVVDSQDLVTCSAILQSFDLATMKPNEVDFTATATLELKPSTSGTCCWCYGVVLWFDTGFSSRFCRETPAVLSTSPYMPRTHWSQTILTFQEPIAMGFGKENRGKPEAIGTEVYPAVKIDLRVSIVRSTEHRSIDISLEAAGVGPDSHKRSWPAQLFNLQ

SEQ ID NO: 1453 - protein, 207 aa, Glycine max
  unsure (1)..(207): unsure at all Xaa locations
MHPINTGDDSTLSSPIPQYGQISNSCLIETQDPSLQPLNQGGNGRKRHYRGVRQRPWGKWAAEIRDPKKAARVWLGTFDTAEAAAAAYDAAALKFKGSKAKLNFPEHVLVPPPPISSSPYNNNHQNNHSYCYGSSALAPPPPLPLPSSQHVYDQPQQPLLSSSSQEEGFPNLMQYAQLLWSRDDDDLQRVASGLXSSTTSSSSSSSQ

SEQ ID NO: 1454 - protein, 151 aa, Glycine max
  unsure (1)..(151): unsure at all Xaa locations
MSKSNNNIMSFKALTLWCILLSLLQLSLGAVRHRIRFNVEYMYREPDCHEHVVMGINGQFPGPTITAEAGDTLEILLTNKLSTEGTVIHWXHGIRQYGTPWADGTAAISQCAIAPGETFNYTFTVDRPGTYFYHXHFGMQRAAGLYGSLIV

SEQ ID NO: 1455 - protein, 321 aa, Glycine max
MEEACEFRSWAELIPDALGVIFTNLSLQERVTVIPRVCKSWANAVTGPYCWQEIDIKDWSNRCQPDQLDRLLEMLITRSCGTLRKLSVSGLQTESIFTFIAENACSLHTLRLPRSSMNDSIVEQIAGRLSMISFLDVSYCIKIGPYALEMIGKNCKLLEGLCRNMHPLDTAEKPHQDDEAYAIASTMPKLKHLEMAYHLISTSGVLQILANCPKLEFLDQRGCWGVTLDHMFLKQKFPKLKVLGPLVLDTYESDGWDDFSDVSDSSEYLAWDFVAGGMGEYYVDDSDSYDGMWDDEARLDELQFGFYEGIEDAGMYWPPSP

SEQ ID NO: 1456 - protein, 429 aa, Glycine max
  unsure (1)..(429): unsure at all Xaa locations
IAVITWLEANSQADNEPTHFTPSSSTGCWGKEFVPGSKLRIQPDINPNEXRENTPRETTRVQPPLLSGLPDDLAIACLIRVPRIEHRKLHLVCKRWHRLLSEDFFYSLRKSLGMAEEWLYVIKADRAGRISVHAFDPIYQLWQPLPPVPGDFPEAMWVGSAVLSXCHLYLFGGVDLEGSRSIRRVIFYNVCTNKWHRAPDMLQKRNLFRSCVINNCLFVAGGELEGIQMTRSAEVYDPSQNRWSFISEMRTSMVPLFGFVHNGTWFFKGNEIGSGNSMCEAYSPETDTWTPVTNGMVNGRGNDCISLNGQLYALGCPDGCKLTVYDRATDSWKKLIDSKLHVDKFPSLVAVAPVSLNGKLCIIRHNMSISLVDVSSPNQQLESNPQDLWENIAGKAQHIRRSLVRKLWSTIARRDFSKVXIVCCQVLQA

SEQ ID NO: 1457 - protein, 409 aa, Glycine max
  unsure (1)..(409): unsure at all Xaa locations
HFPSSISWGDGVLCQIRDYLYSNLDVNSLKHVNPFLFQIPIECFEEPWVIFRGKDGKPGCVQNTCAHRACPLHLGSVNEGRIQCPYHGXVVGEXDSLHQLKEIFASIHDYILAMSYMHWFIYAYIKRYTYMKIYPSNELYVIHIKTYRLKISNCLMLGWEYTTDGKCEKMPSTRLLNVKIKSLPCFETEGMIWVWPGNDPPTATLPSLLPPSGFEVHAEIVMELPIEHGLLLDNLLDLAHAPFTHTSTFAKGWSVPSLVKFLTPASGLQGYWDPYPIDMEFRPPCMVLSTIGISKPGKLEGQSTSQCATHLHQLHVCLPSSKQKTRLLYRMSLDFAPVLKHIPFMQHLWRYFAEQVLNEDLRLVLGQQERMNNGANVWNFPVSYDKLGIRYRLWRNALERGNKQPPFSK

SEQ ID NO: 1458 - protein, 344 aa, Glycine max
MGASSDPTQDGSDEQQKRSEIYTYEAPWHIYAMNWSVRRDKKYRLAIASLLEQYPNRVEIVQLDDSNGEIRSDPSLSFEHPYPPTKSIFIPDKDCHRPDLLATSSDFLRVWHISESSVELKSLLNGNKNSEYCGPLTSFDWNEAEPRRIGTSSIDTTCTIWDIEKETVDTQLIAHDKEVYDIAWGGVGVFASVSADGSVRVFDLRDKEHSTIIYESSEPDTPLVRLGWNKQDPRYMATIIMDSAKVVVLDIRFPTLPVVELQRHQASVNAIAWAPHSSCHICTAGDDSQALIWDLSSMGQPVEGGLDPILAYTAGAEIEQLQWSSSQPDWVAIAFSTKLQILRV

SEQ ID NO: 1459 - protein, 71 aa, Glycine max
  unsure (1)..(71): unsure at all Xaa locations
MAASAPTPREDFVXMANLAEXAERYEEMVEFMEKVSASAESEELTVEERNLLSVAYKNVIGARRASWRIIS

SEQ ID NO: 1460 - protein, 55 aa, Glycine max
MAASAPTPREDSVYMANLADQAERYEDMVDFMEKVSASAESEELTVEERNLLSVA

SEQ ID NO: 1461 - protein, 229 aa, Glycine max
  unsure (1)..(229): unsure at all Xaa locations
FGELPNLLFKVXNSGSNCWEGETALRRKTEDNSIEYDSTDDNVVYFLSKAGFVVASNMQRSPSKQFSSVITNKDGQEIVYFLSSSGNVVACNLTCKCFFEYPXLLPVFSEYSIDVVECNGEMLVVLLSEFLEIATLRVWKYDEASRGWHQIAAMPAANSHEWYGKKADINCVGAGNQIFICLNSPELCTYVVCDLEPTKWVEFPKCCINGEVIAFMSALSFEPRIEASV

SEQ ID NO: 1462 - protein, 418 aa, Glycine max
MEEVEDGVAEESMGAGAEIMEGVDDLLKLEKIQEDLAERFGSQPTFAQWAAVAGGSGMNLQDLVQEGCRGLVKGAEKFDGTKGFKFSTYAHWWIKQAVRKSLSDQSRTIRLPFHMVEATYRVKEARKQLYSENGRQPDDEEVAEATGLSMKRLNAVLMTPKAPRSLEQKIGINQNLKPSEVISDPDAETAEEQLLKQFMKKDLEEALDSLNPRERQVVRWRFGMDDGRTKTLQEIGEMRGWPETANTWEPLENLQSVPDLVDAFEDSLKSGKHQKRKRKHVDVLQLTLLKKRSERSTTSYSLRHFPPLTPTNANDYDPKLSELKAPTHTGVQLDNLAIHFQQPIPSRGAKRRKSASSVKRFKRDTDAAALQPISAPINMPDANTACNIVKIIKPIGYSASLSDNMHDVLVTFMAMRFT

SEQ ID NO: 1463 - protein, 145 aa, Glycine max
MDSPHFPSFASLRVLLFGFCVITLFPEFVVSITRHYTFNVEYLNVTRLCHTRNILSVNGKFPGPRLVAREGDRVVVKVVNHVSNNVSIHWHGIRQITTGWADGPAYVTQCPIQTNQSYTYNFTHSWQCKSQFWHAHILSLRQCYM

SEQ ID NO: 1464 - protein, 151 aa, Glycine max
VSTVGEGKVSSNGHGCCKSRPGYASPLQAISGPRESLIYVTSVYTGTGIEKPDYLATVDVDPHSPTYSKVIHRLSVPYLGDELHHTGWNSCSSCHGDPSADRRFLIVPALVCVILTFPQLNYINLKGHFIHTFIKFIRKRVYIITRVNISI

SEQ ID NO: 1465 - protein, 136 aa, Glycine max
KSYEPNQQLRRSLNFSGEKPSTPVLDTINYPIHMKNLSIQELEELADELREEIVYTLSKTGGHLSSSLGVAELTVALHHVFNTPQDKIVWDVGHRTYAHKILTGRRSKMHTIRQTGGLAGFPKRDESLHDAFCVGH

SEQ ID NO: 1466 - protein, 64 aa, Glycine max
APPIYNPALNPLMARPLIWPAAPAQAWYPQQAAYPQQSAVSVPPIVAGLHHNSHYSQFRMCLLL

SEQ ID NO: 1467 - protein, 194 aa, Glycine max
  unsure (1)..(194): unsure at all Xaa locations
MEKGSTKMAAVTQPKDLVKKPKDAKSFAIDFMMGGVSAAVAKTAAAPIERIKLLVQNQDEMIKQGRLATPYKGISDCFARTYADEGLVSLWRGNTANVIRYFPTQALNFAFKDYFKSMFNFKKSESYAKWFAGNIASGGAAGASSLLFVYSLDYARTRLANDNKSAKKXGGSRQFNGLISVYRQTLATDGIARL

SEQ ID NO: 1468 - protein, 446 aa, Glycine max
SARARSREIDFENPPPWDEQQNQNYKAKFMCSYGGDTKILAVDRSVKFSAFLSKLSALCDSPPQDLTFKYQLPGEDLDALISVTNDDDLEHMMHEYDRLYRPNLKPVRMRLFLFTLSNSNPNSSFSSERDRFVEALNSGPVPSQPDPIKTPPVTPSNVDYLFGLDKAVAPPNLPPNFAAVKFHDPVPEPVAPTPVEYQSRVSDRVVGSDPNVNSMEIQRQMQQEMQRLQIAENEYRRRSEDGFATGYAAAAGGDYYMQKVQEKVPPQNAAVPPPAAYWSEKQFSGEGYQTTVTTAAPGGGDQPMYVMAAPGTFYHHSPVMRPPAAAQGYYAVQRMGSDGYREQQAVYGGMAAPKAGFSTAGMVKGPAYSEGYSGGVVRPAGLPDNAAYAQVAYDSASGRQVYYTAQGGVVHAPPQYQGGPPQDVRPGGVSVGQDGKVVNKVNQGSV

SEQ ID NO: 1469 - protein, 81 aa, Glycine max
  unsure (1)..(81): unsure at all Xaa locations
ARAFSLCLSRRGLVAVASAATPREECECVAKXGQAERCEEMVEFVEKVSASAESEELTVEERDLLSVAXRGLCFGARRASW

SEQ ID NO: 1470 - protein, 74 aa, Glycine max
  unsure (1)..(74): unsure at all Xaa locations
HGGFLLGRRSFTWRPGEXVRYEDIVEFLEKVAKIAEVDELTVEERNLLSVAFKNVIGASRASWRIISSIEQKEE

SEQ ID NO: 1471 - protein, 193 aa, Glycine max
LSRAARRIEYGCEKTTEDDLVSILNEVKSTKTTGPVLLHVVTEKGHGYPYAERAADKYHGVTKFDPATGKQFKSNAATQSYTTYFAEALIAEAEADKDIVGIHAAMGGGTGMNLFLRRFPTRCFDVGIAEQHAVTFAAGLACEGLKPFCAIYSSFMQRAYDQVVHDVDWARLRIRERSNGLQKRASATVARKP

SEQ ID NO: 1472 - protein, 291 aa, Glycine max
  unsure (1)..(291): unsure at all Xaa locations
MFPQENHSNGYQQGPGVGYSHRERVRRGTRRSRASTSSVRVYDQHQPQHRPPCTDFDVAYFHSYAHLGIHQEMIKDRVRTETYRDAIMQHQSSIAGKVVVDVGCGTGILSIFCAQAGAKRVYAIDASDIALQANEVVKANNLSDVIVVLHGRVEDVEIDEEVDVIISEWMGYMLLYESMLGSVINARDRWLKPGGLILPSSATLYMAPVTHTDRYSDSVDFWRNVYGIDMSAMVSLAKQCAFEEPSVETITGENVLTWPHVVKYIDSYSVTVQELESXVTAKFKFNXMMRA

SEQ ID NO: 1473 - protein, 180 aa, Glycine max
  unsure (1)..(180): unsure at all Xaa locations
MGRSPCCDKVGLKKGPWTPEEDQKLLAYIEEHGHGSWRALPAKAGLQRCGKSCRLRWTNYLRPDIKRGKFSLQEEQTIIQLHALLGNRWSAIATHLPKRTDNEIKNYWNTHIKKRLTKMGIDPVTHKPKNDALLSSDGQSKTAANLSHMAQWESARLEAEARLXRESKIRSHSLQHQLGK

SEQ ID NO: 1474 - protein, 122 aa, Glycine max
EKTNQTMGNIGEKAQAAKEKTQEMAQAAKEKTQQTAQAAKDKTCDTSQAAKEKTQQNTGAAQQKTSEMGQSTKESAQSGKDNTQGFLQQTGEKVKGAAQGATEAVKQTLGLGEHDQDNRRNY

SEQ ID NO: 1475 - protein, 273 aa, Glycine max
  unsure (1)..(273): unsure at all Xaa locations
MSKARVYTDVNVLRPKEYSDYESLTLQWGDQDDYEVVRKVGRGKYSEVFEGINVNSNERCIIKILKPVKKKKIKREIKILQNICGGPNIVKLLDIVRDQHSKTPSLIFEXLDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDELNAYLNKYHLELDPQLDALVGRHSRKPWSKFINADNQHLVSPEALDFLDKALR

SEQ ID NO: 1476 - protein, 238 aa, Glycine max
  unsure (1)..(238): unsure at all Xaa locations
SKTIKKLFPITALIGFSCCSSSSISLWLVLGVFLMATMLRMYATCQQLQAQAQAHAAAASGILGHTELRLHMPPSIALASRGRLQGLRLQLXALLVREFDDLDYEPLRALDSDNVSTAPSMPEEEINALPVHKYKVSGPQCGGSSMQQASSSAPAEKKQDNSNAVGSMKASDDDLSCSVCLEQVNVGDVLRSLPCLHQFHANCIDPWLRQQGTCPVCKFRAGSGWSDNGHNDIIADMV

SEQ ID NO: 1477 - protein, 418 aa, Glycine max
  unsure (1)..(418): unsure at all Xaa locations
MGLGNDDDDGDTLKSFGSVCCSICLEAVTDNGDRSWAKLQCGHQFHLDCIGXSAFNIKGAMQCPNCRKVEKGQWLYANGCRSYPEFSMDEWTHDEDLYDLSYSEMSFGVHWCPFGNLTRLPSSFEEGDFSSTAYHDVLGQHAIFAEHTAVSSASHPCPYIAYFGPIHPSTFNSGGTVSEASNFNHWNGPPVPGDMPTSYTFPAVDLHYHSWEHNSSHFSSANSRLGTAEQASVSPGSQRPARVGSEVPRSGSFMHPFLVGHSSAARAGNSVASSMIPPYPGSNARARDRVQALQAYYQPQQPHNSTTIRTPVASSTRRSSSHSGPVQLAPVASPPDQSAGFVYIPSGSSGRNFQEETHLPSRFHAWEREHLPSLALNNVGRESSWRAYHQTASVSDPSIRSSSFRLRHESDRMPSQNR

SEQ ID NO: 1478 - protein, 550 aa, Glycine max
  unsure (1)..(550): unsure at all Xaa locations
MGNTCRGSLKGKYSQGLSQPEDHSKPTTTHSDPSSDHPSTKQSAENYNNNNYLPFNAKRESIMRRGLDNQAYYVLGHKTPNIRDLYTLGRKLGQGQFGTTYLCTENATSIEYACKSISKRKLISKXDVRGPLGREIQIMHHLAGHKNIVTIKGAYEDPLYVHIVMELCSGGELFDRIIQRGHYTERKAAELTKIIVGVVEACHSLGVMHRDLKPENFLLVNKDDDFSLKAIDFGLSVFFKTGQVFTDVVGSPYYVAPEVLLKHYGPEAYVWTAGVILYILLSGVPPFWAETQHGIFDAVLKGLIDFDSDPWPLISDSAKDLIRKMLCSRPSERLTAHQVLCHPWICENGVAPDRSLDPAVLSRLKQFSAMNKLKKMALRVIAESLSEEEIAGLREMFQAMDTDNSGAITFDELKAGLRRYGSTLKDIEIRDLMEAADVDKSGTIDYGEFIAATVHLNKLEREEHLIAAFQYFDKDGSGYITVDELQQACAEQNMTDAFLEDIIREVDQDNDGRIDYGEFAAMMQKGNAGIGRRTMRNSLNLSMRDAPSAQ

SEQ ID NO: 1479 - protein, 401 aa, Glycine max
  unsure (1)..(401): unsure at all Xaa locations
TANSSINQKDESHSLGVKQKYDLIDLPPDARPLLVFINKKNGAQRGDSLRMRLNILLNPVQVFELSSTQGPEMGLYLFRKVSHFRVLVCGGXDGTVGWVLNAIDKQNFVSPPPVAILPAGTGNELARVLSWGGGLGPVERQGGLTTFLHHIEHAAVTVLDRWKVTISNPQGKQQLLPTKFMNNYLGIGCDAKVALDIHNLREENPDKFYNQFMNKVLYAREGAKSIMDRTFADLPWQIRVEVDGVEIEVPEDAEGVLVANIGSYMGGVDLWQNEDENYDNFDQQSMHDKILEVVSISGTWHLGKLQVGLSRARRLAQGQSIKIQLFAMFPVQIDGEPWFQQPCTINITHHGQAFMLKRVAEEPLGPASAIIAEVLENAETHNVINASQKRALLHEMALRLS

SEQ ID NO: 1480 - protein, 217 aa, Glycine max
  unsure (1)..(217): unsure at all Xaa locations
MDCSSWINTSLDLSINPRRVHEEAVPKVVESKLFSLGMPKFNVEEESTSDLEEELKRVSAENKKLAEMLSVVCENYNTLRSHLMEYMRKNGEKEVSPTSKKRKSESSNNNNSNLMGTNNGNSESSSTDEESCKKPREETIKAKISRVYVRTESSDTSLIVKDGYQWRKYGQKVTRDNPYPRAYFKCSFAPSCPVKKKXQRSVDDHSVLLATYEGEHN

SEQ ID NO: 1481 - protein, 115 aa, Glycine max
  unsure (1)..(115): unsure at all Xaa locations
PEVALDKMHGVVKFDPKSRKQLKSKASTQYFAESLTAXAEVDEKIVAIHAAMGXXTGLNLFQKRFPERCFDVGIAEQHAVTFAAGLAAEGLNLFRAIYSSFLQRNYDQVRSYETL

SEQ ID NO: 1482 - protein, 241 aa, Glycine max
  unsure (1)..(241): unsure at all Xaa locations
MSETDLAVIKPEMMKLYVWLQTSDDSIQQVEQEIAMFCPLICQEIIQKGMGSSKSCAICLPQQVSPAMLRLILDYWRFRQLPGRSNNDHQAPGRSYKERKSYDENFIRMDTKRLCELTSAALTRHLHPLDIIEGRTPARIRDGISPPEVRAVVEKLEXPLRNITADPGIRLMNRLYAQKRKELKERARLKNVEVEEEHVDIFANDEVEAVLFVNRCVLDYLTLMNVYVGDPMEVKTPNATF

SEQ ID NO: 1483 - protein, 531 aa, Glycine max
MAEIEGSPGSSMHGVTGREQTFVASVASPIVPTDTTAKFALPVDSEHKAKVFKLFSLANPHMRTFHLSWISFFTCFVSTFAAAPLVPIIRDNLNLTKSDIGNAGVASVSGSIFSRLAMGAVCDMLGPRYGCAFLIMLSAPTVFCMSFVKDAAGYIAVRFLIGVSLATFVSCQYWMSTMFNSKIIGLANGTAAGWGNMGGGATQLIMPLVYELIRRAGATPFTAWRIAFFVPGFMHVIMGILVLTLGQDLPDGNLGALQKKGNVAKDKFSKVLWYAITNYRTWVFALLYGYSMGVELTTDNVIAEYFYDRFNLKLHTAGIIAASFGMANLLARPFGGYTSDVAARLFGMRGRLWNLWILQTLGGVFCIWLGRANSLPIAVLAMILFSIGAQAACGATFGIIPFISRRSLGIISGLTGAGGNFGSGLTQLVFFSTSRFSTSTGLSLMGVMIVCCTLPVTLVHFPQWGSMFLPPSKDVNKSTEEYYYTAEWNEEEKQKGLHQNSLKFAENSRSERGKRVCSSAPTPPNATPTHV

SEQ ID NO: 1484 - protein, 243 aa, Glycine max
MSHISTPSSSAAFDDSSEDACSICLEPFSTHDPATITSCKHEYHLHCILEWSQRSKECPICWQLLILKDPASQELLNAVEAEKRLSSRTVYSHAFTDSRSPLHRLNNDQDDSDFDEQLTQHLVSAASRARYICRGERQRSPGAGPSEVLVFNSSMHASGMQSTLTTSPSSGVPSTSAFSSVGMVTTNTSSESDMPCKPRVIYSQPSPEKCRRLNTSEIFSFPESFKSKLSAASARCKESISKI

SEQ ID NO: 1485 - protein, 69 aa, Glycine max
  unsure (1)..(69): unsure at all Xaa locations
MAASAPTPREDFVYMAXLAEKAERYEEMVDFMEKVSASAESEELTVEERNLLSVAXKNVMGARRASWRI

SEQ ID NO: 1486 - protein, 164 aa, Glycine max
GRISQAKSTLVKLLQYDPEKSPENVRYHGPPQVMLAYLKYQWSLGEDSKRREAFIRLQNLAMELSSAPNIQPVTPSSFTNGLNLSVPLLARVYLNLGSWQWSLSPGLVDESIKDILNAFTKATQYANKWAKAWHKWALFNTAVSLITLKRFPRCCSSFVLQGYR

SEQ ID NO: 1487 - protein, 239 aa, Glycine max
  unsure (1)..(239): unsure at all Xaa locations
LPDGLMRATDVMIAGKVAVICGYGDVGKGCAAAMKTAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKAGIIVLAEGRLMNLGCAXTGHPSFVMSCSFTNQVIAQLELWNEKASGKHEKKVYVLPKHLDEKVALLHLGKLGARLTKLSKDQSDYVSIPIEGPYKPPHYRY

SEQ ID NO: 1488 - protein, 87 aa, Glycine max
AAAPSPREENEYMAKLADQAARYEEMVETMENVSAAVDNQELTVKERNLLSPAYKNVIGARRASRRIISSIEQKDESHTNQDHESVI

SEQ ID NO: 1489 - protein, 345 aa, Glycine max
MATFEQFWTPNTLIGLGLGQFLSLLITSTGFTSSQLAKKGINAPTSQSFLNYVFLSLVYGTILLYRRKALKAKWYYYIILGLVDVEANFLVVKAYQYTSLTSVMLLDCWSIPSVMLLTWLFLKTKYRFKKITGVVVCVAGLVLVVFSDVHSGDRAGGSNPRKGDLLVIAGATLYAISNVSEEFLVKNADRVELMAMLGLSGGIISAIQISILERNELKSIHWSAEAALPFVGFAVAMFMFYSLVPVLLKINGSTMLNLSLLTSDMWAVLIRIFAYHEKVDWMYFVSFGAVTIGLIIYSGGDIDEDQHPPNAAIVDLGPAVKQDEEANSGNHSKGTAAGSSKTWVA

SEQ ID NO: 1490 - protein, 55 aa, Glycine max
MPAVVAGAVRTLFERIADLDMECRTRLILWFSHHLYCYDHSTKWIKFIYQLPLLD

SEQ ID NO: 1491 - protein, 312 aa, Glycine max
MMMMNNTIIPWSTIGVVIAWYTSNIGVLLLNKYLLSNYGFRFPVFLTTCHMLVCSLFSYVIVSVTEAVPLQRVRSRSQFWRIVALGVVFCFSVVCGNVSLRYIPVSFNQAIGATTPFFTAVFAYAVSAKREAWVTYATLLPVVAGVVIASGGEPSFHLFGFIICVSSTGARAFKSVLQDILLSSEGEKLNSMNLLLYMAPIAVMVLLPTILLMEGNVIQITMDLARKDIRIFWYLLLSSSLAYFVNLTNFLVTKHTSALTLQVLGNAKGAVAVVVSILIFKNPISMIGMLGYALTIIGVILYSETKKRYSKN

SEQ ID NO: 1492 - protein, 442 aa, Glycine max
  unsure (1)..(442): unsure at all Xaa locations
MKFQVIELLFGKSTPKQMIPKVTLLAVFAVLLFTVTPLSYPLFRYSSSSSSLKSNKQLSKKPSSAFDDLNESASLPSTSIKKCDIFTGEWVPNPKAPYYTNKTCWAIHEHQNCMKYGRTDSEFMKWKWKPNGCDLPVFNPFQFLEIMRGKSMAFVGDSVGRNQMQSMICLLSRVEWPIDVSYKRDDYFMRWKYPSYNFTMAAFWTTHLVKSKEADAKGPGPTGLCNLYLDEPDEKWITQIEDFDHVILNGGHWFTRSMVFYEKQKIVGCHYCLLENVPDLTMYYGYRKAFRTAFRAINRLENFKGTVFLRTFAPSHFENGLWNEGGNCIRTKPFKSTGDTNXEGLNLEFYMIQLEEFXIAEKEARKKGSXYRLFEIAQASLLRPDGHPSRYGHWPNENVTLYNDCVHWCLPGPIDTWSDFLLGMLKMEGVRSAEERLHLHSN

SEQ ID NO: 1493 - protein, 368 aa, Glycine max
MHALFDLLGRKLTMVAMMNGGMIEDIALIGGLIGVQFVYSGNAVLLSYLMSLGLESLTLVIFTSFATFLILLPLAFYYERYKWSTRAIFKLLIQLLLLSLGGVTLVQSLFLKGINLTSPAMGTAMPNLAPGLIFIIAWIFRLEKVDLSCTYSRVKIIGTFLCVLGALTMSILQSISTTPITGKEGTIQLLSPPNVTFDRHKIIGCLYLLVAILILSSNIVLQAFTLGDFPAPMSLCAITSFFGTFMTAAVQLVEGPLVKTGWPIVGVGDMIAYSLLAGAVNGICLSVNGWALEKRGPVLISMFSPIGTVCSVIFSVVTLGQTINIGSFAGMFLMFTGLYFVLWAKGKEGFAKGGGLESEYDAEKPLLS

SEQ ID NO: 1494 - protein, 74 aa, Glycine max
  unsure (1)..(74): unsure at all Xaa locations
STXKERETHVCVAKLSEQAXRYEEMVECMKTIAKLDLELTVEERNLLSVGYKNVIGARRASWRIMSSIEQKEES

SEQ ID NO: 1495 - protein, 545 aa, Glycine max
MALPHSISALATTLTLSSPITKPHKVNPFPFSSNRNSQFLTKQTRPRSRRNLSLTPARVAAPPSTVEADRLYPEAENNETEEEFSDESSSSKFTWRDHWYPVSLIEDLNPLLPTPFQLLGREIVLWYDKSISQWVAFDDKCPHRLAPLSEGRIDEDGKLQCSYHGWSFDGCGSCVKIPQASSEGPEARAIGSPKACATRFPTLVSQGLLFVWPDENGWEKAKASKPPMLPDDFDKPEFATVNIQRDLFYGYDTLMENVSDPSHIEFAHHKVTGRRDRAKPLPFKMDSRGSWGFSGANEGNPQISAKFVAPCYMMNKIEIDTKLPVVGDQKWVVWICSFNVPMAPGKTRSIVCSARNFFQFSVPGPAWWQVVPRWYEHWTSNKVYDGDMIVLQGQEKIFLSETKEGGDINKQYTNITFTPTQADRFVLAFRNWLRRHGNGQPEWFGNSSDQPLPSTVLSKRQMLDRFEQHTLKCSSCKAAYEGFQTWQKVLIGATVVFCATSGIPSDFQLRVLLAGLAVVSAAIAFALNQLQKNFEFVDYVHAEID

SEQ ID NO: 1496 - protein, 136 aa, Glycine max
  unsure (1)..(136): unsure at all Xaa locations
MATFFKERENFVYVAKLAEQAERYDGSLSLSLDFHCXKMVDAMKKVAKLDVELSVEERNLFSVGYKNVVGSRRASWRILSSIEQKEDSKGNELHVKHIRDYRNKVELELSNICSDIMIILDEHLIPSTNIAESTVF

SEQ ID NO: 1497 - protein, 263 aa, Glycine max
MATFSKERENFVYVAKLAEQAERYDEMVEAMKKVAKLDVELSVEERNLFSVGYKNVVGSRRASWRILSSIEQKEDSKGNELHVKHIRDYRNKVELELSNICSDIMIILDEHLIPSTNIAESTVFYYKMKGDYYRYLAEFKAGNEKKEVADQSLKAYQTASTTAESELQPTHPIRLGLALNFSVFYYEILNSPERACHLAKQAFDDAVSELDTLNEDSYKDSTLIMQLLRDNLTLWTSDIPEEGEDLKMESAARVDQGEDELGR

SEQ ID NO: 1498 - protein, 231 aa, Glycine max
  unsure (1)..(231): unsure at all Xaa locations
MPLTGDRDGCFATNEVWSYDAVVRQWSPRAAMLVSRSMFACCVMIGIILVAGGFSTGRKSISQAEMYDXDXXVWIPMPDLHRTHNSACSGVVIGGKVHVLHKDLSTVQVLDNAGPGWTVEECVWLQGQMAVVGDALYVMSHGLIFKQDKEVRKVVGSASEFRKRIGFAMTGLGDDLYVIGGFIGPDRWNWDIKPLSEVDVLTLGSERPTWRQAAPMTRCHGPILGCTLLRI

SEQ ID NO: 1499 - protein, 356 aa, Glycine max
MMRRHSLVTASPKQVSLFFVGHKSNPTTIHPHTHTLLTPSPKQDPQNHNQWWGHPKTIKPSFNHSRIRFNTLHTGSTEEQVETGEVEVDVWTKMQEEAKLDVTEEPILSNYYNTSILSHKTLETALANHLAINLSSTSLPSSTLSDLFVTVLETDQAIMDAVKCDLRAVKERDPACISHVHCFLNFKGFLACQAHRVAHKLWLQGRKILAVMIQNRVSEIFAVDVHPGARIGSGILLDHATGIVVGETAVIGNNVSILHSVTLGGTGKVSGDRHPKIGDGVLIGAGTCILGNIKVGDGAKIGAGSVVIKDVPPRTTVVGNPAKLVGGKNNPVKLDKIPSFTMDHTSHIADFYDYCV

SEQ ID NO: 1500 - protein, 78 aa, Glycine max
  unsure (1)..(78): unsure at all Xaa locations
NDEELTVEERNLLSVAYKNVIGARRASWRIISSIEQKEESRGGXDHVFVIRDYRSKIEYELFYLCYGVLKLLGTGVIA

SEQ ID NO: 1501 - protein, 345 aa, Glycine max
MSGLIERLPDAVAIRCLARVPFYFHPVLELVSRSWQAAIRSPELFKARQEVGSTEDLLCVCAFDPENLWQLYDPMRDLWITLPVLPSKIRHLSNFGAVSTAGKLFVIGGGSDAVDPLTGDQDGCFATDEVWSYDPVVRQWAPRASMLVPRSMFACCVLNGKIVVAGGFTSCRKSISQAEMYEPEKDVWIPMPDLHRTHNSACSGVVIGGKVHVLHKDLSTVQVLDNAGPGWTVEECVWLQGQMAVVGDALYVMSHGLIFKQDKEVRKVVGSASEFRKRIGFAMTGLGDDLYVIGGFIGPDRWNWDIKPLSEVDVLTLGSERPTWRQAAPMTRCHGPILGCTLLRI

SEQ ID NO: 1502 - protein, 382 aa, Glycine max
  unsure (1)..(382): unsure at all Xaa locations
HFLSYLCSVRSFRNTPTSFITFSNWLLMYLSDIEVQKLAERMLRWLKDAGYIFFRESCFHQSGDSKRKYNPTHYREPRFYTKVFKECHMSDNTGSSCKCIGAYVRNKKNQNQICWIWQKVRSQDDRDFQCFXDRVEYSYKSILRSERMYGPGFVSTGGPETTKEFVAKLGLKPGQKVLDVGCGVGGGDFYMAENFDVEVIGIDLSINMISLAIERAIGLNYAVEFDCADCYRKTYPENTFDVIYTRDTMLHVKDKPTLFRSFYKWLKPGGKILITDYCKSAGSPSLEFAEYIKKGGYYLHDIKAYRQMLEDAGFDDIIAESRTDQFVKTLQQELNALENKKDDFIGDFSEEDYNEIVERWKAKQTRGASREQMWGLFIAKKN

SEQ ID NO: 1503 - protein, 144 aa, Glycine max
AAAPSPNEENVYMAKLAEQAERYEEMVEVIENDSAAADNEELTVYERNLLSVTYKNVIGARRTSWRIISSIDHKEESHSNDDHVYVIRDYRSKIYSNLSNICDSILKLLNCLLIPFASSYEFKVFYLDIKADYPQYLIKFKTST

SEQ ID NO: 1504 - protein, 78 aa, Glycine max
STMTPSMMPPIMMPSMIPPTMMQSMVSSMIMPNMMTVPQCYSDSISHIIQQQQLPFMFSRTLVAISPMFLQQPFVGAA

SEQ ID NO: 1505 - protein, 73 aa, Glycine max
LTHTFSLSLSHPDRVAIASAPTPRAAFVYMAKLAEQAARYEEMVDFMEKVTASAERDELTVEERNLLSVAYKN

SEQ ID NO: 1506 - protein, 113 aa, Glycine max
  unsure (1)..(113): unsure at all Xaa locations
AASKDRENCSCIAKLAEHAERYEEMVESLKNEANLDVELTEEERNLLSVGYKNVIGARRASWKILSSIRQLEXTKGNEXNAKRIKDNTHXVKLELTNICNDEMTVIDEHLMAS

SEQ ID NO: 1507 - protein, 546 aa, Glycine max
  unsure (1)..(546): unsure at all Xaa locations
MGEICDSLCCHGWCLCNILHSLFLSSCCYNMEPLSSTKHNNNLSKPSSLHTEAPPPEASPLRKIMVVASIAAGVQFGWALQLSLLTPYVQLLGIPHTWAAFIWLCGPISGMLVQPIVGYHSDRCTSRFGRRRPFIAAGSLAVAIAVFLIGYAADLGHMFGDSLXKKTRPRAIAIFVVSFWILDVANNMLQGPCRALLADLCAGDHRKTRNANAFFSFFMAVGNVLGYAAGSYSGLHNVFPFTKTKACDVYCANLKSCFFLSIALLLTLSTIALTYVKEKTGMSEKNPASSVLFHGSHGGIXIYKQFGYTRYXIVYDMVRLACVTCLNWIVCHTFLLFDTDWMGREVYGGTVGEGKAYDRGVRAGALGLMLNSVVLGATSLGVEVLARGVGGVKRLWGIVNFLLAVCLAMTVLVTKMAQHSRQYTLLPNAHQEPLPPPAAVKAGALALFSLLGIPLAITYSIPFALASIFSSTSGAGQGLSLGVLNLAIVIPXMVVSVISGPWDALFGGGNLPAFVVGAVAIMLTPVQKRMSITGHPRKKLYESFVQ

SEQ ID NO: 1508 - protein, 107 aa, Glycine max
  unsure (1)..(107): unsure at all Xaa locations
HLPHEENVYIDKLAVQAECYEXMVEXLERVSFGADNNELTXEEMNLFLPACWNVIRARRAWWLIISSIEQKEESLSHHDHVSGMLHYRVMIVSELCNICDVVLKLLD

SEQ ID NO: 1509 - protein, 378 aa, Glycine max
MESATVSSSESEMALPLPLASESQQPYVSELLSFTLDRLHKEPELLRVDADRIRRQMQEVAVGNYRSFIAAADALIAIRQEVSSIDNHLESLINEIPKLTSGCTEFIESAEQILEKRKMNQTMLTNHSTLLDLLEIPQLMDTCVRNGNYDEALDLEAFVGKLSTMHPKLPVIQALAAEVRLTTQSLLSQLLQKLRSNIQLPECLRIIGYLRRIGVFSEYGMRLLFLRCREAWLTGILEDLDQANPYEYLKGMINCHRMHLFDVVNQYRAIFADDTSGSEENYDGGLLFSWAMHQITSHLQTLKVMLPKITEGGSLSNILDQCMYCAMGLGWVGLDFRGLLPSLFEEAVLNLFSKNMSTAVENFQLVLDSHRWVPLPRV

SEQ ID NO: 1510 - protein, 115 aa, Glycine max
IPLPIAVLPMILFSIGAQAACGATSGIIPFISRRSLGIISGLTGAGGNFGSGLTQLVFFSTSKFSTSTGLSLMGIMIVCCTLPVTLVHFPQWGSMFLPPSKDINMSTEEYYYTAE

SEQ ID NO: 1511 - protein, 385 aa, Glycine max
MGLVCSRSRRFREAHAEENAQDAEIERRIELETKAEKHIQKLLLLGAGESGRSTIFKQIKLLFQTGFNEAELKSYIPVVHANVYQTIKVLQDGSKELAQNDFDSSKYVISNENQDIGQKLSEIGGTLVYPRLTKELAQEIETMWEDAAIQETYARGNELQVPDCAHYFMENLERLSDANYVPTKEDFLYARVRTTGVVEIQFSPVGENKRSGEVYRLFDVGGQRNERRKWIHLFEGVTAVIFCSAISEYDQTLYEDENKNRMMETKELFEWVLRQPCFEKTSFMLFLNKFDIFEKKVLNVPLNVCEWFKHDYQPVSTEKQEIEHAYEFVKKKFEELYFQSTAPDCVDRVFKIYQATAPDQKLVKKTFKLGDETLRRRNPLEAGLL

SEQ ID NO: 1512 - protein, 342 aa, Glycine max
  unsure (1)..(342): unsure at all Xaa locations
LIPGTLLHQLKQATVVSKMGLPASPGAATRKVVFSAEEAKLQAENGNKVELMRPETSPEDIEGMVASEALVTTHGGMTSHAAVVARXMGKCCVTRCSNVEIDTVNKTVYYPESELHERDIVSVDGSAGDLYLRAIETVNAEHSEEFDQFLTWSEEIARLQARMNAETPQDIKAGYNFGSKRIGLVRTEHMFFGPERLIEMRRFILASNHDERVQALEKIKTYQVEDFETIFRLSQDRPTIVRLLDPPLHEFLPSSEEDINNVSQQLNVSSEFLRKRIVDLNEVNPMLGHRGCRLAVTYPELYEMQVEAIIESVIKLQKEGITCLPEIMIPLVSTVEEFTTLK

SEQ ID NO: 1513 - protein, 224 aa, Glycine max
TSTFTEYTVVDSACVVKIHVDGDGDLNPYIKRLTLLSCGVSTGVGAAWNTADVHFGSPVAVFGLRAVGLSVAEGARARGASKIIGVDINSDKFIKARAMGITDFIDPRDDEKPVYERIRDMTRGGVHSSSECAGDVHVLSEAFLSAHAGCGLTVILGIHPSPQLLPIHPMELFQGRRIVGSVFGSFKGKTQLPHCAKECMDGVVKLDEFITSQPPIEGINKGLR

SEQ ID NO: 1514 - protein, 48 aa, Glycine max
  unsure (1)..(48): unsure at all Xaa locations
VYPIXLCPHKLFKLPVKTXIYPEPGFELHRRQXDTQTGXMYXDVGVYY

SEQ ID NO: 1515 - protein, 414 aa, Glycine max
MSLRSIVRELKEMRDGIGSTSKRGAESKHRLSRTKSHVAPDVLATPFEPIQQGQWANLPSELLLDIIQRVEESETSWPARAVVVYCGSVCKSWRAVTKEIVKTPEQCGRLTFPISLKQPGPRDSPIQCFIRRNRETSTYLLYIGLVPSENETDKLLLAAKKVRRATGTDFVISLVADDFSRSSNTYVGKLRSNFLGTKFTIYDSQPPHGAAIQPDSQSSRRFHSKQVSPRVPACNYLVSTVAYELNVLCTRGPRRMHCVMNSIPVSAIQEGGNAPTPTSFPQIFDEPFSPSPALKEKVPVTDLNSASLSEPPVSSQCSAEQLALKNRAPRWHEQLQCWCLNFKGRVSVASVKNFQLVAAVDPSHNISAEEQEKVILQFGKIGKDIFTMDYCYPLSTFQAFAICLSSFDTKPACE

SEQ ID NO: 1516 - protein, 241 aa, Glycine max
MGRGRVELKRIENKINRQVTFAKRRNGLLKKAYELSVLCDAEVALIIFSNRGKQYEFCSGSSMLKTLERYQKCNYGAPEDNVATKEALELSSQQEYLRLKARYEALQRSQRNLMGEDLGPLSSKELESLERQLDSSLKQIRSIRTQFMLDQLSDLQRKEHFLGESNRDLRQRLEEFQINPLQLNPSAEDMGYGRHPGQPQGHALFQPLECEPTLQIGYHPDPVSVVTEGPSMNNYMAGWLP

SEQ ID NO: 1517 - protein, 243 aa, Glycine max
MGRGRVELKRIENKINRQVTFAKRRNGLLKKAYELSVLCDAEVALIIFSNRGKQYEFCSGSSMLKTLERYQKCNYGAPEDNVATKEALVLELSSQQEYLRLKARYEALQRSQRNLMGEDLGPLSSKELESLERQLDSSLKQIRSIRTQFMLDQLSDLQRKEHFLGESNRDLRQRLEEFQINPLQLNPSAEDMGYGRHPGQPQGHALFQPLECEPTLQIGYHPDPVSVVTEGPSMNNYMAGWLP

SEQ ID NO: 1518 - protein, 58 aa, Glycine max
  unsure (1)..(58): unsure at all Xaa locations
MLQEMLKDTVRTKTYQNVIYQNKXXFKNKVVLDVGAGTGILSLFCAKAGAEHVYAVSN

SEQ ID NO: 1519 - protein, 192 aa, Glycine max
QTQITPPGLPTSAPVPVSQPLFPVVGNNHTTTQSSAFSAPPLPSSVPSVTPVMSTNVPVDTHLSSNSSVTSSYQAIGVPGGAASNSHSYASGPNTGGPSIGPPPVIANKAPAPQPATNEVYLVWDDEAMSMEERRMSLPKYQVHDESSQVSHTTSLIDGVAFASNQMSRLYASCFQIPLFTHCFQFKEVHSV

SEQ ID NO: 1520 - protein, 84 aa, Glycine max
  unsure (1)..(84): unsure at all Xaa locations
LVALRTCGRALCRKCAHRFMADHKVCLVSNEVCRESNLVXLDKGGPGFSDHGDHXLEARHFKHFGSGSGVGLVSPAMKPCRFII

SEQ ID NO: 1521 - protein, 147 aa, Glycine max
  unsure (1)..(147): unsure at all Xaa locations
PLKDRENFVYIAILVYLAVRFXEMAESMRSAANIPIRTXTAEERNLLSVEHKTATSARTETXRILTCIEQKGETKGNXLYATWTKDSRQEGESKLSNIXDEVXMRASDEHFITAGVRGESTALNYXTTGEYDWDRAECKSSKEKKEA

SEQ ID NO: 1522 - protein, 179 aa, Glycine max
  unsure (1)..(179): unsure at all Xaa locations
NVYMANVAEQAERYLXMVEFMEKVSAAADNXELTVEDRNLLSVDYYNVDRRRXGALCRIISSIDQKEESRGNNDHVYVILDYRSKIESXELSNMCNGILRLVDSHMMLSAFCGDSKVCYLKMKEDDHRYLAEFMSGAKRREASDSTLSACRVAQHDANARSDATASDKRGHALDYMYET

SEQ ID NO: 1523 - protein, 357 aa, Glycine max
MKNCDEWKPFLVMIAIDFSLTMVNILLKKVLQEGMNHLVFITYRLSVATIFLAPIGYFKERNGRPRLTLQILCYLFFSAIIGASVTQYFFLLGIQYTSATFACAFVNMVPVITFIMALPFGLETVNIKCKGGKAKILGTFVCIGGALLLTLYKGKALFDGSHHQSAVAMRSAMDQASSTTRTTQKWTIGVIALIMGTLFWSFWFILQSKIGKRYPCQYSSTAIMTFFGAMQAAILGFSTGSSNLSSWVLKDKIQIITVLYSGIVGSSVCYVGMSWCVKKRGPVFTAAFSPLVQIMSGMIDIPFLHEQLHLGSVVGSMLVMIGLYILLWGKSKDMMQNNGATKFAQEVEETKEQEPQV

SEQ ID NO: 1524 - protein, 192 aa, Glycine max
  unsure (1)..(192): unsure at all Xaa locations
MEEACEFRSWAELIPDALGVIFTNLSLQERVTVIPRVCKSWANAVTGPYCWQEIDIKDWSNRCQPDQLDRLLEMLITRSCGTLRKLSVSGLQTESIFTFIAENACSLHTLRLPRSSMNDSIVEQIAGRLSMISFLDVSYCIKIGPYALEMIGKNCKLLEGLCRNMHPLDTAEKPHQDDEAYAIAXTMPKLKH

SEQ ID NO: 1525 - protein, 206 aa, Glycine max
  unsure (1)..(206): unsure at all Xaa locations
MSDVEEYRCFIGGLAWSTSDRKLKDTFEKFGKLIEAKVVVDKFSGRSRGFGFVTFDDKKAMDEAIDAMNGMDLDGRTITVDRAQPQQGSTRGDGDRYRDRGRDRDRDHGGGGGRGSNGGECFKCGKPGHFARECPSEGSRGGKYGGRESRYGGSSGGGYGPDRADRSSGGRSXGDGGSHGDSGSDRFYRDRSGPYERERRGSGGFR

SEQ ID NO: 1526 - protein, 168 aa, Glycine max
MATATYPPPPPYYRLYKDYLQNPKSAPDPPPPIEGTYLCFGANYTTSDVLPTLEEQGVRQLYSKGPNVDFKKELRSLNGELQLHVLELADILIERPSQYARRVEEISTVFKNLHHLLNSLRPHQARATLIHILELQIQRRKQAVEDIKRRREEARRLLNESLATLDGH

SEQ ID NO: 1527 - protein, 523 aa, Glycine max
  unsure (1)..(523): unsure at all Xaa locations
QLVFIFVPTPNLSNEPDAPYYEKKLWRPLILPQSKTSTTKSEALKRKIRTLDNTTSDSLRLLDRRETSLDATLQIXSGTLDTRRTAALSALLTDADDIXQQAPPTVKVNDTTGLILKLKSFCLRMDAFGFFAFVSAKKKELDGLRAEMPVALAECVDPAKFVLEAISEXVFPVDKRGDKAGHDLGWVCVLVLESLIPVVVDPVIGKSRLLVTPIVKEQATEIAETWKTSLEERGGVENVKTPDVHTFLQHVVTFGIVKNEDSDLYRKLVIASAWRKQMPKLALSLGLAQQMPDMIEELISKGQQLDAVHFTYEVGLVEKFPPVPLXKSFLKDAKKVAASILEDPNNAGRAAYLAARKEQSALRAVIKCIEEYKLEDEFPPENLKKRLDQLEKVKTVKTEKRKPVAVPANKRTRASNSNGGPMPPAKAXGRLTNAYVSSFPAAPTFVRSPSHGAIPQLLFPPYPSPPHMYGSRSPPTNPYAAYSPEXAPAIAGSYPGSXPMNYPPAYGGYGNVLAPTYQQAYYR

SEQ ID NO: 1528 - protein, 182 aa, Glycine max
IFGLGSIGLAVAEGARLCGATRIIGVDINPEKFEIGKKFGVTDFVNAGECGGKPVGQVIIEITDGGADYCFECVGMASLVHEAYASCRKGWGKTIVLGVDKPGARINLSSYEVLHDGKSLMGSLFGGLKPKSHVPILLKRYMDKELQLDKFVTHEVEFKDINKAFDLLSKGECLRCVIWMDK

SEQ ID NO: 1529 - protein, 394 aa, Glycine max
  unsure (1)..(394): unsure at all Xaa locations
MEHKVATTTEGQSIRCKAAICRKAGEPLSIEEIIVAPPMPGEARIRIICSSLCQTDISFRNMQMYLLXLKDHPAIYPRILGHEAIGVVESVGEDVTEVTKGDVVVPIFLPDCGECIDCKSSKSNLCSKFPFEVSPWMPRYATSRFTDLKGEIIHHFLSVSSFSEYTVVDIAHLIKIDPAIPPNRACLISCGISAGIGAAWRAAGVEPGSTVAIFGLGSIGLAVAEGARLCGATKIIGVDVNPERYEIGKRFGLTDFVHSGECENKSVSQVIIEMTGGGADYCFECVGMASLMHEAYASCRKGWGKTIVLGVDKPGSKLNLSCSEVLVSGKSLRGCLFGGLKPKSHVPILLKRYMDKELNLDEFVTHEMEFKDINKAFDLLIEGQCLRCVIWMDK

SEQ ID NO: 1530 - protein, 196 aa, Glycine max
  unsure (1)..(196): unsure at all Xaa locations
PRVIAREGDRLVIKVTNNVPYNVTIHWHGVRQLRSAWADGPAYVTQCPIQTGQTFVYNFTVTGQRGTLWWHAHISWLRTTLYGPIVILPXXHVPYPXXXTFKEVPIIFDTETVINQAMQTGLAPNLSDAYTINGFPGFLYNGTTKGKQQHDNRTDTFKLKVKAGKTYLLRLINAALNNELFFGIANHTLTVVEADA

SEQ ID NO: 1531 - protein, 263 aa, Glycine max
  unsure (1)..(263): unsure at all Xaa locations
ACLQVQLQNVTRLCQTKSIVTINGRFPGPRVIAREGDRLVIKVTNNVPYNVTIHWHGVRQLRSAWADGPAYVTQCPIQTGQTFVYNFTVTGQRGTLWWHAHISWLRTTLYGPIVILPXXHVPYPXXXTFKEVPIIFGEWWKADTETVINQAMQTGLAPNLSDAYTINGFPGFLYNGTTKDTFKLKVKAGKTYLLRLINAALNNELFFGIANHTLTVVEADAVYVKPFRTNYVLITPGQTINVLLKTKSKAPNAAFVIAARPYA

SEQ ID NO: 1532 - protein, 132 aa, Glycine max
  unsure (1)..(132): unsure at all Xaa locations
MGRKKKKQLKPWCWYCNRDFDDEKILIQHQKAKHFKCHICHKKLYTGPGLAIHCMQVHKETIDAVPNAIPGRTDIELEIYGMEGIPEKXMEERRRILEQKTQVDGQKKKTNQDDSDYDDDDDTAPXTSFQQM

SEQ ID NO: 1533 - protein, 610 aa, Glycine max
IRLEARRRQKGREHKDKFDLVISDVHMPDMDGFKLLELVGLEMDLPVIMLSANGDTKMVMKGISHGACDYLLKPVRMEELKNIWQHVIRRKKFDSKEKNKTSNLDKPTSNSGNGLGSSGTGNSDQNEKLTKKRKDQDEDEDEDQENDLDNEDPSAQKKPRVVWSVDLHRKFVAAVNQLGIDKAVPKKILDLMNVEKLTRENVASHLQKYRLYLKRISCVANQQANMVAALGVADPSYLRMSSVSGVGHVQTLSGSGQLHNNNFRSFPPSGIINRLNTPAGLNVHGFPSGVLQLSQSQNLNNANDHHKFQSVIVPVNQNGVQGMTVSVGLDQLQNNKVVMSVQNLTTVFDAKTTFPIPNKLPDPRPKITNSVSHTSDVHFSNNALMLEPRPQGSQGSVRIGTLSSSVASQHSEFSLSLLDQGRYSDNWTSAVQPSVIQTNFFPPSECFRQTNIPPADNMASVPLQGGNLSGPSITSLSRQSHDSMTEMHSEGMTFTNRPGHTSSNVPFQGWDDHNQDATHHSNIMSINSLTPVNGAAVQAGHAATNSVLHRNLDFNYCDPLQMKHEGFVELTDETLLKQHQGNTMDQQKSQENHFSNNLGSLEDLVSSMMK

SEQ ID NO: 1534 - protein, 82 aa, Glycine max
  unsure (1)..(82): unsure at all Xaa locations
RLNVKIKSLPCFETEGMIWXWPCNXXXTATLPSLLPPSGFEVHAEIVMELPIEHGLLLDNLLDLAHAPFTHTSTFAKGWSVP

SEQ ID NO: 1535 - protein, 204 aa, Glycine max
MYRERGGVGSKSEVTSVDRKRINDVLDKQLERSSPSTSRAAAINGKDRSSSSLLAAAKDSRSASVTAPISKNSNASDEESETDSEESDVSGSDGDDTSWISWFCNLRGNEFFCEVDDDYIQDDFNLCGLSSQVPYYDYALDLILDVESSHGDMFTEEQNELIESAAEMLYGLIHARYILTSNGMAAMLDKYKNYDFGRCPRVYC

SEQ ID NO: 1536 - protein, 135 aa, Glycine max
MSGKGAKGLITGKTSATNNKDKDKKKPISRSSRAGLQFPVGRIHRLLKSRTTANGRVGATAAVYSAAILEYLTAEVLELAGNASKDLKVKRITPRHLQLAIRGDEELDTLIKGTIAGGGVIPHIHKSLINKSSKE

SEQ ID NO: 1537 - protein, 99 aa, Glycine max
  unsure (1)..(99): unsure at all Xaa locations
MMKLYVWLQTSDDSIQQVEQEIAMFCPLICQEIIXXGMGSSKSCAICLPQQVSPAMLSLILDYCRFHQVPGRSNKERKSYDEKFVRIDTERLCELTSAA

SEQ ID NO: 1538 - protein, 126 aa, Glycine max
  unsure (1)..(126): unsure at all Xaa locations
VDKGKESSNSDNEVEATNSPIICGLPDDISLMCLARIPRKYHSVLKCVSKRWRDLICSEEWICYRRKHKLDETWIYALCKDKSKEIFCYVLDPTDPIRYWKLVGWSXPHIXXXEGMGFEVLGNKLF

SEQ ID NO: 1539 - protein, 106 aa, Glycine max
  unsure (1)..(106): unsure at all Xaa locations
ALLVEKTTNGTKYKAKDLSQADFSHLKIELAEVXMPGLMACQTEFDISHPYKGARITVFLHMTIQTALLIDTLTALGAEVLLRYCILYSTEDSFATRNKSQSEDIF

SEQ ID NO: 1540 - protein, 89 aa, Glycine max
  unsure (1)..(89): unsure at all Xaa locations
WXXLCRSNSQFIWPWEEWAYVLDLPRWAPQRVFVQEVLEREVRLSYWDKVKQSREGRTHCAVLLPSCFGLPGAVELTTEGRQTDGGACC

SEQ ID NO: 1541 - protein, 116 aa, Glycine max
SNSQFIWPWEEWAYVLDLPRWAPQRVFVQEVLEREVRLSYWDKVKQLPCKATHHQNLVSVELWWNLELEHKIVSLEWLTQFHQKAEKGEPTVLFSYPHALVCQALWSLQQRGDKQT

SEQ ID NO: 1542 - protein, 371 aa, Glycine max; identical to SEQ ID NO: 693

SEQ ID NO: 1543 - protein, 477 aa, Glycine max
VEATPVKRLCKTHNSITVNGQYPGPTLEINNGDTLVVKVTNKARYNVTIHWHGVRQMRTGWADGPEFVTQCPIRPGGSYTYRFTVQGQEGTLWWHAHSSWLRATVYGALIIRPREGEPYPFPKPKHETPILLDTTIVPIHAGETNLLRVINAALNQPLFFTVANHKLTVVGADASYLKPFTTKVLMLGPGQTTDVLITGDQPPSRYYMAARAYQSAQNAAFDNTTTTAILEYKSPNHHNKHSHHHAKGVKNKTKPIMPPLPAYNDTNAVTAFSKSFRSPRKVEVPTEIDQSLFFTVGLGIKKCPKNFGPKRCQAHHLGIPGVFTTDFPGKPPVKFDYTGNVSRSLWQPVPGTKAHKLKFGSRVQIVLQDTSIVTPENHPIHLHGYDFYIVAEGFGNFDPKKDTAKFNLVDPPLRNTVAVPVNGWAVIRFVADNPGAWLLHCHLDVHIGWGLATVLLVENGVGKLQSIEPPPVDLPLC

SEQ ID NO: 1544 - protein, 81 aa, Glycine max
MIFSEILTVILSFFFLISFQMSDDSPIVCDHNKALDLGRGANPKGYMVEEIWQELAKAKYLEWERSSSKRSWELQSLKYVF

SEQ ID NO: 1545 - protein, 135 aa, Glycine max
MQIWWFQVDGEVEFPFPAGKYSVFFRIHLGRAGKRFGRRVCNTEHVHGWDKKPVRFQLWTSDGQYVASQCFLNGPGKWIFYHAGDFVVEDGNASTKVKFSMSQIVCTHTKGGLCLDSVLVYPSEFRKVKAFLNYS

SEQ ID NO: 1546 - protein, 61 aa, Glycine max
CIGSAFNIKGAMQCPNCRKIEKGQWLYANGCRSYPEFSMDEWTHDEDLYDLSYSEMVIVLL

SEQ ID NO: 1547 - protein, 92 aa, Glycine max
  unsure (1)..(92): unsure at all Xaa locations
LQVHSSLNGKNFKSRMNAEHIDLLHSPWLIELGXXXLNSSGLDNCELDGVYGFFSCDLRITKAVMTLVLPDSINLEYDLTCAICLSRVLAQG

SEQ ID NO: 1548 - protein, 114 aa, Glycine max
IAEEQKDPILIPTKKNILDSLNWLVKDCQSEDSLVFYFSGHGLQQPEDRKGDEIDGLDETICPVDFLREGMITDNEINSIIVQPLKQGVTLHAIIDACHSGTTLDLLYLCKKEK

SEQ ID NO: 1549 - protein, 149 aa, Glycine max
IPHGAKLHALIDACHSGTVLDLPFLCRMNRSGQYVWEDHRPRSGVWKGSSGGDIICFSGCDDHQTSADTSALSKITSTGAMTFCFIQAIEGGHGATYGSILTAMRTAIRNVGSGGGGSAIGGGDVVTSLLSMLLTGGSLSGVGGLRQVI

SEQ ID NO: 1550 - protein, 101 aa, Glycine max
MISVDSAALINHGLHPMNSHHLFGTRYDHIHIVLCPLSFIPRLVVTLDTSVIALTGIPVMLVLLLYTSSMPERNYCCDFTGTRIDLSKHGHLTYHAPDDQY

SEQ ID NO: 1551 - protein, 179 aa, Glycine max
MTSSLVKIQGEQVLTNDFQDLSIKDLGEKGSEAEIHEVGYGGHGGICAICLDKIVLQETALVKGCEHAYCVTCILHWATYREKVTCPQCKHPFEFLNVHRSLDGSIQDYMFEESVCLLLRASWFTPLSVEEHVAHEDVYEDLEDYYQYEDDDDMDEAYYGGSSNLRVIGNRRWGDNGYV

SEQ ID NO: 1552 - protein, 386 aa, Glycine max
  unsure (1)..(386): unsure at all Xaa locations
MEHKLATTEGQPIRCKAAVXRKAGEPLGIEEIMVAPPMPGEARIRIICSSLCRTDISFRNMQGPPANFPTILGHEAIGVVESVGEDVTEVAKGDMVVPIFIAECGECIDCKSSKSNLCSKFPFKVSPWMPRHATSRFADLKGEIIHHFLSVSSFSEYTVVDIAHLIKIDPXVPPNRACLLSCGVSTGVGAAWRTAGVEPGSTVAIFGLGSIGLAVAEGARLCGATRIIGVDVNPERYEIGKKFGITEFVHSGECENKSASQVIIEMTDGGADYCFECVGNASLMHEAYASCRKGWXNTIVLGEDKPGSKLSLCCFEILVNGKSLVGCMFGGLKPKSHVPILIKRYLDKELNLDGFVTHEVEFKDINKAFDLMIKGQCLRCVIWMDK

SEQ ID NO: 1553 - protein, 166 aa, Glycine max
MSDKLSYKVADISLADWGRKAIEIAENEMPGLMKMREMYSESKPLKGARIAGCLHMTLQTAVLIETLTAIGAEVQWSSCNIFSTQDHAAAAIAKTGVPVYAWKGETDEEYIWCIEQTIYFKDGKPLNMILDDGGDLTNLVHTKYPQLLKGIKGIFEETTTGVHNLY

SEQ ID NO: 1554 - protein, 178 aa, Glycine max
VQTKRVTKICSSKDIVTINGMFPGPVVYAQEDDRIIVKVTNMTPFNVTIHWHGVRQRLSCWYDGPSLITQCPIQAGQSFTYNFTVVQQKGTFFWHAHVSWLRGTVYGAMIVYPKTGVPYPFKFPFQEHIIILAGEYWLQDLQQVENATIASGGPPPVADAYTITDHPGPNYNCSTNGI

SEQ ID NO: 1555 - protein, 66 aa, Glycine max
  unsure (1)..(66): unsure at all Xaa locations
AESLFNAFATAAXXKFVVFSIFEMRYLLAIWKANRPLSNGEGWETMRRELSVLYSRFCNILAMNLM

SEQ ID NO: 1556 - protein, 71 aa, Glycine max
GSPGYCMYGSSCTFVLSTENGVNGFTLDPSLGEFILTHPNIKIPSKGKIYFVNEGNARNWDEPTVSMGDSL

SEQ ID NO: 1557 - protein, 126 aa, Glycine max
  unsure (1)..(126): unsure at all Xaa locations
MLHPFLLLSGGRTNIQFMAAAKLQALWNHPAGPKTIHFWAPTFKWGISIANIADFSKPPEKLSYXQQIAVTATGIIWSRYSTVITPKNWNLFSVNIAMAGTGIYQLSRKLRHDYSSEAEVKAVTKE

SEQ ID NO: 1558 - protein, 211 aa, Glycine max
FGSRFYIHCDGALFGLMMPFVKLAPKVTFKKPIGSVSVSGHKFVGCPMPCGVQITRLEYVNALARDVEYLASRDATIMGSRNGHAPIFLWYTLNRKGYRGFQKEVQKCLRNAHYFKGRLVEAGIGAMLNELSSTVVFERPHDEEFIRKWQLACKGNIAHVVVMPNITIEKLDDFLNELLDKRATWFQDGKDQPYCISSDVGEKNCLCALHK

SEQ ID NO: 1559 - protein, 66 aa, Glycine max
  unsure (1)..(66): unsure at all Xaa locations
MAGSAPTPREEFVYMAKLAEQAERYEEMVEFMEKXTPTPRAXELTVEERILLCVNYLNAFRARSAF

SEQ ID NO: 1560 - protein, 240 aa, Glycine max
MYGQSSYESDLALLDSIRRHLLGDSEEHKFGAPNVSSGNTPAYSRSSCFSRLYPCLSNDWGELPLKEDDSEDMLLYGVLRDAINAGWVPSLDASSPESFSSGFIPAVTVKSEPDLFPAPEPVYIPPAAQKAEPAVVPAKGKHYRGVRQRPWGKFAAEIRDPAKNGARVWLGTFETAEDAALAYDRAAYRMRGSRALLNFPLRINSGEPRPVRVTAKRASAEPCSSSESGSWVKKRKKVVG

SEQ ID NO: 1561 - protein, 198 aa, Glycine max
  unsure (1)..(198): unsure at all Xaa locations
MLSSGRNHSNGYQQGQGVGYSHRERVRRGTRRSRASTSSVRVYDQHQPQHRPPWTDFDVDYYHSYAHLGIHQEMIKDRVRTETYRDAIMQHQSSIAGKANEVVKANNLXDVVVVLHGRVEDVEIDEEVDVIISEWMSYMLLYESMLGSVINARDRWLKLGGLILPSSATEYMAPVTHTGRYSDSVDFWRNVYGIDSRS

SEQ ID NO: 1562 - protein, 248 aa, Glycine max
  unsure (1)..(248): unsure at all Xaa locations
MLIAEXAFAVFLVSIVSITAVLYVRYKLRNCQCSGPKVKKLKGSSINQKDQKCKIRPDLEDFKIRRAQMFPYEELERATSGFKEESIVGKGXXXCVFKGVLKDGTVVAVKRAIVSPNMQKNSKEFHTELDLLSRLNHAHLLNLLGYCEEGGERLLVYEYMAHGSLHQHLHGNKVMQEQMDWVRRVTIAVQAARGIEYLHGYACPPVIHRDIKSSNILIDEEHNARVADFGLSLLGPADSSSPLAELPG

SEQ ID NO: 1563 - protein, 221 aa, Glycine max
  unsure (1)..(221): unsure at all Xaa locations
LPVLIAEIAFAVFLVSIVSITVVLYVRYKLRDCQCSGPKVKKLKGSSSNQKDQKCKIRPDLEEFKIRRAQMFSYEELERATSGFKEEAIVSPNMQKNSKEFHTELDLLSRLNHAHLLNLLGYCEEGGERLLVYEFMAHGSLHQHLHATNQVLREQLDWIRRVTIAVQAARGIEYLHGYACPPVIHRDIKSSNILIDEEHNARVAGYGLSLLGPXDSGSSLD

SEQ ID NO: 1564 - protein, 279 aa, Glycine max
  unsure (1)..(279): unsure at all Xaa locations
PDACPLLLFLFNAASGKRSERFWSMQLPVLIAEIAFAVFLVSIVSITVVLYVRYKLRDCQCSGPKVKKLKGSSSNQKDQKCKIRPDLEEFKIRRAQMFSYEELERATSGFKEESIAGKXXXXXXXXXXXXXXTVVAVKRAIVSPNMQKNSKEFHTELDLLSRLNHAHLLNLLGYCEEGGERLLVYEFMAHGSLHQHLHATNQVLREQLDWIRRVTIAVQAARGIEYLHGYACPPVIHRDIKSSNILIDEEHNARVAGYGLSLLGPXDSGSSLDESPGVP

SEQ ID NO: 1565 - protein, 207 aa, Glycine max
LGAFFLKDLKGRFRVFAVFGEEEKKNAWAALFDVEDPRSKFPQNKGKVLDIYQALEVARHDIQYLDWRARQDVLTIMHLHEKVVEVLNPLAREYKSIGTLKKELAGLQDELAQAHRQVHISEARVTTALDKLAYMEELVNDRLLQDRSTAEVAQTSSSPSTSANSLVIEKRRQPRKSLNVSGPVQSYHPHLKNFWYPVAFSNDLKDD

SEQ ID NO: 1566 - protein, 200 aa, Glycine max
  unsure (1)..(200): unsure at all Xaa locations
MALSATFVKTNRSILPFHQNSSPNHGRIKQLCVRASASSLDDDEDRTVVRKEKDGWKIKFSSQKPATPLLDTINYPAHMKNLSLQDLEQLAAELRADVVHSVSNTGGHLSSSLGVVELTVALHHVFNTPEDKIIWDVGHQAYPHKILTGRRSRMHTIRKTSGLAGFPKREESVYDXFGTGHSSTSISAGLGMAVARDLLG

SEQ ID NO: 1567 - protein, 367 aa, Glycine max
  unsure (1)..(367): unsure at all Xaa locations
MSTAGQVIKCRAAVAWEAGKPLSIETIEVAPPQKGEVRLKILFNSLCRTDVYWWDAKGQTPLFPRILGHEASGIVESVGKGVTHLKPGDHALPIFTGECGECTYCKSEESNLCELLRINTDRGVMLSDGKTRFSKNGQPIYHFVGTSTFSEYTVLHEGCVAKINPAAPLDKGAVGRCGFCTRSGATVNVAKPKPNNTVAVFGLGAVGLAACEGARVSGASRIIGVDLLTNRFEQAKQFGVTDFVNPKDHNKPVQEVIAEMTNGGVDRAIECTGSIQASISAFECTHDGWGTAVLVSVPKKDAEFKTHPMKVMEXGRTLKGTFYGHYRXPRTDIXGGCWRSTFNQGAGWDKIYHLLLVPFFRSTTCNL

SEQ ID NO: 1568 - protein, 112 aa, Glycine max
MEGDTFNGAQIDAKIMQTFKKNFVQVQDIFDQNRLLINEINQNHESKVPDNLTRNVGLIRELNNNIRRVYDLYVDLSSSFTKSMEVTSEGDSSGGAVKSSDGKAGHIGHRPV

SEQ ID NO: 1569 - protein, 397 aa, Glycine max
MACPAMANGNDSLNLKPSETKGKTITCKAAVAYGPGEPFVVENILVHPPQKMEVRIKILYTSICHTDLSAWRGVSEAQRAYPRILGHEASGIVESVGEGVSEVKEGDIVVPIFNGECGECTLCKCEKTNKCEIYGVNPMKKVMEGDGTSRFSTVHGKPIFHFLNTSTFSEYTVVDSACVVKFVSTDHSLSIKNLTLLSCGVSTGVGAAWNTANVHSGSTVAVFGLGAVGLAVAEGARARGASKIIGVDINPDKFIKAMGVTNFINPKDEEKPVYERIREMTDGGVHYSFECTGNVDVLRDAFLSAHEGWGLTVVLGIHASPTLLPIHPMELFDGRNIVGSVFGGFKGRSHLPHFAKQCGQGVVKLDNFITHELPLEEIDKAFDLLITGKSLRCLLHF

SEQ ID NO: 1570 - protein, 227 aa, Glycine max
MARGKIQIKRIENNTNRQVTYSKRRNGLFKKANELTVLCDAKVSIIMFSSTGKLHQYISPSTSTKQFFDQYQMTLGVDLWNSHYENMQENLKKLKEVNRNLRKEIRQRMGDCLNELGMEDLKLLEEEMDKAAKVVRERKYKVITNQIDTQRKKFNNEKEVHNRLLHDLDAKAEDPRFALIDNGGEYESVIGFSNLGPRMFALSIQPSHPSAHSGGAGSDLTTYPLLF

SEQ ID NO: 1571 - protein, 294 aa, Glycine max
QFHPAIEDLLFSKVDNIEHIGYLADRRKPIIFSMARLDVVKNLTGLVEWYGKNKRLRNLVNLVIVGGFFDPSKSKDREEMAEIKNMHDLIDKYQLKGQFRWIAAQTNRYRNGELYRCIADTRGAFVQPALYEAFGLTVIEAMNCGLPTFATNQGGPAEIIVDGVSGFHIDPLNGDESSNKIADFFEKCKMNQSQWNVISAAGLQRINECYTWKIYANKMVNMGNIYTFWRQVNKEQKEAKQRYIQMFYNLIFKNLVKTVPVPSDEPQQPVGKQPSLKSRSTGRSHSRLQRLFGN

SEQ ID NO: 1572 - protein, 198 aa, Glycine max
MGKKKLEIKRIENKSNRQITFSKRRKGLMKKARELSILCDAKLALLIFSSTGKLYELCNGDSLAEVVQRYWDNLGASGTDTKGLRFEIADIWSDEAFSQLVQSHFGVSELEHLSVTDLMELEKLVHSALSRIRSAKMRLMMESGENLKKKEHILRNEGEVWGKRMEGQKRGGGGNNVVTRFIDYDQTDRVTHNLLPGL

SEQ ID NO: 1573 - protein, 210 aa, Glycine max
PLAFALAARDFQVGLLDVDICGPSIPKMLGLEGQEIHQSNLGWSPVYVESNLGVMSVGFMLPNPDEAVIWRGPRKNGLIKQFLKDVYWGELDFLIVDAPPGTSDEHISLVQCLDATGIDGAIIVTTPQQISLIDVRKEVNFCKKVGVKVLGVVENMSGLSPEMLNLLACTEVFDSSGGGAVKMCNDMGVTFLGKVPLDPQLVRQGYRGGY

SEQ ID NO: 1574 - protein, 355 aa, Glycine max
MENADIPENANEHCPGPQSESAGKSDACEGCPNQQICATAPKGPDPDLVAIAERMATVKHKILVLSGKGGVGKSTFSAQLAFALAARDFQVGLLDVDICGPSIPKMLGLEGQEIHQSNLGWSPVYVESNLGVMSVGFMLPNPDEAVIWRGPRKNGLIKQFLKDVYWGELDFLIVDAPPGTSDEHISLVQCLDATGIDGAIIVTTPQQISLIDVRKEVNFCKKVGVKVLGVVENMSGLCLPITDFKFMKLTDNGEQKDVTQWVWEYMREKAPEMLNLLACTEVFDSSGGGAVKMCNDMGVTFLGKVPLDPQLCKAAEEGSSCFAKKDCVVSAPALKKIIEQLIETNGWSMLLSNGV

SEQ ID NO: 1575 - protein, 511 aa, Glycine max
MEAPSLTKPNDPTKPSNTSSTLSLEGGPGEASPLRKMFAVASIAAGIQFGWALQLSLLTPYVQLLGVPHAAASFIWLCGPISGLVVQPIVGYYSDHCTSRFGRRRPFILGGALAVAIAVFLIGYAADIGHSAGDDITKKTRPRAVGVFVIGFWILDVANNMLQGPCRAFLADLAAGDQQKTRIANGFFSFFMAVGNVLGYAAGSYSGLHKIFPFTETKACDVFCANLKSCFFFSILLLLFLATVALLYVKDKQVEAIPLDDATQPSCFFQLFGALKELKRPMWMLMLVTAVNWVGWFPYFLFDTDWMGREVYGGTAGEDAYAKGVRVGSLGLMVNAVVLGFMSLAVEPLGKMVGGVKRLWAIVNFILAIGFGMTVVITKVAEHQRRMNPAAVGHPSEGVVVGSMVFFGVLGVPLAITFSVPFALASIYCSASGAGQGLSLGVLNLAIVVPQMVVSALSGPWDSLFGGGNLPAFMVGAAAAALSAIMAIVLLPTPKPADEAKASSMMAGGFH

SEQ ID NO: 1576 - protein, 96 aa, Glycine max
  unsure (1)..(96): unsure at all Xaa locations
VPCSTAEKEAVADAAAWVFNDAASVGIIIANMAGMATXGFSGGTTLTGMHLGSPTLVTGVLRMLXVGQSAYLPESEVCEGEGIANCAIGGMNGRSM

SEQ ID NO: 1577 - protein, 342 aa, Glycine max
  unsure (1)..(342): unsure at all Xaa locations
SFFHMSSTFSNLIISTLMQNPAAHAAASFSLCIGPKCSSETCCSMGCWVXAATFWPYANPETSANSPRXPQGICFTNRQIGSPPCVAAIAAATVAAATAWWAAHGLLPLCAPLHTSFACPASVTTLQNPPLQDQMLDPXYSEAQQAQHSASKSPAAILSDSESGDAKLNTSSKVTDHETNKTISEHLDSNKTKGRKPVDRSSCGSNTASSSDVETDALEKGEKGKEEPEIPDANQLAIEFSNRRRSVSNLTDSWKEVSEEGRLAFQALFSREVLPQSFSPPHALKXTDHQMDNANDNQANIDDXXEDLDGKKCSSNYEAMQKNLLFVENTXGLFTIGLGQGS

SEQ ID NO: 1578 - protein, 183 aa, Glycine max
MGFIKIVKNKAYFKRYQVQFRRRRECKTDYYARKRLIIQDKNKYKTPKYRLVVRVTNRDIITQIVAADINHDVVLASAYAHELPRYGIKLGLTNYAAAYATGLLLARRVNDKFKLKYEGNTEVNGEDYNVEADEEGAKPFKALLDVGLARTTSGARVFGALKGATDGGLDVPHNDHRFPGSKR

SEQ ID NO: 1579 - protein, 104 aa, Glycine max
  unsure (1)..(104): unsure at all Xaa locations
EDQDTNYCKKLFKNMTCYVSREVPRESKLYAIPAFGGIIFWEGERAPFGESDQSISYQIVDREAQGHPFLSXNXVQPQWAYECVNARYFLPTDHYELGRXXPPH

SEQ ID NO: 1580 - protein, 319 aa, Glycine max
MDAVLQTRGLLSLPTNPINRISLLHPSHGLRHRLFSPKPKNLSGSSLSSNGFPKLSPKANVFAQRDKNKNFFLCRAEAAAAAAASFGEPGSEKPKLLGIEVATLKKIVPLGLMFFCILFNYTILRDTKDVLVVTARGSSAEIIPFLKTWVNLPMAIGFMLLYTKLANVLSKQALFYSIILPFIAFFGAFGFVLYPLSNYIHPEAFADKLLNILGPRFLGPLAIMRIWSFCLFYVMAELWGSVVISVLFWGFANQITTVDEAKRFYPLFVLGANVALVFSGRTVKYFSNLRSTLSPGVDGWAISLKAMMSIVVGMGVAIC

SEQ ID NO: 1581 - protein, 319 aa, Glycine max
HCCFFLHHTKSLPTVNIQRDLFYGYDTLMENVSDPSHIEFAHHKVTGRRDRAKPLPFKMDSRGSWGFSGANEGNPQISAKFVAPCYMMNKIQIDTKLPVVGDQKWVVWICSFNVPMAPGKTRSIVCSARNFFQFSVPGPAWWQVVPRWYEHWTSNKVYDGDMIVLQGQEKIFLSETKEGGDINKQYTNITFTPTQADRFVLAFRNWLRRHGNGQPEWFGNSSDQPLPSTVLSKRQMLDRFEQHTLKCSSCKAAYEGFQTWQKVLIGTTVVFCATSGIPSDVQLRVLLAGLAIVSAAITFALNQLQKNFEFVDYVHAEID

SEQ ID NO: 1582 - protein, 171 aa, Glycine max
MGFPVGYPELLVPKMFLHALSFLAWLRSLVFALFRLLRISDLLDTEPSPSDLPPPAPPREPTLSALLIREFLPVAAFRDLASASGVDPPQSGCAVCLSEFSEEEEIRCMANCKHIFHCACVDRWIDHDQKTCPLCRSTLVPHQKLEEYNQRLWAASGVSQFYYQDDYTASL

SEQ ID NO: 1583 - protein, 192 aa, Glycine max
  unsure (1)..(192): unsure at all Xaa locations
MLLYKYLSTTLYRTWNTIYYIFLHGEEHKLNLLLSSFASHFTLNVSAKSRGIFHSTTISLQKRPFCFFSDNMGLVCSRGRRFREADAEENAQDAEIERRIKLETKAEKHIQKLLLLGAGXSGKSTIFKQIKLLFQTGFDEAELKSYIPVIHANVYQAIKVLHDGSKELAXNDVDSSKCVISHENQNIGEKLS

SEQ ID NO: 1584 - protein, 151 aa, Glycine max
NNKGTPLEIGKGTSVRQGSTVAILGYGSVVQQCLQAAQMLKPLDLSVTVADARFCKPLDLYLIKLLGKELEFLLTVEEGSIGGFGSHVSHFLSIVGLLDGPLKWRPMMLPDRYIEHGSPQDQTEEAGLSSKNIAATVLSLLERPKEALLFK

SEQ ID NO: 1585 - protein, 336 aa, Glycine max
MDPPIHHPLGKRPAAEDDSVISDCESGVSGGDTAAGFVPADENADLVRTRFVRGLAAHGLKPEVLAVGRNACSSVMAQARQHSFHVFARAVAKLRDGNANVKFAWYGASSKEEISDIVQNGFFGHAHGNGLRLFPQDSPLESVKSSVVDKDGLRHLLLCRVILGKTELVPRDSNQCRSSSEEFDSGVDDLSNPKEYVIWCNQINTHVLPEYVLSFRFPSPLKGHVKIGEPLRPSSPWMAFPALISVLSKILPPPDIAYIAKFHKDYREKRISRHELIQKVRVIAGDKLLFSVIKSFRAKKIPASFKENKGNEWQAESQQLERYDCSYGSSINYYRK

SEQ ID NO: 1586 - protein, 233 aa, Glycine max
  unsure (1)..(233): unsure at all Xaa locations
MKFGSAFREYLQEEREWLVDQKCAHVEYIRLKKVLKTCQKDTSSSDNKDQLCHCQSCPLCDQQFFSELMKEASDVVGYFSSRVKNLLHLHIATGMQRYVLRLRQCFKDDRQALTQEGRILIEYIAMNAIAXRKILKKYDKVRSSLNGENLKSRMHAEHIEILHSPWLIELGAFYLNSSGLDSCDLDGVYGRFSCELNITKAVMTLVLPDSINLEHDLTCAICLDFVFNPYALS

SEQ ID NO: 1587 - protein, 225 aa, Glycine max
  unsure (1)..(225): unsure at all Xaa locations
MVRGKTQMKRIENETSRQVTFSKRRNGLLKKAFELSVLCDAEVALIIFSTRGRLYEFSSSXSINKTVERYQRKIEDLGVSNKGIHENTQHLKEVDMSMAKKIEHLEDSRRKLLGDELDKCSIDELQQLENQLERSLDKIRATKNQLFRKRIEKLKEEEKCLLEVNKRLREQYRIERQRCLSDQDVEFATKKEGEEVETELFIGRPERRMPLKLKPTTYSAHAYIA

SEQ ID NO: 1588 - protein, 543 aa, Glycine max
ARGSVVSKLQTLSTSDHASVVSMNLFVALLCGCIVLGHLLEENRWMNESITALLIGVCTGVVILLFSGGKSSHILVFSEDLFFIYLLPPIIFNAGFQVKKKQFFVNFMTIMLFGAIGTLISCTIITLGATQIFKRLDVGPLELGDFLAIGAIFAATDSVCTLQVLNQDETPLLYSLVFGEGVVNDATSVVLFNAIQSFDLNQIDSSIAVHFLGNFLYLFIASTMLGVLTGLLSAYIIKKLYIGRHSTDREVALMMLMAYLSYMLAELCYLSGILTVFFCGIVMSHYTWHNVTESSRITTKHSFATLSFVAEIFIFLYVGMDALDIEKWKFVSDSPGTSVATSGVLLGLILLGRAAFVFPLSFISNLAKKSPNEKISFRQQVIIWWAGLMRGAVSIALAYNQFTMSGHTSLRSNAIMITSTITVVLFSTVVFGLLTKPLIRLLLPHTPHHKESSITIITDPSTPSPKSVTIPLLGSAQESEVDIDGHDIHRPSSIRALLTTPTHTVHRLWRKFDDAFMRPVFGGRGFVPVEPGSPTERNGHQWR

SEQ ID NO: 1589 - protein, 94 aa, Glycine max
RGPKLRGGPPMIPLGLEGERLFAPPPLFGPWAPRFFPGVVPKGSPIIPIFVVFEKGGLKIPPPFFVAFGAGPEGPFFAPEMGYPGGGGPKEIGV

SEQ ID NO: 1590 - protein, 445 aa, Glycine max
MATIKAVKARQIFDSRGNPTVEVDVILSDGSFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENQEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPY

SEQ ID NO: 1591 - protein, 133 aa, Glycine max
YRGFNVSCVGIIVYRGLYFGMYDSLKPVLLVGTLQDSFLASFALGWMVTIGASIASYPLDTVRRRMMMTSGEAVKYKSSFNAFSQIVKNEGSKSLFKGAGANILRAVAGAGVLSGYDKLQVLVLGKKYGSGGA

SEQ ID NO: 1592 - protein, 351 aa, Glycine max
FRNSYPERGVLVLRCCEQRERWTDEEHKKFLEALKLYGRAWRRIEEHVGTKTAVQIRSHAQKFFSKILRESSGNSTTLEESIEIPPPRPKRKPIHPYPRKLVEFPKTGISNSEHPLRSNSLKSSDFGQENNSPKSVLSTVVSETVGSSDSDTSSRCLSPASSISGVPTNRFPLAEPKTSFKEEGSAPSSAHDEQPPVKLEFFHKESVSTRDDATEESSGRTLKLFGTTLLVTDTCKPSSPTTEPCKPTPAAAMYLMQLQNVCSDVTEGHASIVPWWTLPHNTPFMPLHKEPKGKHLYSNLGEFEHKEVQKEGSWTGSNTSSIDDGDNTEKSDDQAKSHVHGFSKSETFNYI

SEQ ID NO: 1593 - protein, 65 aa, Glycine max
  unsure (1)..(65): unsure at all Xaa locations
REENVYMAKLAEHAERYEEMVEFMENVSAAADNEELTVEEMNLLSCAYKNVIXARRASWLIISSI

SEQ ID NO: 1594 - protein, 275 aa, Glycine max
MVLLVAFQSTSDLEEELKRVSAENKKLAEMLSVVCENYNTLRSHLMEYMRKNGEKEVSPTSKKRKSESSNNNNSNLMGTNNGNSESSSTDEESCKKPREETIKAKISRVYVRTEASDTSLIVKDGYQWRKYGQKVTRDNPCPRAYFKCSFAPSCPVKKKVQRSVDDQSVLVATYEGEHNHPQFSSQMEATSGSGRSVTLGSVPCTASLSTSTPTLVTLDLTKSQGSNDSKSTKPKGDSPKVPQVLVEQMATSLTTDPNFRAALVAAISGRLLHNN

SEQ ID NO: 1595 - protein, 130 aa, Glycine max
  unsure (1)..(130): unsure at all Xaa locations
SAFAQRTDLMTITRFVLNXQSNHPESRGDFSILLSHIXVLGCKILCSVVNKAGLVKLIALAGETNVQGLFQKKLYVLCNDVFIKALVNRGRTCILVSEEYEEATFVEASMRGKYXVDLDPLNGSSNIDLR

SEQ ID NO: 1596 - protein, 338 aa, Glycine max
MDHSADAQRTDLMTITRFVLNEQSKHPESRGDFSILLSHIVLGCKFVCSAVNKAGLAKLIGLAGETNVQGEEQKKLDVLSNDVFIKALISSGRTCILVSEEDEEATFVEPSKRGKYCVVFDPLDGSSNIDCGVSIGTIFGIYLIKEDHEPTVEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 1597 - protein, 233 aa, Glycine max
LISMNAADFIITSTYQEIAGSKQKPGQYETHTAFTMPGLCRAVSGINVFDPKFNIAAPGADQSVYFPSTAKEQRLTSFHPAIEELLYSKDDNEEHIGLLEDMKKPIIFSMARLDKVKNLSGLVEWYARTKRLRSLVNLVVVGGFFNPAKSKDREETEEIKKMHFLMKEYNLKGQFRWIAAQTDRYRNSELYRCISDTKGAFVQPALYEAFGLTVIEAMNCGLPTFATNQGGPG

SEQ ID NO: 1598 - protein, 84 aa, Glycine max
NMGGGATQLIMPMVYELIRRAGATPFTAWRIAFFVPGWMHVVMGILVLTLGQDLPDGNLGALQKKGNVAKDKFSKVRLFLPYMF

SEQ ID NO: 1599 - protein, 67 aa, Glycine max
  unsure (1)..(67): unsure at all Xaa locations
MTQAFFVRLEIVLVEVVMPGLMSSXTEFGPSXLFKGARITGFLHMTIQTCVLIETLTALCAEVLWCS

SEQ ID NO: 1600 - protein, 142 aa, Glycine max
  unsure (1)..(142): unsure at all Xaa locations
VLLWDSFFLSSSLPLVSPLLYWLKKAXWDYYILLGLVDVEANFLVVKAYQYTSLTSVMLLDCWSIPCVMLFTWIFLKTKYGFKKVTGVVVCIAGLVLVVFSDVHAGDRAGGSNPSIGDILVIAGATLYAVSNVSEEFLVKML

SEQ ID NO: 1601 - protein, 222 aa, Glycine max
  unsure (1)..(222): unsure at all Xaa locations
KNILFAILGSFYSPGTSVATSGVLLGLILLGRAAFVFPLSFISNLAKKSPNEKISFRQQVIIWWAGLMRGAVSIALAYNQFTMSXHTSLRSNAIMITSTITVVLFSTVVFGLLTKPLIKLLLPHTPHHKESSITIITDPSTPSPKSVTVPLLGSAQESEVDIDGHDIHRPSSIRALLSTPTHTVHRLWRKFDDAFMRPVFGGRGLVPIEPGSPTERNGHQWR

SEQ ID NO: 1602 - protein, 99 aa, Glycine max
  unsure (1)..(99): unsure at all Xaa locations
AEQEQNANLIPTKHNILESLNWLVKDCQAGDSLLFYFSGHGLQQPDFKEDEIDGFDETLCPVXXXREGMIIDNEINSTIVWPLKEGVTLHAIVDACHSG

SEQ ID NO: 1603 - protein, 136 aa, Glycine max
MAGKGGKGLLAAKTTAANKDKDKDKKRPISRSSRAGIQFPVGRIHRQLKQRVQANGRVGATAAVYLASILEYLTAEVLELAGNASKDLKVKRITPRHLQLAIRGDEELDTLIKGTIAGGGVIPHIHKSLINKTAKD

SEQ ID NO: 1604 - protein, 248 aa, Glycine max
MGRGRVELKRIENKINRQVTFAKRRNGLLKKAYELSVLCDAEVALIIFSTRGKLYEFCSTNSMLKTLERYQKCSYGAVEVSKPGKELESSYREYLKLKARFESLQRTQRNLLGEDLGPLNTKDLEQLERQLDSSLKQVRSTKTQFMLDQLADLQNKEHMLVEANRSLTMKLEEINSRNQYRQTWEAGEQSMPYGTQNAHSQGFFQPLECTPTLQIGSDYRYIPEASEQQLAATTQAQQVNGFIPGWML

SEQ ID NO: 1605 - protein, 122 aa, Glycine max
MEKERGEEEVKYRGVRKRPWGKFGAEIRDPTKPTGRQWLGTFDTAEEAARAYDRAAIALRGALAILNFPHEFHFHLPFILSNSSTKGNGSSFDKEVIELEYLDDKVLEELLELEEKRRNNED

SEQ ID NO: 1606 - protein, 246 aa, Glycine max
  unsure (1)..(246): unsure at all Xaa locations
TTVKHLLLAKYETLSIHDNAGGCSKAGDSEENSQSGNFFLEKDLEAALDSFDNLXCRRCLVFXCRLHGCSQDLVFPAEKQPTWNPPDTENAPCGPNCFRSVLKSERFAKTSSAQADEEKSSGGALSRKKSSAKRRIKCSQSESASSNAKNISESSDSENGPGRDAVSASRSAPPKTKPVGKGGIGKRNSKRVAERVLVCMQKRQKKTMVSDSDSISEALDRSSNDMVTDPHAMSSEDNMRKEFDDN

SEQ ID NO: 1607 - protein, 141 aa, Glycine max
MGFPVGYTELVMPKVFLQVLSVLGFIRRLITILLCYMGFHDFFESDIAGPERAVSAVLMREILPVVKFSEMEMAVEAAESCAVCLYEFEGEDEIRRLTNCRHIFHRGCLDRWMGYDQRTCPLCRTPFIPHHMQAAFYYNHH

SEQ ID NO: 1608 - protein, 313 aa, Glycine max
  unsure (1)..(313): unsure at all Xaa locations
MSEIDMAVIKPEMMKPYIWLETSDGSIQQVEQEIAMFCPLICQEIIQKGMGSSKNCAICLPQRVSPATLSLILDYCHFHQVPGRSNKERKSYDEKFIRMDTKRLCELTSAADSLQLKPLVDLTSRALARIIEGKSPEEIREIFHLPDDLTEGEKACREVXPLKHTTDDPRIRLLNRLYAKKRKELKERERLKNVEVEEEHVDERSVDDLLSFINGNDGDPKEVKTSKNKKKNRRKKEQQQKNSSLKEASEVNKEVNGQSIRHQSAEADRIAETSNSHTEDVFAHREFDDGDIDDGIDPALKEKIDSIVAVADH

SEQ ID NO: 1609 - protein, 388 aa, Glycine max
PWNTKVATTTEGQSIRCKAAICRKAGEPLCIEEIIVAPPMPGEARIRIICSSLCQTDISFRNMQDHPAIYPTILGHEAIGVVESVGEDVTEVAKGDMVVPIFIAECGECIDCKSSKSNLCSKFPFKLSPWMPRHATSRFVDLKGEIIHHFLSVSSFSEYTVVDIAHLTKIDPEVPPSKACLLSCGVSTGVGAAWRTAGVEPGSTVAIFGLGSIGLAVAEGARLCGATRIIGVDINSEKYEIGKKFGITDFVHSGECENKSASQVIIEMTDGGADYCFECVGNASLMHEAYASCRKGWGKTIVLGSDKPGSKLSLSCSEILVSGKSLVGCMFGGLKPKSHVPILIKRYLDKELNLDGFVTHEVEFKDINKAFDLMIKGQCLRCVIWMDK

SEQ ID NO: 1610 - protein, 103 aa, Glycine max
ADSSREENVFMAKLAEHADRYEEMVEFMEKVAKTVEVEELTVEDRNLLYAAYKNAIAARRALPTTTSSIDRKEETPCAEDHLAMVEEPSGTLAAYIPAICRVR

SEQ ID NO: 1611 - protein, 105 aa, Glycine max
NMGGGATQLIMPLVYELIRRAGATPFTAWRIAFFIPGWMPVVMGIMVLTLGLDLPDGNLGALQKKGNVAKDKFSKVRLFLLYMFEDTINIYVELLEMYLACENVF

SEQ ID NO: 1612 - protein, 152 aa, Glycine max
MSPGLNRRDLFRGAALAGGGLALSAWLPAWAQPISSGIAKPLPTVSGNDITLKIAHQMMMIDGRQSHAIGINGTVPAPLIRLRQGQNVRLSVINDLEEDSSIHWHGLLLPFQFDGVPGISFPGIKPKSTFVYEFPIVQAGTYWYHSHSGRAG

SEQ ID NO: 1613 - protein, 335 aa, Glycine max
MENSTQESHLRSENSVSYESPYPIYGMSFSPSHPHRLALGSFIEEYTNRVDILSFHPDTLSLTPNPSLSFDHPYPPTKLMFHPRKPPSSSSDLLATSGDYLRLWEVRDNSVEAVSLFNNSKTSEFCAPLTSFDWNDIDPNRIATSSIDTTCTIWDIERTLVETQLIAHDKEVYDIAWGEARVFASVSADGSVRIFDLRDKEHSTIIYESPHPDTPLLRLAWNKQDLRYMATILMDSNKVVILDIRSPTTPVAELERHRGSVNAIAWAPHSSTHICSAGDDTQALIWDLPTLASPTGIDPVCMYSAGCEINQLQWSAVQPEWIAIAFANKMQLLKV

SEQ ID NO: 1614 - protein, 98 aa, Glycine max
  unsure (1)..(98): unsure at all Xaa locations
ASATTPREEFVYMANLAEQAERYDEMVEFMEKVSGNAENXELTVEEHNQLCVTYKNRIRTSRACWRIISXIEQNEESQGNEDHGPVIRSYRSQIKAEL

SEQ ID NO: 1615 - protein, 212 aa, Glycine max
  unsure (1)..(212): unsure at all Xaa locations
VAAPARVGLVAPIDVVVPPGNTGLDPSQTSFFQVLNIPTKINKGTVEIITPVELIMKGDKVGSSEAALLSKLAIRPFSYGLAVVSVYENGSVFSPEVLDLTEDDLVVKFAEGVCMVSSLSLAISYPSIAAAPHMFVNSYKNILAVAVATEYSFPEADKVKEYLKDPSKFAXAVVAAPATKSGAAPAAASKVEDKKEEAADESDDDMGFSLFD

SEQ ID NO: 1616 - protein, 212 aa, Glycine max
  unsure (1)..(212): unsure at all Xaa locations
GNVEITVFFYKTFRCYFACEXLDENLYAIGGFGSNSSDHSWETFDPLTKCWTSQTDXKIVXEIKHSVVLDGNIYVRCARFCANPRVFSVVYKPSSGTWQYADDDMVSGWTGPVVVVDGTLYVLDHSLGRTRLMISLKEGREWIPVGRLLPLHTRPPFQLVAVGKSIFVVGRVLSTVVVDVGDLGNEDQVIVGSAIPGLLFDVNVLSVKCLSI

SEQ ID NO: 1617 - protein, 86 aa, Glycine max
  unsure (1)..(86): unsure at all Xaa locations
ELTIEERILLSVPYNNVIRARRASWRIIFSIXHKEESRGHXDHLFLILYYRFKIYSYLCNICHRMLKLLHCFLIPSTSSGYFKVLY

SEQ ID NO: 1618 - protein, 105 aa, Glycine max
  unsure (1)..(105): unsure at all Xaa locations
MDLVPEKTTSGREYKVKDAXQADFGRLXSELGLVEMPGLMAXRTEFXLCQSFKGARITDSLHIIMHTAGVIETLTDLRSEIRWSYYNILFINNHFNCLICMIQRR

SEQ ID NO: 1619 - protein, 275 aa, Glycine max
MLEGLDEEGCVEEPGHHSEKKRRLSVDQVKALEKNFEVENKLEPDRKLKLAQELGLQPRQVAVWFQNRRARWKTKQLERDYGVLKANYESLKLNYDTLQQDHEALLKEIKELKSRLVQEENNNNTESDVSVKEEMLTTTLCETAIPGSDTKELSYECFNKSDEVGGGSSVFHVDFKDGSSDSDSSAILNEENNNHSPNNNAAISSCGVLQSHGLLLSPSSSSMNNCFQFQKQYQTTTTQYVKMEEHNFLSADEACNFFSDEQAPTLQWYCSEEWS

SEQ ID NO: 1620 - protein, 173 aa, Glycine max
  unsure (1)..(173): unsure at all Xaa locations
MGYICXXXGDQRSMVYCRSDAACLCLSCDRNVHSANALSKRHSRTLLCERCNSQPAFVRCVEEKISLCQNCDWLGHGTSTSSSTHKRQAINCYSGCPSAAELSSIWSFVLEIAAISESTCEQELGLMSINENKCADEVTDLPALNKSLVGASLMPESSSEPVFWTSLKSTAGS

SEQ ID NO: 1621 - protein, 415 aa, Glycine max
  unsure (1)..(415): unsure at all Xaa locations
MAIQSQNAFTRSRGGLPIGDGISLNSGVHPVADIPLHDQFSCGNDYALKVRKPYTITKQRERWTDEEHKKFLEALKLYGRAWRRIEDSSRVXRNSTTLEESIEIPPPRPKRKPIHPYPRKLVEIPKTEISNSELPLRSNSLKPSDFGQENNSPKSVLSTVVSETLGSSDSDTPTRCLSPTSSISDVPTNRFPLAEPKTSFEEEGSPPSSAHDKQPPVKLEFFHKESVSTKDDATEESSGRTLKLFGTTLLITDTCKPSSPTMEPWKPTPAAAMYLMQLQNGCSDITEGPASIVPWWSLPHNTPFMPLHKEPKGNHIYSNLGEFVHKEVQKEGSWTGSNTSSINDGDNIEKSDDQAKSHVHCFSKSEISSISELRVRPKTCGKGFVPCKRRMAERESKYSSICYEEREEQGIKLSL

SEQ ID NO: 1622 - protein, 208 aa, Glycine max
LNEGSILWLTESRKPLGLIDEIFGPVKNPYYVVRYNSESEVPTGIHEGTLISFVPEFADHVLNNKDLYRKGYDASGADDEELSDEMEFSDDEKEAEYKRMQKQTKRGANDQNHGKKKNNRKKFSPKEHAAPTIHAAPMLHHGNCPPFSGTGQGLMGGTTPLPPLNVAPTFATNGVWTNGTTFPHQQQSPMLPNGYPTNGMPWYPQNPI

SEQ ID NO: 1623 - protein, 62 aa, Glycine max
MAARAPIPREEFVYMANCPEQAERYEEMVEFMEKVSASAESEELPVEERNFFSVAKKNVLGA

SEQ ID NO: 1624 - protein, 86 aa, Glycine max
  unsure (1)..(86): unsure at all Xaa locations
DEERNYAGEKPATLLLDTINYPIHMKNLSTQDLEQLAAELRADIVHTVSNTGGHLSSSLGVVELAXALHHVFNTPEDKIIWDVGHX

SEQ ID NO: 1625 - protein, 443 aa, Glycine max
  unsure (1)..(443): unsure at all Xaa locations
MEEETSDAMNLDLNLGPGPEPETGPISNEAVNLDDWIGEPLQRISEAVRYRARQRWRWRQLPLPPPEFHAHFPTEATRHFQIPPEAHNISVELNHFLVNSGNGSALQAGEGSVAAEERMEEVPKACENINGVAEDEASQKKGDIEKGSGNDGXTFFDCNIXLDLARDPVVTCCGHLFCWSCLYRWLHLHSDAKECPVCKGEVTLKSVTPIYGRANNVRGPEEDSALKIPPRPQAKRVESLRQTIQRNAFALPVEEMIRRLGSRIELTRDLVQPPEPDAARETAERTTSLLRFLTAQGIRREHQNLVAPPEDVMGLAQNNVNTSEAGDPRTRVQSHLLRRTQSHRATLSTLSSALTSAERLVEAYFRSNPLGRNQEQPPPPVEDRDSFSSIGAVINSESQLDTAVEIDSMVSLSTSSSRRRNDASRVSDVDSGDSRAPRRRRLN

SEQ ID NO: 1626 - protein, 118 aa, Glycine max
  unsure (1)..(118): unsure at all Xaa locations
MDSGPPANDLCSVCHGNFHIPCQANCSHWFCXGSVGCSCKCPLCRRAISLLVPTEESLRQQQDPEVSQILSKIHAYNRFFGGQPTTLYQRLRDLSFLLHRLLKEFLQPKGSFLFLIRP

SEQ ID NO: 1627 - protein, 381 aa, Glycine max
  unsure (1)..(381): unsure at all Xaa locations
MSSTVGQTIKCKAAIAWEAGKPLVIEEVEVAPPQAGEVRLKILYTSLCHTDVYFWDAKGQTPLFPRIFGHEASGIVESVGEGVTHLKPGDHALPVFTGECGDCAHCKSEESNMCELLRINTXDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 1628 - protein, 413 aa, Glycine max
  unsure (1)..(413): unsure at all Xaa locations
SRSSFGADQFDDADEAEKEHKSSFFNWFYLSINXGALIAASVLVWVQTNVSWGWGFGIPAVAMAIAVVSFFSGTRLYRNQKPGGSPLTRMCQVIVASIRKSDVQVPNDKSGLYEIEEDSESAIEGSRKLDHTNGLRFLDKAAVLGDSDNVKDPVNPWRLCTVTQVEELKAIIRLLPIWATGIIFSTVYSQMGSYFILQGDTMNNRVGNIKLHISPATLSVFDTISVIFWVPVYDRIIVPVARKFTGRKNGITQLPRVGIGLFLSIFAMVYSVILESMRLKMVRRHNYYDREQVPMSLYLQIPPYFIIGCAEVFTFIGQLEFFYEQAPDAMRSTCSALQLLTVSFGSYLSSLLITIVTKVTTRNGGPGWLPDKLNYGHLDYFFLLLTVLSVLNFVAFLQVSKLYSYKNPVGTLH

SEQ ID NO: 1629 - protein, 177 aa, Glycine max
MAITTNPLVVGRVIGDVLEPFASSIPLRVVYNNNKEVINSGELKPSQIINPPRVEVGGDDLRTLYTLVMVDPDAPSPSDPNMREYLHWLVTNIPATTSASFGQEVVSYESPRPTSGIHRFIFVLFRQPRRMSIPAPGWRQNFITRDFAEYYNLGLPVAAVYFNCQRQGGSGGRRLML

SEQ ID NO: 1630 - protein, 426 aa, Glycine max
MGNEESTHDSHDDFFRQPRSHDGSSPNTSHQYHQPPSYDGSSANTSHQYHQPSSYAGSSVNTRHQYKQRPTYIADSFSSLDQVVSALREAGLESSNLIIGIDFTKSNEWTGKHSFNHKSLHFTGNTPNPYEQAISIIGRTLSSFDEDNLIPCFGFGDASTHDQNVFSFYPDECYCHGFEEVLARYREIVPYIKLSGPTSFAPVIDAAIDIVERNNGQYHVLVIIADGQVTRNPDVPYGKLSPQEQATINSIIAASHYPLSIILVGVGDGPWDEMKYFDDNITERLFDNFQFVNFTKIMSENTEASKKEATFALAALMEIPLQYRAAQNIQLNDRESVLHQHKRPLPPPNEVIHHDNARMAIPHMPNLESAESTAPAAAEPVCPICLTNPKDMAFGCGHTTCKECGSTLSSCPMCRHQITTRLRLYT

SEQ ID NO: 1631 - protein, 619 aa, Glycine max
FWGHIVMAYAFTFWTCYVLLKEYGRVATMRLGFLAAEKRRPDQFTVLVRNIPPDPDESVSELVEHFFLVNHPDHYLTHQVVYNANKLAKLVKKKKKLQNWLVYYQNKVERTSERPQIKTGFLLGLCGNKVDAIDHHNTEIDKLSKEIALERDNVSNDPKSIMPAAFVSFKTRWGAAVCAQTQQTRNPTMWLTEWAPEPRDIYWSNLAIPYVSLTVRRLIMAVAFFFLTFFFMIPIAIVQGLASIEGIRKRAPWLNPLIDIPFIKSFIQGFLPGIALKLFLIFLPTILMIMSKFEGFGSISSLERRSASRYYLFNFVNIFLGNILTGTAFEQLDSFIHQPANEYPITIGTAIPLKASFFITYIMVDGWAGIAAEVLMLKPLIVYHLKNFFLVKTEKDREEAMDPGSIGFNTGEPRIQLYFLLGLVYAAVTPAVLPFITVFFGLAYLVFRHQIINVYNQEYESGAAFWPDVHFRIVMALIVSQIVLMGLLTTKKAASSTPFLIVLPILTIWFHRYCKGRFESAFVKFPLQEAMMKDTLERATEPNLNLKGYLQNAYVHPVFKASLFDEDEDEEVMSLKLETESLTVPTKRQSRRNTPLPSRISGASSPSLPDHGIRNHPEP

SEQ ID NO: 1632 - protein, 173 aa, Glycine max
  unsure (1)..(173): unsure at all Xaa locations
MASSDVEYRCFVGGLAWATDDQALERAFSQYGEIVETKIINDRETGRSRGFGFVTFASEQSMKDAIEGMNGQNLDGRNITVNEAQSRGGGGGGGGGGXGGGYGGGRGGGYGGGGPGGGGGYNRSGGGGGYGGGGGYGGGGGGGYGGGRDRGYGGGGDRGYSRGGDGGDGGWRN

SEQ ID NO: 1633 - protein, 155 aa, Glycine max
MDVGQMQRQWIDYTKSLFLEGFLDGQFLQLQQLQDENNPDFVVEVVSLFFEDSERLLKDLTFALDQNGVDFKKVDAHVHQLKGSSSSIGAQRVKNACIAFRNFCEEQNTDACLRCLQQVKQEYCIVKNKLETMFRLEQQIVAAGGSIPTELSFIG

SEQ ID NO: 1634 - protein, 389 aa, Glycine max; identical to SEQ ID NO: 933

SEQ ID NO: 1635 - protein, 164 aa, Glycine max
IRHQLGTFETAEDAARAYDEAARLMCGTRARTNFPYNPNASQSSSSKLLSATLTAKLHRCYMASLQMTRPSSQAEPQRVASPNVITSSASNFSMKSNETETLLLPQKRQEEEQEAEGNWVFKKVKVENAQQFKPLEEDHIEQMIEELLHYGSIELCSVIPPQAL

SEQ ID NO: 1636 - protein, 171 aa, Glycine max
MAESDNESGGHTGNASGSNEFSGCREQDRFLPIANVSRIMKKALPANAKISKEAKETVQECVSEFISFITGEASDKCQKEKRKTINGDDLLWAMTTLGFEEYVEPLKVYLHKYRELEGEKTAMMGRPHERDEGYGHATPMMIMMGHQQQQHQGHVYGSGTTTGSAFFARTR

SEQ ID NO: 1637 - protein, 138 aa, Glycine max
  unsure (1)..(138): unsure at all Xaa locations
MTFCGGAFVKPNYSVSPCHKHKAPSPYQGGRNKFCVRVSASGSADEERTIIRKEKVGWKINYSGEKPATPLLDTVNHPIHMKNLSTQDLEQLAAELRADIVHSVSDTCGHLSSSLXVVELSVALHHCFNTLEDKYIWM

SEQ ID NO: 1638 - protein, 180 aa, Glycine max
EGNVEATGEDYSVEPAESRRPFRALLDVGLIRTTTGNRVFGALKGALDGGLDIPHSDKRFAGFDKEKKELDAEVHRKYVFGGHTTFFFLQILAEDEPEKYQSHFSEYIKRGIEADGIEALYKKVHAAIRADPSLKKSEKQPPKEHKRYNLKKLTYEERKAKLIARVAAINSAADNDEDDE

SEQ ID NO: 1639 - protein, 128 aa, Glycine max
MDPAHAKDTGDNGIYRFHLIYDIFAMREANEVVKANNLSDVVVVLHGRVEDVEIDEEVDVIISEWMSYMLLYESMLGSVINARDRWLKLGGLILPSSATLYMAPVTHTDRYSDSVDFWRNVYGIDSQS

SEQ ID NO: 1640 - protein, 156 aa, Glycine max
MVKSTYERFSKDFVMGGVAAIISRSAAAPIERVKLLLQNQGEMIKRGQLKKPYLGVSDGFKRVFMEEGLIAFWRGHQANLIRYFPTQAFNFAFKGYFKSIFGYSKERDGYIKWVAGNVASGSAAGATTSLLLYHLDYARTRLGTDAIECRVTGQRQ

SEQ ID NO: 1641 - protein, 441 aa, Glycine max
NAEQLIVGSHGCSSHRETASVTVVYASATVVSSDRRRLPTRRHRSHELHGSIPLLANRVAGPHWPPLPKRRLDRRYSRIADDYHSLDEVTTALSHAGLESSNLIVGIDFTKSNEWTGKRSFNRKSLHHIGSGQNPYEQAISIIGKTLSVFDEDNLIPCFGFGDASTHDQDVFSFHSDERFCHGFEEVLSRYRDIVPRLRLAGPTSFAPIIEMAMTIVEQSGGQYHVLLIIADGQVTRSVDTQHGQLSPQEEKTIDAIVKASEYPLSIVLVGVGDGPWDMMREFDDNIPARAFDNFQFVNFTEIMSESIDSSRKEREFALSALMEIPSQYKATIDLGILGARRGHSADRVPLPPPHYERASSSSTIPLPSNSFQQSTPTYYDNVNAESSSRNLYDSKVCPICLTNDKDMAFGCGHQTCCDCGENLECCPICRSTITTRIKLY

SEQ ID NO: 1642 - protein, 140 aa, Glycine max
MASHRQSYEAGQTKGRTEEKTNQTMGNIGEKAQAAKEKTQEMAQAAKEKTQQTAQAAKDKTCDTSQAAKEKAQQNTGAAQQKTSEMGQSTKESAQSGKDNTQGFLQQTGEKVKGAAQGATEAVKQTLGLGEHDQDNRRNY

SEQ ID NO: 1643 - protein, 540 aa, Glycine max
MGSTGLLHLICLVIALVSVSLVQAEDAYKYFTWTVTYGTLYPLASPQQVILINGQFPGPRLDLVTNENVILNLINKLDEPFLLTWNGIKQRKNSWQDGVLGTNCPIPPNSNYTYKFQAKDQIGTYTYFPSTQLHKAAGGFGALNVYHRSVIPIPYPNPDGDFTLLVGDWYKTNHKTLRQTLDSGKSLAFPDGLLINGQAHSTFTGNQGKTYMFRISNVGLSTSINFRIQGHTLKLVEVEGSHTVQNLYDSLDVHVGQSVAVLVTLNQPPKDCYIVASTRFTETPLTTTAVLHYANSFSSALGPVPAPPVDKYDFDWSMKQARTYRWNLTANAARPNPQGSFHYGKITPTKVIKLANSAPLINGKLRYAVNSVSYVNPDTPLKLADYFNIPGVFSVNLLQNSPSNGPGYIGTSVLQTSLHDFIEVIFQNNENTMQSWHLDGYDFWVIGHGFGQWTDASRKTYNLVDALTRHTAQVYPKSWTTILVSLDNQGMWNLRSAIWERQYLGQQFYLRVWNAQKSLANEYDIPNNVLLCGKAVGHHP

SEQ ID NO: 1644 - protein, 176 aa, Glycine max; identical to SEQ ID NO: 679

SEQ ID NO: 1645 - protein, 173 aa, Glycine max
MGEGERFQLGTVGALTLSVVSSVSIVICNKALMSSLHFIFATTLTSWHLLVTFCSLHVALKMRFFEHKPFEQKAVMGFGILNGISIGLLNLSLGFNSVGFYQMTKLAIIPCTVLLETIFLGKRFSKRIQFALSILLLGVGIATVTDLQLNALGSFLSFLAVITTCVAQIVSLK

SEQ ID NO: 1646 - protein, 220 aa, Glycine max
ARIIEGKTPEEIRDIFHLPDDLTEEEKLEPLRNITADPRIRLLNRLYAKKRKELKERERLKNVEVEEEHVDERSVDDLLSFINGNDGDPKGVKTSKNKKKNRRKKEQQKSSSLKEESELNKKEVNGHDIRHQSSEAERISETSYLPYADDDTFSPKVGFDDGDIDDEIDPALKEKIDREVEDFARRLNSDWPERMQELLSSGQERKTMLFTTDGFLRRQA

SEQ ID NO: 1647 - protein, 251 aa, Glycine max
MYGRSDSYESDLALLDSIRRHLLGESELIFGAPNFGSGRSSSFSSLDSCLSDDWGELPFKEDDSEDMVLYGVLRDAVNVGWVPSLDAGSPESVSSGFPAVKLEPDVMPALINPCPPPAPAVEEKKVVPPKGKHYRGVRQRPWGKFAAEIRDPAKNGARVWLGTFETAEDAALAYDRAAYRMRGSRALLNFPLRVNSGEPDPVRVTSKRSSSPESMAAAAPKRKKVMVVGTVQEQVGSQVVECTRGEQLLVS

SEQ ID NO: 1648 - protein, 147 aa, Glycine max
RVFGALKGALDGGLDIPHSDKRFAGFDKEKKELDAEVHRKYVFGGHLLDNLILYFLQILAEDEPEKYQSHFSEYIKRGIEADGIEALYKKVHAAIRADPTLKKSDKQLPKEHKRYNLKKLTYEERKAKLIARVASLNSAADNDEDDE

SEQ ID NO: 1649 - protein, 696 aa, Glycine max
MTVEKKMNDSGDEFPVGMRVLAVDDDPTCLLVLETLLRRCQYHATTTNQAIKALALLREHKDKFDLVISDVHMPDMDGFKLLELVGLEMDLPVIMLSANGDTKLVMKGISHGACDYLLKPVRMEELKNIWQHVIRRKKFDSKEKNKTRNIDKPTSNSSNGLGSSGTGNSDHNEKLTKKRKDQDEDEDEDQENDLDNEDPSAQKKPRVVWSVDLHRKFVAAVNQLGIDKAVPKKILDLMNVEKLTRENVASHLQKYRLYLKRISCVANQQANMVAALGVADPSYLRMSSVSGVGHVQTLSGSGQLHNNNFRSFPPSGIINRLNTPAGLNVHGFPSGVLQLSQSQNLNNANDHHKFQSAIVPANQNGVQGMTVSVGLDQLQNNKGVMSVQNLTTVFDAKTTFPISNKLPDPRPKITNSGSHTPDVSFSNNALMLEPRPQGTQGSVRIETLSSSVASQHSEFSLSLLDQGRYSDNWASTVQPSVIQTNSYPPSECFGQTNIPPTDNMASVPLQGGNLSGASITSLSRQSYDSMTDMHSEGVTFTNRPGHISSNVPYQGWHDNNQDATHHSNILSINSLTPVNGAAVPAGHAAMNSALHRNLDFNYCDPLQMKHEGFVELTDEALSKQHQGNIMNLPKSQQSHFSNNLGSLEDLVSSMMKQENDKMKLLDGNLICNNYSGGLSRCDSRFSSTFQNIMHPR

SEQ ID NO: 1650 - protein, 86 aa, Glycine max
FRDRDPACLSYCSALLYMKGYHALQVHRVAHTLWHQGRKVLALALQSRVSDVFGVDIHPAAKIGDGILLDHATGVVIGETAIVETE

SEQ ID NO: 1651 - protein, 124 aa, Glycine max
SFLSTCKLANLTVRAELGCCLLHRKGRLTIDGCILQCESNPLDYLSCPIVSTASSSVVLPSQTKSNNGDGVFVSQTRIEGGAKAVLTSGDLALQRVRVIYARTSLLFWFDVEQMCDQIDYDKPL

SEQ ID NO: 1652 - protein, 389 aa, Glycine max
RAGSFFNWFYFSINIGALVSSTFIVWIQENAGWGLGFGIPALFMALAIGSFFLGTPLYRFQKPGGSPITRMCQVVVASVWKRNLVVPEDSNLLYETPDKSSAIEGSRKLGHSDELKCLDRAAVVSDAESKSGDYSNQWRLCTVTQVEELKILIRMFPVWATGIVFAAVYAQMSTLFVEQGTMMNTNFGSFRIPPASLSSFDVISVIFWVPVYDRIIVPIARKFTGKERGFSELQRMGIGLFISVLCMSAAAIVEIVRLKVAKEHGLVDEPVPVPLNIFWQIPQYFLLGAAEVFTFVGQLEFFYDQSPDAMRSLCSALSLLTTSLGNYLSSFILTVVTYFTTQGGNPGWIPDNLNKGHLDYFFWLLAGLSFLNTFVYIVAAKRYKQKKSA

SEQ ID NO: 1653 - protein, 97 aa, Glycine max
RYIESMVADIHRTWLNGGIFMYPADAKSPNGKLRLLYEVFPMSYLMEQAGGQAFTGKQRALDLIPKKIHERSPVFLGSYDDIEQMKELYAASKEDDA

SEQ ID NO: 1654 - protein, 288 aa, Glycine max
LTLGQDLPDGNLGALQKKGNVAKDKFSKVLWYAITNYRTWVFALLYGYSMGVELTTDNVIAEYFYDRFNLKLHTAGIIAASFGMANLLARPFGGYTSDVAARLFGMRGRLWNLWILQTLGGVFCIWLGRANSLPIAVLAMILFFIGAQAACGATFGIIPFISRRSLGIISGLTGAGGNFGSGLTQLIFFSTSRFSTSTGLSLMGVMIVCCTLPVTLVHFPQWGSMFLPPSKDVNKSTEEYYYTAEWNEEEKQKGLHQNSLKFAENSRSERGKRVASAPTPPNTTPTHA

SEQ ID NO: 1655 - protein, 295 aa, Glycine max
MGYICDFCGDQRSMVYCRSDAACLCLSCDRNVHSANALSKRHSRTLLCERCNSQPAFVRCVEEKISLCQNCDWLGHGTSTSSSTHKRQAINCYSGCPSAAELSSIWSFVLDIAAISESTCEQELGLMSINENKCVGVPPEDQNVSGSDEVTDLPALNKSLVGASLMPESSSEPCILDQPAGPTNECLPKLYCPATKCPALSEDDNLYDDFNMDEVDLDLENYEELFGMALSHSEELFENGGIDSLFGTKGMSAGDSNCQEAIAAEVLNSSYLLSVIIMAFFTNGASHVMFCILHR

SEQ ID NO: 1656 - protein, 274 aa, Glycine max
QEKIAYWAVKKHNKQQKKKVKKKQKEGKANSVLVAETKVVLSGSHSSPGPEHPQCSNRGEEYEVKNDCGPAPRDVANFVVGEEESVARDLANSDEGFKSVPVSQGANNSDSGCVELDGYVYAQPTINPIWRGSMYFCNETNGTVNGLLAHMSDLACSKVVEETGHFPEVLHAELLPRDKVWPESFKSRRPTDQDIALFIFPDGEGSEKDFDKVVEDIMIHEHAIKIVAKKAELLIFHSIELPIKYWRFEAKYYLWGVFRRKQISEETNDAVCRD

SEQ ID NO: 1657 - protein, 199 aa, Glycine max
MSPATSSAVGTLSGGLLPHGAHRRRPLPTARLLPPRWSRLQVNAARHRRLATPPRAQSAPSPGYLPDSEFYKIEAILRPWRVSHVSSGLLEMGIRGVTVSDVRGYGAQGGSTERYEGSEFSEDTFIAKVKMEIVVCKEQVEPVIDKIIEKARTGEIGDGKIFLIPVADVVRVRTGERGVHAEKMIGGLSDKLPPVITIS

SEQ ID NO: 1658 - protein, 157 aa, Glycine max
MEGKGFTEEQEALVVKSWNEMKKNSQELGLKFFKKILEIAPAAQQLFSFLKDSTVPLEENPKLKPHAMAVFVMTCESAVQLRKAGKVTVRESNLKRLGATHFKAGVAAEHFEVTKLALLETIKEAVPEMWSPAMKNAWEEAHDQLAEAIKSEMKPSD

SEQ ID NO: 1659 - protein, 358 aa, Glycine max
  unsure (1)..(358): unsure at all Xaa locations
TNISRLYLAANPSAHAAASFAATFWTYANSDTSANSPRCSQGGFTNRQIGSPPSVAAIAAATVAAATAWRAAHGSLPMRAPLHTSFACPASVTTVPSMNTGEAPALKAEQDKTTLQNPPLQDQMLDPXYSEAQHAQHSASKSPAAILSDSESGDAKLNTSSKVTDHETNKTISEHLDSNKTKGRKPVDRSSCGSNTASSSDVETDALEKGEKGKEEPEIPDANQLAIEFSNRRRSVSNLTDSWKEVSEEGRLAFQALFSKEVLAQSFSPPHALKNTDHQMDNANDNKQNIDDKDEDLENNEGLLTIGLGQGKLKTHRTGFKPYKRCSMEAKENRVGASSNQGEEQGCKRIRLEGETST

SEQ ID NO: 1660 - protein, 173 aa, Glycine max
MGFPVGYTEVFLPKLFVQTLSILSLIRTVVFSLFRFLGLSDFLEMDQTWPDYTSYPTRTPELRSPFSALLIREILPVIKFEDVTTSSGEDLPESCAVCLYEFEGEQEIRWLRNCRHIFHRSCLDRWMDHDQKTCPLCRTPFVPDEMQEEFNQRLWAASGVHDFHSEYCPVTEL

SEQ ID NO: 1661 - protein, 270 aa, Glycine max
MAGSSINRGERWSLNGMTALVTGGTRGIGHSIVSDLAAFGAAVHTCSRTQTELNKCLQEWQSQGFQVTGSLCDVSSPPQREKLIQEVASTFNGKLNIYVNNVGINIRKPTIEYTAEEYSQIMTVNLDSSFHLCQLAYPLLKASEKGSIVFISSVAGVVSLGTGAVFAASKAAINQLTKNLACDWAKDNIRSNCVVPWATRTPVVEHLFKDQKFVDDIMSRTPIKRIAEPEEVSSLVNFLCLPAASFITGQVICVDGGLTVNGFQPSMRIT

SEQ ID NO: 1662 - protein, 331 aa, Glycine max
GVTVLYLGQPEPHLLNICSKTKSLWKIFCLGPLLRALQKRKKCHHWTSQVICVDGGLTVNGFEPSSINRGARWSLNGTTALVTGGTRGIGHAIVSDLAAFGAAVHTCSRTQTELNKCLQEWQSLGFQVTGSVCDVSSPSQREKLIEEVTSILNGKLNIYVNNVGTNFRKPTIEYTAEEYSQLMTVNLDSSFHLCQLAYPLLKASENGSIVFISSVAGVVSLGTGAVYAASKAAINQLTKNLACEWAKDNIRSNCVVPWATRTPLVEHLLRDQKFVDDIMSRTPIKRIAEPEEVSSLVTFLCLPAASYITGQVICVDGGLTVNGFQPSMRIT

SEQ ID NO: 1663 - protein, 150 aa, Glycine max
  unsure (1)..(150): unsure at all Xaa locations
MLSFVTENMGLLCSRNRRYNDADAEENAQTAEIERRIELETKAEKHIQKLLLLGAGESGKSTIFKQIKLLFQTGFDEAELKSYLPVIHANVYQTIKLLHDGSKEFAQNDVDSSKYVISNENKGIXEKVIWNWEAGLDYPISSARELAQGN

SEQ ID NO: 1664 - protein, 385 aa, Glycine max
MGLLCSRNRRYNDADAEENAQTAEIERRIEVRNERAEKHIQKLLLLGAGESGKSTIFKQIKLLFQTGFDEAELKSYLPVIHANVYQTIKLLHDGSKEFAQNDVDSSKYVISNENKEIGEKLLEIGGRLDYPYLSKELAQEIENLWKDPAIQETYARGSELQIPDCTDYFMENLQRLSDANYVPTKEDVLYARVRTTGVVEIQFSPVGENKKSDEVYRLFDVGGQRNERRKWIHLFEGVSAVIFCAAISEYDQTLFEDENRNRMMETKELFEWILKQPCFEKTSFMLFLNKFDIFEKKILKVPLNVCEWFKDYQPVSTGKQEIEHAYEFVKKKFEESYFQSTAPDRVDRVFKIYRTTALDQKVVKKTFKLVDETLRRRNLLEAGLL

SEQ ID NO: 1665 - protein, 590 aa, Glycine max
  unsure (1)..(590): unsure at all Xaa locations
MTEDRNVRKTRVVDLVLDCVIPYIDDPKDRDXVSQVCRRWYELDSLTRKHVTIALCYTTTPARLRRRFPHLESLKLKGKPRAAMFNLIPEDWGGHVTPWVKEISQYFDCLKSLHFRRMIVKDSDLRNLARDRGHVLHALKLDKCSGFTTDGLFHIGRFCKSLRVLFLEESSIVEKDGEWLHELALNNTVLETLNFYLTDIAVVKIQDLELLAKNCPNLVSVKLTDCEILDLVNFFKHASALEEFCGGTYNEEPEKYSAISLPAKLCRLGLTYIGKNELPIVFMFAAVLKKLDLLYAMLDTEDHCMLIQKCPNLEVLETRNVIGDRGLEVLGRCCKRLKRLRIERGDDDQGMEDEEGTVSHRGLIALSQGCSELEYMAVYVSDITNASLEHIGTHLKNLCDFRLVLLDHEEKITDLPLDNGVRALLRGCNKLRRFALYLRRGGLTDVGLGYIGQYSPNVRWMLLGYVGESDAGLLEFSKGCPSLQKLEMRGCSFFSERALAVAATQLTSLRYLWVQGYGVSPSGRDLLAMARPFWNIELIPSRKVAMNTNSDETVVVEHPAHILAYYSLAGQRSDFPDTVVPLDTATCVDT

SEQ ID NO: 1666 - protein, 316 aa, Glycine max
MSAADDDDPERRRLNSGLKSFQRDLMAGAVMGGVVHTIVAPIERAKLLLQTQESNLAIVASGRRRFKGMLDCIARTVREEGILSLWRGNGSSVIRYYPSVALNFSLKDLYKSMLRGGNSSDNLLPGATANFAAGAAAGCTTLVLVYPLDIAHTRLAADIGRTDVRQFRGIYHFLATIFHKDGIWGIYRGLPASLHGMVVHRGLYFGGFDTMKEIMSEESKPELALWKRWVVAQAVTTSAGLISYPLDTVRRRMMMQSGMEQPVYNSTLDCWRKIYRTEGLASFYRGAVSNVFRSTGAAAILVLYDEVKKFMNWGRI

SEQ ID NO: 1667 - protein, 161 aa, Glycine max
  unsure (1)..(161): unsure at all Xaa locations
HDAACRVIARLKKERDEARSLLAQAERQFPVSAPNAITANAPVLSNGKRAAEDEDLAPGAKKIHPGISSSIISELTDCNAALSQQRKKRQIPPTLAPVEALEAYTQISSHPFHTAYEQGIISLDILYSKDXIATGGIDTNAVIFDRPSXQILSTLSGHSKR

SEQ ID NO: 1668 - protein, 413 aa, Glycine max
MECNDQRVSVSLKRKSPENGDRVLFNTFSLDDLNEDLFERILSWLPTSTFFRLNSVCKRWKSVAASASFKLACSHIPSRDPWVLMVAPNLNQSVILDSAESTWKRLNHPPLLQEESNQDCVPVAASGGLICYRKSSGNFIVTNPVTGSCRKLPPLQFASQNQPLNAIVMSTSSKDQISFKIVLVFGELPNLLFKVYNSGSNCWEGETALRRKTEDNSMEYDSTDDNVVYFLSKAGIVVASNMQRSPSKQFSSVITNKNDQEIVYFLSYSGNVVACNLTCKCFSEYPRLLPVYNEYSIDVVECNGEMLVVLLSEFLETTTLRVWKYDEANRGWHQIAAMPAANSHEWYGKKADINCVGAGNQIFICLNSTELCTYVMCDLETNKWVELPNCCINGQVIDFMSAFSFEPRIEASV

SEQ ID NO: 1669 - protein, 480 aa, Glycine max
MSSVLEHGVVGCCKSGPGYATPLEAMSGPRESLIYVTAVYTGTGIEKPDYLATVDIDPNSPTYSKVIHRLRVPYLGDELHHTGWNSCSSCHGDPSADRRFLIAPALVSGRIYVVDVKTNPRAPSLHKVVEPADIIQKTGLAYPHTSHCLASGDIMISCLGDKDGNAAGNGFLLLDSEFNVKGRWEKPGHSPLFGYDFWYQPRHNTMISTSWGAPSAFTKGFNLQHLSDGLYGRHLHVYSWPGGELRQTLDLGDSGLLPLEIRFLHDPAKDTGFVGSALTSNMIRFFKTQDESWSHEVAISVKPLKVQNWILPEMPGLITDFLISLDDRFLYFVNWLHGDIRQYNIENLKNPKLTGQVWVGGLIQKGSPVVAITDDGETWQAEVPEIQGNKLRGGPQMIQLSLDGKRLYATNSLFSTWDKQFYPELVQKGSHIIQIDVDTEKGGLKINPNFFVDFGAEPDGPSLAHEMRYPGGDCTSDIWI

SEQ ID NO: 1670 - protein, 543 aa, Glycine max
SARETAAVAVAIVCISAFSITVVAEDPYRFFNWNVTYGDIYPLGVRQQGILINGQFPGPDIHSVTNDNLIINVFNSLDQPFLLSWNGVQQRRNSFEDGVLGTTCPIPPGGNFTYILQVKDQIGSFYYFPSLAFHKAAGGFGGIRILSRPRIPVPFDDPAGDYTVLIGDWYKLNHTDLMSLLDSGRKLPFPNGILINGRGSNGAYFNVEQGKTYRLRISNVGLENSLNFRIQNHKLKLVEVEGTHTLQTTYSSLDVHVGQSYSVLVTADQPAQDYYIVVSTRFTSTVLTSTGVLRYSNSAGPVSGPPPGGPTIQIDWSLNQARSIRTNLTASGPRPNPQGSYHYGLINTTRTIILSSSPGIVNGKQRYAINSVSYVAPDTPLKLADYFKIPGVFRVGSFSDRPTGGGIYLDTSVLQTDYRTFVEFVFQNDEDIIQSYHLDGYSFFVVGMDGGQWTPASRNTYNLRDAVSRCTTQVYPKSWTAIYIALDNVGMWNLRSEFWARQYLGQQFYMRVYTTSTSIRDEYPVPKNALLCGRASGRHTRPL

SEQ ID NO: 1671 - protein, 102 aa, Glycine max
MSMSERKTIDLEQGWDFMQKGITKLKNILEGLPEPQFSSEDYMMLYTTIYNMCTQKPPHDYSQQLYDKYKESFEEYIVSTVLPSLREKHDEFMLRELVKRWA

SEQ ID NO: 1672 - protein, 488 aa, Glycine max
MIATETIVPSTKLKIKFSTKRIEIDSGPKCEFGQKVYHNDKNRRCNSNENSSALNSNKRGPPVSVEGQKEKRQKIDRKGSMQCATILKSLMSHSYSWVFLKPVDPVALSIPDYFTIISHPMDLGTIKSKLERNIYSGTEEFADDVRLTFSNAMKYNPPGNDVHMMAKELSKIFDRKWKDFGRKWNKGNHDVEQPAGSLKACSSVCFVTSKCRICGDTTCHCVIPSNSIQVSSDISSEGSEGGDVITRGADSLRQNCPTKCTSPIEKKSDPDSDGAVSSLDSEHVCPSSQHVTPTTDASSGEVWSTPVLPVQLSPKKALRAAMLKSRFADTILKAQQKTLLDHGDKGNPQKMQQEKERLERIQREERARIEAQIKIAEAAARMRAEEESRQRREKEREAARAAIEKMKRTVDIEHNVEIIKELESLSGCTLSYKAVGCRNGYKVALETLDKPQFENPLERLGLFIKEDFTADEDEEVLNGGFEEGEIFN

SEQ ID NO: 1673 - protein, 355 aa, Glycine max
  unsure (1)..(355): unsure at all Xaa locations
IKSKLERNIYSGTEEFADDVRLTFSNAMKYNPPGNDVHMMAKELSKIFDRKWKDFGRKWKFEDEHDKSETETIKETGRKSLDAMLPRHKDSLPKKNTIXEHKGMHKIRSLATKDARVETPKLSQIPCKLIEKDLHKGMNALRVLSLDSEHVCPSSQHVTPTTDASSGEVWSTPVLPVQLSPKKALRAAMLKSRFADTILKAQQKTLLDHGDKGNPQKMQQEKERLERIQREERARIEAQIKIAEAAARMRAEEESRQRREKEREAARAAIEKMKRTVDIEHNVEIIKELESLSGCTLSYKAVGCRNGYKVALETLDKPQFENPLERLGLFIKEDFTADEDEEGLNGGFEEGEIFN

SEQ ID NO: 1674 - protein, 108 aa, Glycine max
  unsure (1)..(108): unsure at all Xaa locations
ADKTVXIWQGGEEGXYXCIHTXXDHXAEVEAVTVHATXKYFVTAAKDNTWCFYDISTGSCLSQVGEASGQEGYTSASFXPXGLXLGTGXTEAVVKXWDVKTXSNVAKX

SEQ ID NO: 1675 - protein, 139 aa, Glycine max
MKKRPCGGYASLSESGEYYSHRPPTPLLDTVNYPIHMKNLSAKELKQLADELRSDVIFSVSRTGGHLGSSLGVVELTVALHYVFNAPQDKILWDVGHQSYPHKILTGRRDQMHTMRQTNGLSGLTKRSESEIDCFGTGH

SEQ ID NO: 1676 - protein, 91 aa, Glycine max
MASNQDKASYRAGEAKAHTEEKAGQVTGAAKDEACDAKDRASGAAGQATGKGQGAVEATKQKAGEAGQKTSETAQAGKDRAAEGKDRTGSY

SEQ ID NO: 1677 - protein, 97 aa, Glycine max
MDKTSADYYFDSYSHFGIHEEMLKDSVRTKTYHNVIYQNKFLFKNKVVLDVGAGTGILSLFCAKAGAEHVYAVECSHMADMAKEIVEANGYSNGDAI

SEQ ID NO: 1678 - protein, 184 aa, Glycine max
LCSGFDFLSNCRTTRSRAAAINGKDRSSSSLLAAAKDSRSASVTAPISKNSNASDEESETDSEESDVSGSDGDDTSWISWFCNLRGNEFFCEVDDDYIQDDFNLCGLSSQVPYYDYALDLILDVESSHGDMFTEEQNELIESAAEMLYGLIHARYILTSKGMAAMLDKYKNYDFGRCPRVYCSG

SEQ ID NO: 1679 - protein, 861 aa, Glycine max
  unsure (1)..(861): unsure at all Xaa locations
MDQNRDESWRKLVKKMLPPGASIPADASNLDYSIAMEYVGPPVSYEVPRVEPFDTNSRAIPTAQPLSGSQRSNTHGGHMVIEPIPLPVSRIAVGVTSSPNQSPRVSGSSDSVVSVLQNPDLSSASPSASPASVHNLPSNPPKPANEAKRAPVVTFNTVDRPQRKEVEVVKPVYAEYVGVSNERKKKKIRVCYRCGKGKWETKESCIVCNAKYCSNCVLRAMGSMPEGRKCVTCICQPIDESRRLKLGKYSRVLSRLLSPLEVKQIMKAEKECSANQLRPEQLIVNGLPLKPDEMAELLGCPLPPRKLKPGRYRYDKESGLWGKEGEQPDRIISSNLNFTGKLSLDASNGNTEVYMNGREITKLELRVLKLANVQCPRDTHFWVYDDGRYEEEGQNNIRGNIWEKASTRFVCALFSLPFPHGQPHGQKDETSHYTTVPNYLEQKKTQKLLLLGIQGSGTSTIFKQAKFLYGNRFSDEELQDVKLMIQSSMYKYLSILLDGRERFEEEAVSRMNGQGSPGQTMETGSNGEASNTSECIYSLNPRLKHFSDWLLDIIATGDLDAFFPAATREYAPLVEEVWRDPAIQETFKRKDELHFLPDVAEHLCQERYLIXLHEFDSSERDIDYAEGVTQGNGLAFMEFSLDDRIPKSDTYSENLDAQLPPLAKYQLIRVNAKGLNEGCKWVEMFEDVRAVVFCVSLSDYDQLLLSPDSSGSGTLVQNKMVQSKELFETMVRHPCFKDTPLVLVLNKYDIFEEKISRVSLNTCEWFSDFCPVRAHHNNQSLAHQAYFYVAMKFKDLYASLTGKKLFVAQARARDRVTVDEAFKYIKEILKWDEEKEENFYGPPEDSFYSTDISSSPFIRQE

SEQ ID NO: 1680 - protein, 532 aa, Glycine max
RIISSNLNFTGKLSLDASNGNTEVYMNGREITKLELRVLKLANVQCPRDTHFWVYDDGRYEEEGQNNIRGNIWEKASTRFVCALFSLPFPHGQPHGQKDETSHYTTVPNYLEQKKTQKLLLLGIQGSGTSTIFKQAKFLYGNRFSDEELQDVKLMIQSNMYKYLSILLDGRERFEEEAVSRMNGQGSPGQTMETGSNGEASNTSECIYSLNPRLKHFSDWLLDIIATGDLDAFFPAATREYAPLVEEVWRDPAIQETFKRKDELHFLPDVAEYFLSRAVEISSNEYEPSERDIVYAEGVTQGNGLAFMEFSLDDRVPKSDTYLENLDAQLPPLTKYQLIRVNAKGLNEGCKWVEMFEDVRAVVFCVFLSDYDQLSLSPDSSGSGTLVQNKMVQSKELFETMVRHPCFKDTPLVLVLNKYDIFEEKISRVSLNTCEWFSDFCPVRAHHNNQSLAHQAYFYVAMKFKDLYASLTGKKLFVAQARARDRVTVDEAFKYIKEILKWDEEKEENFYGPPEDSFYSTDISSSPFIRQE

SEQ ID NO: 1681 - protein, 279 aa, Glycine max
MLGSRGEDWSLGGKMKNTEREESLLSLGCFSPNNGFQSKASPWPNYHHHHQGNNNKASSSSFLQCPKVVVELQNGGDGKVFSPSSANTAVSQPNTSQKRTAPAPVVGWPPIRSFRKNLASSSSASKPPPESQAEQHNKVAGKKPVDNYANNKGLFVKINMDGVPIGRKVDLNAYDSYENLSSAVDELFRGLLAAQRDSSAGGVHNKQEEEKAITGLLDGSGEYTLVYEDNEGDRMLVGDVPWHMFVSTVKRLRVLKSSELSAFTLGSKQDKIPLDSAMK

SEQ ID NO: 1682 - protein, 87 aa, Glycine max
FLPRVRTAARRRQKGNFVAKVKMEIVVRKDQVEAVIDKIIEEARTGEIGDGKIFLIPVSDVIRIRTGERGEQAERMTGGRSDMLSAV

SEQ ID NO: 1683 - protein, 435 aa, Glycine max
  unsure (1)..(435): unsure at all Xaa locations
MTVFTEVRREKEKRVQICLTKTSYKHIQIRQKTKRVKRTNRAMEGGGAAPPADTVMSDAAPPPQQAMAMGIENIPATLSHGGRFIQYNIFGNIFEVTAKYKPPIMPIGKGAYGIVCSALNSETNEHVAIKKIANAFDNKIDAKRTLREIKLLRHMDHENVVAIRDIVPPPQREIFNDVYIAYELMDTDLHQIIRSNQALSEEHCQYFLYQILRGLKYIHSANVLHRDLKPSNLLLNANCDLKICDFGLARVTSETDFMTEYVXXRWYXAPELLLNSSDYTAAXIDVWSVGCIFMELMDRKPLFPGRDHVHQYILLTLQLIGTPSEADLGFLNENAKRYIRQLPLYRRQSFQEKFPHVHPEAIDLVEKMLTFDPRKRITVEDALAHPYLTSLHDISDEPVCLTPFSFDFEQHALTEEQMKELIYREALAFNLEYQQ

SEQ ID NO: 1684 - protein, 198 aa, Glycine max
VVGIIGNIIAGCLFLSPVPTFVRIWKKGSVEQYSAVPYLATLMNCMVWTLYGLPMVHPHSLLVVTINGAGCVIEIIYVTLFLLYSDRTKRLKVFLWLFLELVFIAVLTFVTFTLIHSVKKRSAVVGTICMLFNVAMYASPLSVMKLVITTKSVEYMPFFLSLASFGNGVSWTTYALIPFDPFIAIPNGIGTTLSVAQL

SEQ ID NO: 1685 - protein, 178 aa, Glycine max
  unsure (1)..(178): unsure at all Xaa locations
MAFVKVYKTRAYFKRYQTRFRRRREGKTDYHARKALIIQDKNKYNTPKYRLVARVTCSRVIAQVIYATIQGDRIVAAADFRELKRYGLEAGLTNYAACYATGLLVARRLLNKTGLDKVYTGAKKTDGEDYDVVNDHKGTEKRPFKAVXDAGLIRTTTGNRVFGVLKGACDGGLNVPHS

SEQ ID NO: 1686 - protein, 428 aa, Glycine max
MGGQNSKEESWRQSSSVRSSSSSWSAYLDPLSSYGFNEPQPSYSSYGYEAYGGDGMVRYDSTKLERRYSRISDHYSSIDQVSEALALAGLESSNLIVGVDFTKSNEWTGKNSFNRRSLHHIGRGLNPYEQAISIIGKSLAAFDEDNLIPCFGFGDASTHDQDVFSFYPSERFCDGFEDVLSRYREIVPHLRLAGPTSFAPIIEMAMSIVEQSGGQYHVLVIIADGQVTKNVDTKHGRPSPQEQKTVDAIVAASKFPLSIILVGVGDVPWDMMKEFDDNIPARAFDNFQFVNFTEIMSKSIPPSRKEAAFALAALMEIPSQYKAAIELKLLGSRQANAPQRHALPPPRYSSHAARFEPSIPPQHGNSHPFATAPSAPSSTSDNQLCPICLSNAKDMAFGCGHQTCCECGQDLQSCPMCRSPINTRIKLY

SEQ ID NO: 1687 - protein, 574 aa, Glycine max
MTMEEGRVENEDYTQDGTVNIKGKPILRSKSGGWKACSFVVVYEVFERMAYYGISSNLILYLTTKLHQGTVSSANNVTNWVGTIWMTPILGAYIADAFLGRYWTFVIASTVYLSGMSLLTLAVSLPSLKPPQCFEKDVTKCAKASTLQLAVFYGALYTLAVGTGGTKPNISTIGADQFDDFHPKEKLHKLSFFNWWMFSIFFGTLFANSVLVYIQDNVGWTLGYALPTLGLLVSIMIFVAGTPFYQAQSAAGSTFTRMARVIVAACRKSKVPVPSDSKELYELDKEGYAKKGSYRIDHTPTLKFLDKACVKTDSNTSPWMLCTVTQVGETKQMIRMIPILVATFVPSTMMAQINTLFVKQGYYSRQTPWKLQIPQQSLAAFVTVSLLVCIVLYDRFFVKIMQRFTKNPRGITLLQRMGIGLVIHTLIMIIASGTESYRLKVAREHGVVESGGQVPLSIFILLPQFILMGTADAFLEVAKIEFFYDQSPEHMKSIGTSYSTTTLGLGNFISSFLLSTVSNITKKNGHKGWILNNLNESHLDYYYAFFAIFKLPQPHLLRVCSLGTMYIGLKFQIP

SEQ ID NO: 1688 - protein, 247 aa, Glycine max
MASFQGINNNIETLIPPELLITQIMQLHASISKLETLRPCKQVNSLFTHLVKLCTLPSSIGIESLPQEVQDMRESLINLSGRAEGLLELEFSTFISLTPEPMKNVTLFPYYGNYVKLANMESKILTENGVVNPKKVAFVGSGPMPLTSIVMATHHMESTHFDNFDIDEEANEVARKIVASDVALEKRMKFETQDVMEVRERLGQYDCIFLAALVGMSREAKVKILGHIRKYMKEGGVLLVRMQKGKG

SEQ ID NO: 1689 - protein, 359 aa, Glycine max
MAEGRSEEDKDDRTMKRLLLTTNCLLLTIGTSGGPLVMRLYFLHGGHRVWLSSFLETAGFPLMLLPLAVSYLRRRRTASAAGTAKPKLISMKPPLLAASTFIGILTGLDDYLYAYGVARLPVSTSALIIATQLGFTAFFAFLLVRQKFTAYSINAVVMLTVGAGVLALHTSGDRPPGESVKEYVMGFVMTVIAAALYGFVLPLIELVYQKIKQPLTYSLVMEIQFVMCFSATLFCLLGMIINNDFKVIPREAKQFEHGEGSYYAVLVGSAIIWQVFFLGAIGVIFCASSLFSGILIAVLLPVTEVLAVIFYKEKFQAEKGVSLLLSLWGMVSYFYGEIKHSRKRKKKNSDPEAEPSQYS

SEQ ID NO: 1690 - protein, 371 aa, Glycine max
MATPVEPPNGIRTEGKHYYSMWQTLFEIDSKYVPIKPIGRGAYGIVCSSVNREINEKVAIKKIQNAFENRVDALRTLRELKLLRHVDHENVIALKDIMMPVHRNSFKDVYLVYELMDTDLHQIIKSSQALSNDHCQYFLFQLLRGLKYLHSANILHRDLKPGNLLINANCDLKICDFGLARTNCSKNQFMTEYVVTRWYRAPELLLCCDNYGTSIDVWSVGCIFAELLGRKPIFPGSECLNQLKLIINILGSQREEDIEFIDNPKAKKYIKSLPYSPGTPLSQLYPNAHPLAIDLLAKMLVFDPTKRISVTQALQHPYMAPLYDPNCDPPAVIPIDLDIDEDLGEEMIRDMMWKEMLHYHPESAMESAGLC

SEQ ID NO: 1691 - protein, 316 aa, Glycine max
MGRTPCCDKKGLKKGPWTAEEDEILSSYIKKNGGHGSWRSLPRMAGLLRCGKSCRLRWTNYLRPDIKRGPFTLEEEKLVIQLHGILGNRWAAIASQLPGRTDNEIKNLWNTHLKKRLKSMGLDPKTHEPLASSTYPFHKAPASVSTRHMAQWESARLEAEARLSNESSRFSHNTTNNSNSDNNKTTDSDYFLRIWNSEVGEAFRNVHHHKADDDNNNNKITTNTPTSSCHSPLSTGSSSNKCESIATNADLASNAPEIITPSSIVKQEFEWGTRGSDSSSSNDMEDSSDTALQLLLDFPINNDMSFLEGNSFVCPL

SEQ ID NO: 1692 - protein, 83 aa, Glycine max
  unsure (1)..(83): unsure at all Xaa locations
RHQASVNAVAWAPHSSCHICTAGDDSQALIWDLSSMGQPVEGGLDPILAYTAGAEIEQLQWSSSQPDWVAIAFXSTKLQILRV

SEQ ID NO: 1693 - protein, 402 aa, Glycine max
  unsure (1)..(402): unsure at all Xaa locations
MEGAGMEENNIINDDDNNNKSEAHLTSAAAFVEGGIQDACXDACSICLEAFXEREPFTGTTCKHEFHLQCILEWCQRSSQCPMCWQPISLKDPTSQELLEAVERERNFRFNPSRNATIFHHPTLGDFELQHLPVGASDADLEERIIQHLAAAAAMGRARHVARREGQRNRSSAQGRQXFLVFSTHPNSPPMAPASSSPSQRGDDEPTPTIDVANLSPTPATGEESSQPTLVSPVQAEQVSASGSGTTALATDHQGSSYNNRRSPNQSSPSSQDRAGPLELQSFSESLKSKLNXAVSTRYKESISKSTRGWKERWFSRNNTMSDLGSEVRREVNAGIATVSRMMERLETRDNNRSNSNSAPSNIEDGSVQGSNDQTLTAGNEGGSLVRDNNTKASCAAGSSSN

SEQ ID NO: 1694 - protein, 398 aa, Glycine max
  unsure (1)..(398): unsure at all Xaa locations
MEGAGMEENNIINDDNKSEAHLTSAAAFVEGGIQDACDDACSICLEAFCDSDPSTVTSCKHEFHLQCILEWCQRSSQCPMCWQPISLKDPTSQELLEAVERERNFRFNPSRNATIFHHPTLGDFELQHLPVGASDADLEERIIQHLAAAAAMGRARHVARREGQRNRSSAQGRQHFLVFSTHPNSPPMAPASSSPSQRGDDEPTPTIDVANLSPTPATGEESSQPTLVSPVQAEQVSASGSGTTALATDHQGSSYNNRRSPNQSSPSSQDRAGPSELQSFSESLKSKLNAVSTRYKESISKSTRGWKERWFSRNNTMSDLGXEVRREVNAGIATVSRMMERLEXXXNNRSXSXXXXSXIXDGSXQXXNXXTLTXGNEGXXXXRXNNXKAXCAAXXSSN

SEQ ID NO: 1695 - protein, 344 aa, Glycine max
MSGLIEGLPDAVAIRCLAWVPFYLHPKLELVSRAWRAVVRGPELFKARQELGSSEDLLCVCAFEPENLWQLYDPLRDLWITLPVLPSRIRHLSHFGAVSTAGKLFVIGGGSDAVDPLTGDQDGCFATNEVWSYDPVVRQWSPRAAMLVPRSMFACCVMNGKIVVAGGFTSCRKSISQAEMYDPEKDVWIPMPDLHRTHNSACSGVVIGGKVHVLHKDMSTVQVLDNAGQWTVEEYGWLHGQMAVIRDALYVISYGLIIKQDKKMRKVVGSASEFRRRIGFAMIGLGDELYVIGGVIGPDRWNWDIKPLSDVDVLTLASDRPTWRQAAPMTRCGGTILGCTLLRI

SEQ ID NO: 1696 - protein, 93 aa, Glycine max
MSGLIEGLPDAVAIRCLAWVPFYLHPKLELVSRAWRAVVRGPELFKARQELGSSEDLVCVCAFEPKNLWQLYDPQRDLWITLPVLPSRIRHLS

SEQ ID NO: 1697 - protein, 93 aa, Glycine max
MSGLIEGLPDAVAIRCLAWVPFYLHPKLELVSRAWRAVVRGPELFKARQELGSSEDLLCVCAFEPENLWQLYDPQRDLWITLPVLPSRIRHLS

SEQ ID NO: 1698 - protein, 155 aa, Glycine max; identical to SEQ ID NO: 901

SEQ ID NO: 1699 - protein, 155 aa, Glycine max; identical to SEQ ID NO: 901

SEQ ID NO: 1700 - protein, 154 aa, Glycine max
KVRNWMLPEMPGLITDFVISLDDRYLYLVNWLHGDIRQYNIEDPAKPVLAGQVFVGGLLQKGSDVVYVTDDDKEEQYAVPQVKGHRLRGGPQMIQLSLDGKRVYVTNSLFSRWDEQFYGPDLLKKGSHMLQIDVDTEEGGLTVNPDFFVDFGTE

SEQ ID NO: 1701 - protein, 204 aa, Glycine max
  unsure (1)..(204): unsure at all Xaa locations
MEREIEHCDKVMSQSSMDACPKSGPGYASPLAAIXGPRETLLYVTAIYSGTGRDKPDFLATVDVDPSSPTYSKVIHRLPVPYLGDELHHFGWNSCSSCYGDPTAVRRYLILPSLVSGRIYVVDTKANPRSPSVHKVVEPEDIISKTGLAYAHTSHCLASGDVLISFLGDEDGNAEGSRCLLLDHVLNLXXMWQKPAHSASCGYD

SEQ ID NO: 1702 - protein, 484 aa, Glycine max
MERCDKVMNQRNMHDCPKTGPGYPSPLAAMSGPKETLLYVTAIYSGTGRDKPDFLATVDVDPSSPTYSKVIHRLPVPYLGDELHHFGWNSCSSCYGDPSAVRRYLILPSLVSGRIYVVDTRSNPRSPSLHKVVEPEDIISKTGLAYAHTSHCLASGDVMISFLGDKDGNAAGSGFLLLDHEFNLKGRWEKPGHSPSFGYDFWYQPQHKTMISSSWGAPAASTKGFNLQHVSDGLYGRHLTCIQLAWGELRQTLDLGESGVLPLEVRFLHDPSKDTGFVGCALSSNMVRFLRPRDESWSHEVAISVKPLKVQNWILPEMPGLITDFLISLDDRFLYFVNWLHGDIRQYNIEDPKNPVLTGQVWVGDYFQKGSPIVAITEDGNTWQSDVPDIQGNKLSAGPQMIQLSLDGKRVYVTNSLFSAWDKQFYPELVEKGSHMLQIDVDTENGGLKINPNFFVDFGAEPGGPALAHEMRYPGGDCTSDIWI

SEQ ID NO: 1703 - protein, 485 aa, Glycine max
  unsure (1)..(485): unsure at all Xaa locations
MERCDKVMNQRNMHDCPKTGPGYPSPLAAMSGPKETLLYVTAIYSGTGRDKPDFLATVDVDPSSPTYSKVIHRLPVPYLGDELHHFGWNSCSSCYGDPSAVRRYLILPSLVSGRIYVVDTRSNPRSPSLHKVVEPEDIISKTGLAYAHTSHCLASGDVMISFLGDKDGNAAGSGFLLLDHEFNLKGRWEKPGHSPSFGYDFWYQPQHKTMISSSWGAPAAFTKGFNLQHVSDGLYGRHXTCIQLAWGXELRQTLDLGESGVLPLEVRFLHDPSKDTGFVGCALSSNMVRFFKTEDESWSHEVAISVKPLKVQNWILPEMPGLITDFLISLDDRFLYFVNWLHGDIRQYNIEDPKNPVLTGQVWVGGLLQKGSPIVAITEDGNTWQSDVPDIQGNKLRAGPQMIQLSLDGKRVYVTNSLFSAWDKQFYPELVEKGSHMLQIDVDTENGGLKINPNFFVDFGAEPGGPCLAHEMRYPGGDCTSDIWI

SEQ ID NO: 1704 - protein, 254 aa, Glycine max
  unsure (1)..(254): unsure at all Xaa locations
MGIRFSSSQAAPSESSPASSLGELPESCVAQIMTYMDPPQICKLATLNRAFRGASSADFVWESKLPPNYDVLLRRIFADFPSHLGKRGIYARLCRLNSLDDGTKKVWLDRGMGKLCLCVSAKGLSITGIDDRRNWNHIPTDESRFSSVAYLQQIWWFEVDGEVEFPFPAGKYSVFFRIHLGRAGCCFGLRVCNTEHVHGWDCKPVCCRRWQXSTKVKFSMTQIDCTHTKGGLCLDSVLVYPSEFRKVKAFLNYS

SEQ ID NO: 1705 - protein, 265 aa, Glycine max
MAETKLSMMKDKRWSLRGMTALVTGATRGIGHAIVEELADFGATVHICARNQDDIDKCLEEWKNEGLNVTGSVCDLQCSDQRIRLMEVVGSIFHGKLNILVNNAGRCIAKTILDSTAEDISTTMGTNFESAYHLCQLAHPLLRESGYGSVVFISSTAGLRGFPFFSAYAASKGAMNQFTKNLAFEWAKDNIRGNAVASGPVMTVLMEGVMNSSEVSDVVNAATSQSLVGRMGEAKQISALVAFLCLPVASYITGQVICVDGGLTT

SEQ ID NO: 1706 - protein, 590 aa, Glycine max
MTEERNVRKTRVVDVVLDCVIPYIDDPKDRDAVSQVCRRWYELDSLTRKHVTIALCYTTTPARLRRRFPHLESLKLKGKPRAAMFNLIPEDWGGHVTPWVKEISQYFDCLKSLHFRRMIVKDSDLQNLARDRGHVLHALKLDKCSGFTTDGLFHIGRFCKSLRVLFLEESSILEKDGEWLHELALNNTVLETLNFYLTDIAVVKIEDLELLAKNCPNLVSVKLTDCEILDLVNFFKHASALEEFCGGTYNEEPERYSAISLPAKLCRLGLTYIGKNELPIVFMFAAVLKKLDLLYAMLDTEDHCMLIQRCPNLEVLETRNVIGDRGLEVLGRCCKRLKRLRIERGDDDQGMEDEEGTVSHRGLIALSQGCSELEYMAVYVSDITNASLEHIGTHLKNLCDFRLVLLDHEEKITDLPLDNGVRALLRGCDKLRRFALYLRRGGLTDVGLGYIGQYSPNVRWMLLGYVGESDAGLLEFAKGCPSLQKLEMRGCLFFSERALAVAATQLTSLRYLWVQGYGVSPSGRDLLVMARPFWNIELIPSRKVATNTNPDETVVVEHPAHILAYYSLAGQRSDFPDTVVPLDTATCVDT

SEQ ID NO: 1707 - protein, 104 aa, Glycine max
MADSSREENVYMAKLAEQAERYEEMVEFMEKVAKTVEVEELTVEERNLLSVAYKNVIGARRASWRIISYIEHKEESRGNEDHVAIIKEYKGKIEFKTGADRKEV

SEQ ID NO: 1708 - protein, 211 aa, Glycine max
MAGSEPVRAEGETMAVDAAPRKPRILLAASGSVAAVKFANLCHCFSEWADVRAVSTSASLHFIDRAAMPKDVILYTDDNEWSSWKKLGDSVLHIELRKWADIMVIAPLSANTLGKIAGGLCDNLLTCIVRAWDYSKPFFVAPAMNTLMWNNPFTERHFISIDELGISLIPPVTKRLACGDYGNGAMAEPSTIYSTVRLFYESKAQQGNGDI

SEQ ID NO: 1709 - protein, 90 aa, Glycine max
  unsure (1)..(90): unsure at all Xaa locations
VYHLSHRLKGAFIRNNYDTRSGVLSQLKVLLTGYKNKPPKTADTPFAVLEKTKARDIYEYALXLXVKNEDQDAFERHLLQKKTYYTDAWK

SEQ ID NO: 1710 - protein, 135 aa, Glycine max
EQTLYEDENKNRMMETKELFEWVLRQPCFEKTSFMLFLNKFDIFEKKVLNVPLNVCEWFKDYQPVSTGKQEIEHAYEFVKKKFEELYFQSTAPDCVDRVFKIYNTRLLEIRRVWKTFKLVDETLRRRGLFEALSL

SEQ ID NO: 1711 - protein, 113 aa, Glycine max
MALAKAKEIVASASVVVFSKSYCPFCVQVKKLLTQLGASFKAVEMDTESDGTEIQSALAEWTGQRTVPNVFINGKHIGGCDDTIALNKGGKLVALLTEAGAISGSSSKTTVTA

SEQ ID NO: 1712 - protein, 248 aa, Glycine max
MVFEETELRLGLRLGLPGNGAAPTTEAAAELGVRKRGFSETETDETTSVDLMLNLSPKEASAAATTDGADPRENPKTSPKEKNLPLLDPAKPPAKAQVVGWPPVRSFRKNMFAAQKSSGGEESEKNSPNASFVKVSMDGAPYLRKVDLKMYKSYPELSDALGKMFSSFTIGNCESQGFKDFMNESKLMDLLNSSDYVPTYEDRDGDWMLVGDVPWEMFVESCKRLRIMKGKEAIGLAPRAVEKCKNRS

SEQ ID NO: 1713 - protein, 295 aa, Glycine max
MIAVARKDMDRIKGPWSPEEDEALQKLVERHGPRNWSLISRSIPGRSGKSCRLRWCNQLSPQVEHRAFTPEEDETIIRAHARFGNKWATIARLLSGRTDNAIKNHWNSTLKRKCASFMMAGDEAVAVSPRPLKRSFSAGAAVPPPGSPSGSDFSESSAPGVVSVSPSHVFRPVPVRPIVETASSQDDADDAGPATSLSLSLPGVESAEISNRATTVPVMPVNTVAAPAPVPAEVGLGALNLSGEFMAVMHEMIRKEVRSYMEQQKNGMMCFQGMEMMEGFRNVSVKRIGISRVDS

SEQ ID NO: 1714 - protein, 223 aa, Glycine max
  unsure (1)..(223): unsure at all Xaa locations
MKFGAPNFGSGRSSCFSSLYPCLSDDWGELPLKEDDSEDMVLYGVLRDAVNAGVGPISRCILTRESFVGFSGVTXWSLMSCSSGFIPAVTVKSEPDLFPAPEPVYNPPAAQGPEPAVVPAKGKHYRGVRQRPWGKFAAEIRDPAKNGARVWLGTFETAEDAALAYXRAAYRMRGSRAWWHSTVRRTSGEARPVRVTARWGSVQACSKREGGPAVRNWKKVVGC

SEQ ID NO: 1715 - protein, 111 aa, Glycine max
MAQPAELSREENVYMAKLAEQAERYEEMVEFMEKVAKTVDSEELTVEERNLLSVAYKNVIGARRASWRIISSIEQKEESRGNEDRVTLIKDYHGKIEVVLTKICDGILKLL

SEQ ID NO: 1716 - protein, 290 aa, Glycine max
  unsure (1)..(290): unsure at all Xaa locations
HSTNAHLISQSSTNITQFPLSYSSNTGPPTSATPSHYSKESSVSWHTDSLPSFLDFPENGSIDNNRVESSACPIMASEEYSKQNDWQEWAERLISDDDTLTTNWNDLLADNIQDLEPKVPFQVSKPLSQIXDINPEPIEPQLPASSGENCIGVAPTSSTNSAPAKPRMRWTPELHEAFVEAVNQLGGSERATPKGVLKLMKVDGLTIYHVKSHLQKYRTARYRPESSEGAAEKKLSPIEEMSSLDLKTNYPNLITXLEKRTDRWTKSGIEITEVLRLQMEVQKRLHEQLE

SEQ ID NO: 1717 - protein, 368 aa, Glycine max
MSKTSEIITCKGKPVTVEEIQVDPPKATEVRVKMLCASICSTDISSTKGFPHTNFPIALGHEGVGIIESVGDQVTNLKEGDVVIPTYIGECQECENCVSEKTNLCMTYPVRWTGLMPDNTSRMSIRGERIYHIFSCATWSEYMVSDANYVLKVDPTIDRAHASFISCGFSTGFGAAWKEAKVESGSTVAVFGLGAVGLGAVIGSKMQGASRIIGIDTNENKRAKGEAFGITDFINPGDSNKSASELVKELSGGMGADYSFECTGVSTLLSESLEATKIGTGKAIVIGVGIEITLPLGLFAILLGRTLKGSVFGGLRAISDLSILADKGHKKEFPLQELFTHEVTLADINKAFELLKQPNCVKVVINMP

SEQ ID NO: 1718 - protein, 136 aa, Glycine max
  unsure (1)..(136): unsure at all Xaa locations
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGRSGGYXGGGGYCGGGG

SEQ ID NO: 1719 - protein, 109 aa, Glycine max
  unsure (1)..(109): unsure at all Xaa locations
MSSSSREENVYMAKLAEQAERYEEMVEFMEKVAKSVDNEELTVEERNLLSVAYKNVIGARRASWRIISSIEQKEESKGNEDHVAIIKDYRGXIEAELSXICDGILNVLE

SEQ ID NO: 1720 - protein, 250 aa, Glycine max
  unsure (1)..(250): unsure at all Xaa locations
MGRGRXVELKRIENKINRQETFEKRRNGLLKKAYELSVLCDAEVSLIIFSTRGNLYEFCSTNSMLKTLERYQKCSYGAVEVSKPGKELEQSSYREYLKLKARFESLQRTQRNLLGEDLGPLNTKDLEQLERQLDSSLKQVRSTKTQFMLDQLADLQNKEHMLVEANRSLTMKLEEINSRNQYRQTWEAGEQSMSYGTQNAHSQGFFQPLECNPTLQIGSDYRYNPEASEQQLAATTQAQQVNGFIPGWML

SEQ ID NO: 1721 - protein, 150 aa, Glycine max
  unsure (1)..(150): unsure at all Xaa locations
MAAKMLALFALLALCASATSATHIPGHLPPVMPLGTMNPCMQYCMMQRGLASLMACPSLMLQQLLALPLQTMPVMMPQMMTPNMMSPLMMPSMMSPMVLPSMMSQMMMPQCHCDAVSQIMLQQXLPFMFNPMAMTIPPMFLQQPFVGAAF

SEQ ID NO: 1722 - protein, 721 aa, Glycine max
MSLSAFSFPLHLRQTTPPSDPKTSSTPLPLSSHSHWGADLLTQSQRKLNQVKRRPHGVCASLSEMGEYYSQKPPTPLLDTINYPIHMKNLATKKLKQLADELRSDVIFHVSRTGGHLGSSLGVVELTIALHYVFNAPKDKILWDVGHQSYPHKILTGRRDKMHTMRQTDGLAGFTKRSESDYDCFGTGHSSTTISAGLGMAVGRDLKGDKNNVVAVIGDGAMTAGQAYEAMNNAGYLDSDMIVILNDNKQVSLPTANLDGPIPPVGALSSALSKLQSNRPLRELREVAKGVTKQIGGPMHELAAKVDEYARGMISGSGSTLFEELGLYYIGPVDGHNIDDLVSILNEVKSTKTTGPVLLHVVTEKGHGYPYAERAADKYHGVTKFDPATGKQFKSNAATQSYTTYFAEALIAEAEADKDIVGIHAAMGGGTGMNLFLRRFPTRCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFHMVATAAAIDDRPSCFRYPRGNGIGVELPLGNKGIPLEIGKGRILIEGERVALLGYGSAVQSCLAAASLLEHHGLRATVADARFCKPLDRSLIRSLAQSHEVLITVEEGSIGGFGSHVVQFMALDGLLDGKLKWRPIVLPDCYIDHGSPVDQLSAAGLTPSHIAATVFNLLGQTREALEVMT

SEQ ID NO: 1723 - protein, 760 aa, Glycine max
MHMASLGDIGLAAAINILSAFAFLLAFAILRIQPINDRVYFPKWYLKGLRSSPLQAGIFVSKFVNLDFKSYIRFLSWMPAALQMPEPELIDHAGLDSAVYLRIYLLGLKIFVPIAVLAFSVMVPVNWTNSTLERSNLTYSQIDKLSISNIPTGSNRFWTHLVMAYAFTFWTCYILKREYQIVATMRLHFLASERRRPDQFTVLVRNVPPDPDESVSELVEHFFLVNHPDHYLTQQVVYNAKKLSSLVSKKKKRQNWLDYYELKYSRNQSTRPSKKTGFLGLCGNRVDAIDFYTDEIKRLSEEIELEKHKVMKNSKYTMPAAFVSFRTRWGAAVCAQTQQSRNPTVWLTEWAPEPRDVYWDNMAIPYVSLTIRKLIIAVAFFFLTFFFMIPIAFVQSLANIEGIEKAAPFLKSFIEMQFIKSFIQGFLPGIALKIFLIFLPAILMIMSKFEGFISTSALERRAATRYYIFQFINVFLGSIITGTAFQQLDKFIHQSANEIPKTIGVSIPMKATFFITYIMVDGWAGCAGEILRLKPLIFYHLKNFFLVKTEKDREEAMDPGTFGFNTGEPQIQLYFLLGLVYAVVTPFLLPYIIVFFGLAYVVYRHQIINVYNQEYESAAAFWPDVHGRIIFALVISQLLLMGLLSTKEAANSTPLLITLPILTISFHLYCKGRYEPAFVKHPLQEAMMKDTLERAREPNFNLKEFLQNAYIHPVFKGDDDSDSDVMSENWEEQEPVLVQTKRQSRKNTPLPSKHSGSLSS

SEQ ID NO: 1724 - protein, 427 aa, Glycine max
  unsure (1)..(427): unsure at all Xaa locations
MGGSISKRRRSKQHSSNFFPRYQQPHFPQSQDNGSVGHYGYSPQSYGGGRAPEQGKSLDRKYSRIGDDYKSLDQVTDALAKAGLESSNLIVGIDFTKSNEWTGGRSFQRRCLHHIGHEQNPYEQAISIIGKTLSSFDEDNLIPCFGFGDASTHDQEVFSFYPDERFCRGFEEVLERYRELVPQLKLAGPTSFAPVIEMAITIVEQSGGQYHVLVIIADGQVTRSVDTEHGQLSAQEKKTVEAIVKASEYPLSIILVGVGDGPWDMMKQFDDNIPARAFDNFQFVNFTEIMSKNMDRSXKETEFALAALMEIPSQYKATLELNILGACRGKDIDRIPLPPPLYGAASFNSPKTSRQYSSRPSAPSSRHDVSTNPPATSASDNQVCPICLTDPKDMAFGCGHQTCCDCGQDLELCPICRSTIDTRIKLY

SEQ ID NO: 1725 - protein, 230 aa, Glycine max
  unsure (1)..(230): unsure at all Xaa locations
LVSEFIWYRAPPRVSYLGPPPPILSCGICTGFGATXVNVAKPKPGSSVAIFGLGAVGLAAAEGARVSGASRIIGVDLLSARFEEAKNFWVNEFVNPKDHDKPVQQVIAEMTNGGVDRAVECTGSIQAXMVSAFECVHDGWGLAVLVGVPSKDDAFKTAPINFLNERTLKGTFYGNYKPRTDLPSVVEKYMSGELEVDKFITHTVPFSEINKAFDLMLKGQSIRCIIRMQE

SEQ ID NO: 1726 - protein, 308 aa, Glycine max
  unsure (1)..(308): unsure at all Xaa locations
LWRKILLFCFYCLIHCLFFCNIIQDLLKLEKIQEDLAERFGGQPTFAQWAAVAGVDQKTLRKRLNYGIFCKDKMIKSNIRLVISIAKNYQGSGMNLQDLVQEGCRGLVKGAEKFDGTKGFKFSTYAHWWIKQAVRKSLSDQSRTIRLPFHMVEATYRVKEARKQLYSENGRQPDDGEVAEATGLSMKRLNAVLMTPKSSXSLEQKIGINQNLKPSEVISDPDAETAEEQLLKQFMKKDLEEALDSLNARERQVVRWRFGMDDGRTKTLQEIGEMLGVSRERIRQIESSAFKKLKNKKRTNHLQQYLVS

SEQ ID NO: 1727 - protein, 638 aa, Glycine max
MSCLLPHFNCHLDTFRTHPYALPTHPSKTRLNLCFQPQCVLSATSPSTLLSLEKKLALHAPSDPNTSWPYIAAVAPPLQLGMQFSLFNLPLWMGGHNNVPSAQLVFLGLHQVHGSKTSKIVPKDPSHISSLVAQRNLACQAYPGTNYIYAFNQANFKSTLSAESLLTNEEAVIVAAASEALALAKAAAKVAKDAALLVKKKPPAEAEYKSHVSSKSDDLLLKWFKQMEEVEDGVAEESMGAGAEIMEGVDVSPSEEESDLEPSHEELERLQEQLSDSIAVRSRRQTERKAKRVRATEKATTNFTSFKPGSSSRRKRVSMQEVDYSDPLRYLRTTTSASRLLTPTEEIKLSAGIQDLLKLEKIQEDLAERFGSQPTFAQWAAVAGVDQKTLRKRLNYGIFCKDKMIKSNIRLVISIAKNYQGSGMNLQDLVQEGCRGLVKGAEKFDGTKGFKFSTYAHWWIKQAVRKSLSDQSRTIRLPFHMVEATYRVKEARKQLYSENGRQPDDEEVAEATGLSMKRLNAVLMTPKAPRSLEQKIGINQNLKPSEVISDPDAETAEEQLLKQFMKKDLEEALDSLNPRERQVVRWRFGMDDGRTKTLQEIGEMLGVSRERIRQIESSAFKKLKNKKRTNHLQQYLVS

SEQ ID NO: 1728 - protein, 62 aa, Glycine max
  unsure (1)..(62): unsure at all Xaa locations
MKVKILQWHAVASWTWDAQDETCGICRMAFDGCCPDCKFPGDECPIIWGACXNHAFHLHCIL

SEQ ID NO: 1729 - protein, 252 aa, Glycine max
  unsure (1)..(252): unsure at all Xaa locations
MDHSADAHRTDLMTITRFVLNEQSKHPESRXGDFTILLSHIVLGCKFVCSAVSKAGLAKLIGLAGETNVQGEEQKKLDVLSNEVFIKALISSGRTCILVSEEDEEAIIVEPSKRGKLYCVCFDPLDGSSNIDCGVSIGTIFGVYALYDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGR

SEQ ID NO: 1730 - protein, 230 aa, Glycine max
  unsure (1)..(230): unsure at all Xaa locations
MNMNYGSMGPGAMVRCRQCSSSITAMPGARAVQCMQCSCVTRVSGRGWQQHGYGQGYGGNGGGMLMPPMRPTPAFGGGRGKKRAVLIGIKYTNRRSCELRGPINDVKCMRYLLTERFGFPNDCVLILTDEEXEPCRQPTKDNIRMAMHWLGGQGGPLPGNPPGGSGFPGPGGRRGPQQTKCKQLGTAGDKGPPAPGDPLSPRGPPIRGAGRILRGPLRPPPSVCPAATTL

SEQ ID NO: 1731 - protein, 144 aa, Glycine max
  unsure (1)..(144): unsure at all Xaa locations
MATAAATREEMVYLAKLAEQAERYEEMVEFMEKVVAAAGTGELTVEERNLLSVAYKNVIGARRASWRIVSSIEQKEEGRGAAGHAAAARGYRALVEAELSNICAGILRLLDERLVPAAAAVDAKVFYLKMKGDYHRYLAEXTSA

SEQ ID NO: 1732 - protein, 63 aa, Glycine max
  unsure (1)..(63): unsure at all Xaa locations
MSSATKGDRKTALDVASWMFNIVASVGIILVNKALMATXGFSFATTLTGLRHEKPAREAGTRS

SEQ ID NO: 1733 - protein, 696 aa, Glycine max
MTVEKKMNDSGDEFPVGMRVLAVDDDPTCLLVLETLLRRCQYHATTTNQAIKALALLREHKDKFDLVISDVHMPDMDGFKLLELVGLEMDLPVIMLSANGDTKLVMKGISHGACDYLLKPVRMEELKNIWQHVIRRKKFDSKEKNKTRNIDKPTSNSSNGLGSSGTGNSDHNEKLTKKRKDQDEDEDEEQENDHDNDDPSAQKKPRVVWSVELHRKFVAAVNQLGIDKAVPKKILDLMNVEKLTRENVASHLQKYRLYLKRISCVANQQTNMVVALGGADPSYLRMNSVSGVGHIQSISGSGQLHNNAFRSFPPSGIINRLNTPAGLNVHGFPSGVLQLSQSQNLKNTNDNLKFQSAIVPANQNGVHGMTVSVGLDQLQNNKGVMSVQNLTTVFDAKTTFPISNKLPDPRPKITNSGSHTPDVSFSNNALMLEPRPQGTQGSVRIETLSSSVASQHSEFSLSLLDQGRYSDNWASTVQPSVIQTNSYPPSECFGQTNIPPTDNMASVPLQGGNLSGASITSLSRQSYDSMTDMHSEGVTFTNRPGHISSNVPYQGWHDNNQDATHHSNILSINSLTPVNGAAVPAGHAAMNSALHRNLDFNYCDPLQMKHEGFVELTDEALSKQHQGNIMNLPKSQQSHFSNNLGSLEDLVSSMMKQENDKMKLLDGNLICNNYSGGLSRCDSRFSSTFQNIMHPR

SEQ ID NO: 1734 - protein, 302 aa, Glycine max
MELTKETYSCSLRLKNTVEEDAIRLQPGSSEVHMFFPDSLGDDLIVEFQESKGKHFGRVLVQVATIADDPADKLRWWPIYREPNHELMGKLQLYVNYSTSADDNSHLKQNSYMSSVRKMACEILELMAEGLKIQQKNVFSKLLMDKESDSVFRVNHYPACPELVNGQNMIGFGEHTDPQIISLLRSNNTSGLQIFLRDGNWISVPPDHKSFFINVGDSLQVMTNGRFRSVKHRVLTNGFKSRLSMIYFGGPPLSEKIVPLSSLMKGKESLYKEFTWFEYKNLTYASRLADNRLGHFERIVAS

SEQ ID NO: 1735 - protein, 247 aa, Glycine max
  unsure (1)..(247): unsure at all Xaa locations
MSDAAMAVVKPSSFSSCMPFSIFFFFFFFFFKMKSYIWLQTVDGSIQQVEEEVAMFCPMICQEVLQTGMGSSKNYAISLPQRVNPAILGLILDYCRFNQVPGHSNKERKTFDEKFIRMDTKKLCELTSAADSLQLKPLVDLTSRALARIIEGKTPEEIRETFHLPLDLISSFFKKKKKKEPLRNITDDPRIRLLNRLYARKRKELKERKKLKDVEVEEEPKDERSXEDLLSFINGADGDIKGTRANK

SEQ ID NO: 1736 - protein, 117 aa, Glycine max
MAVSAREEFVYMAKLAEQAERYEEMVEFMEKVSAAVDGDELTVEERNLLSVAYKNVIGARRASWRIISSIEQKEESRGNDDHVTAIRDYRSKIETELSGICDGILKLLDSRLVPAAA

SEQ ID NO: 1737 - protein, 138 aa, Glycine max; identical to SEQ ID NO: 1159

SEQ ID NO: 1738 - protein, 92 aa, Glycine max
  unsure (1)..(92): unsure at all Xaa locations
MEDAPSPREKNVYMANIAQQAERYEKKVELMKKVSSFXNTHHPTGEERNRLSVAYKNEMEERRASGEIFSSIXQKEESHAKXDHDAVIREYR

SEQ ID NO: 1739 - protein, 190 aa, Glycine max
FGFHCSVLKQICGVAEAMEVQSLSFEENILWVGSFVEALVLDTLLATAKSLACFLVVTGSLLTDANNLVSPMVDGRFPLDQPCKGKHTSEENKDASDTEDDDDDDDVNDGEDGDDDDEDDEDFSGDDGGEEADSDDDPEANGGGESDDDDEDDDDDDDDNDEDDGDEDDDDEEDEDEDEETPQPPSKKRK

SEQ ID NO: 1740 - protein, 167 aa, Glycine max
  unsure (1)..(167): unsure at all Xaa locations
MGTSANAVAGGRGGAPVPKDVDYANYFCTYAFLYHXKEMLSDRVRMDAYFDAIFQNKRHFAGKTVLDVGTGSGILAIWSAQAGARKVYAVEATKMSEHARALVKANNLQDVVEVIEGSMEEITLPEKVDVIISEWMGYFLLRESMFDSVINARDRWLKPTGVMYVLV

SEQ ID NO: 1741 - protein, 181 aa, Glycine max
MGTSANAVAGGRGGAPVPKDVDYANYFCTYAFLYHQKEMLSDRVRMDAYFNAIFENKRHFAGKTVLDVGTGSGILAIWSAQAGARKVYAVEATKMSEHARALVKANNLQDVVEVIEGSMEEITLPEKVDVIISEWMGYFLLRESMFDSVINARDRWLKPTGVMYVFWCNKAEKKIVLMNVS

SEQ ID NO: 1742 - protein, 342 aa, Glycine max
MATCVDAPTPLSRKPNGSQSDDHSFNYMKFCRPTFSDRVPCIPICKNRDTAFTRVEEFDTCVEDNDDIEVEVVEGVDLWLKIQEEARLDVDQEPILSSYYFSSILSHKSLESALANHLSTNLSSLSLPSSTLFDLFMGVLVDDGDDDIVGAVKDDLIAVKERDPACISYVHCLLNFKGFLACQAHRIAHKLWLQGRKVLALLIQNRVSDVFAVDIHPGAKIGRGILLDHATGLVVGETAVIGNNVSILHNVTLGGTGKASGDRHPKIGDGVLIGAGTCILGNIKIGDGAKIGACSVVLKEVPPRTTAVGNPARLVGGKDNPIKLDKMPSFTMDHTSWSDYVI

SEQ ID NO: 1743 - protein, 185 aa, Glycine max
MASEVIEYRCFVGGLAWATDSDALEKAFSHYGEIVESKVIIDRETGRSRGFGFVTFASEQAMKDAIEGMNGQNLDGRSITVNEAQSRGSGGGGGGYGGGGGYGGGGYSRGGGGYGGGGRREGGGGGYNRNGGGGGYGGGGGYGGGGGHGGGGGYGGGGRDRGYGGDGGSRYSRGGGASDGGSWRN

SEQ ID NO: 1744 - protein, 133 aa, Glycine max
MVFVKPSKSNAYFKRYQVKFRRRRDGKTDYRARIRLINQDKNKYNTPKYRFVVRFTNKDIVAQIVSASIAGDIVKASAYAHELPQYGLTVGLTNYAAAYCTGLLLARRVLKMLEMDEEYEGNLEATGEDFSVE

SEQ ID NO: 1745 - protein, 122 aa, Glycine max
MKGAKSKGAAKADTKLAVKSKGAEKPAAKGKKGKAGKDPNKPKRAPSAFFVFMGEFREEFKQKNPKNKSVAAVGKAAGERWKSLSESEKAPYVAKANKLKGEYNKAIAAYNKGESAAAAAPK

SEQ ID NO: 1746 - protein, 182 aa, Glycine max
MARVYVGSLDPAVTARELEDEFRVFGVLRSVWVARKPPGFAFVDFDDRRDAQDAIKDLDGKNGWRVELSRNASSGPGGRDRSGGSEMKCYECGESGHFARECRLRIGSGGLGSGRRRSRSRSRSRSRSPRYRRSPSYSRRSYSRSPRRRSVSPARGRSVSRSPVRGRDESPAYGNGYRRSRS

SEQ ID NO: 1747 - protein, 224 aa, Glycine max
  unsure (1)..(224): unsure at all Xaa locations
GFIVAFDPLDGFSIVDTNFTVGTIFGVXPGNKLAVVTGRDHVAAAMGVMGPRTTNVLALKDFPGTHEFLLIDEDHIRSIRXRKQVVTHYPLCLFKMELVNDFPDHSKLINYYAREKYTLRYTGXMVPDVNQILFKRKGIFTNVSSPSAKAKLRLLFEVAPLGFLIEKAGGYSSDGHQSVLDKVISNIDDRTQVAYGSKNEIIRFEETLYGKSRLKGGVAVGAAA

SEQ ID NO: 1748 - protein, 387 aa, Glycine max
METGIACYTRGPFLPSVSSKHSPPSISPSFGLRSLKSSSLFGESLRVASKSTLKVSKTKNTSLVTRCEIGDSLEEFLTKATPDKGLIRLLVSMGEALRTISFKVKTASCGGTQCVNTFGDEQLAVDLLANQLLFEALNYSHFCKYACSEENPELLDMGGPVEGGFSVAFDPLDGSSIVDTNFTVGTIFGVWPGDKLTGITGRDQVAAAMGVLGPRTTYVLALKDFPGTHEFLLLDEGKWQHVKETTEIGEGKLFSPGNLRATSDNPDYAKLIDYYVNEKYTLRYTGGMVPDVNQIIVKEKGIFTNVSSPSAKAKLRLLFEVAPLGFLIEKAGGYSSDGHQSVLDKVISNIDDRTQVAYGSKNEIIRFEETLYGKSRLKGGVAVGAAA

SEQ ID NO: 1749 - protein, 387 aa, Glycine max
METGIACYTRGPFLPSVSSKHSPPSISPSFGLRSLKSSSLFGESLRVASKSTLKVSKTKNTSLVTRCEIGDSLEEFLTKATPDKGLIRLLVSMGEALRTISFKVKTASCGGTQCVNTFGDEQLAVDLLANQLLFEALNYSHFCKYACSEENPELLDMGGPVEGGFSVAFDPLDGSSIVDTNFTVGTIFGVWPGDKLTGITGRDQVAAAMGVLGPRTTYVLALKDFPGTHEFLLLDEGKWQHVKETTEIGEGKLFSPGNLRATSDNPDYAKLIDYYVNEKYTLRYTGGMVPDVNQIIVKEKGIFTNVSSPSAKAKLRLLFQVAPLGFLIEKAGGCSSDGHQSVLGKVISTIDDRTQVAYGSKNEIIRFEETLYGKSRLKGGVAVGAAA

SEQ ID NO: 1750 - protein, 404 aa, Glycine max
MSGSIPKGAFLLPLTLFLIVLLLPLFRNFIQSSPKTYASNLETKETRRCNIFSGNWVPYPKEPYYNNETCPFILDQINCIKNGRPDRDFLKLRWKPHHCELPLFDATQFLELVRGKSMAFVGDSMGRNQLESLLCLINTVAHPEDITEKYTSNDNIFFRWWFVPDYNFTVTTMWSPFLVKFNDSDPTGRGFYSATKLYLEEADEAWRSKIKDFDFVVFSTGQWFFRPLTFYEKGQVVGCQKCENSTELNYYGYKKAFQTAFRTIRKLEGFKGLAFLVTHSPEHFENGAWNEGGTCNRTKPFEEKGVYENGDIVEALHQIQVEEFNAAREKGLRFGLIDITDAMGMRADAHPGRFRLGGNNNNNLNVNDCVHWCSPGAVDTWNEFLLYLMKLEAEIQHKHKGNML

SEQ ID NO: 1751 - protein, 112 aa, Glycine max
  unsure (1)..(112): unsure at all Xaa locations
IGYRAPPRVSYVGPPPPRVIVTEIDPICALHALMEGLQXLPLEDVASXADIFLTTTGNXDIILVDHMRKMXXXAIVCNIGHXTXKLIXXAXETXPVXXRXXIXPXTPAGITC

SEQ ID NO: 1752 - protein, 136 aa, Glycine max
QIDLSTDLRLGLSISPSSPFREESFDWPPIKSILRSTLVGKQSHLSQRPSLFVKVYMEGIPIGRKLNLMAHYSYDGLVKTLGHMFRTNILCKHNSRNFHVLTYEDQEGDWMMVGDVPWEMFLNSVKRLKITRADRC

SEQ ID NO: 1753 - protein, 586 aa, Glycine max
  unsure (1)..(586): unsure at all Xaa locations
MQKMAYTFSFPEEVLEHVFSFIWSERDRNAISLVCKSWYEIERWCRRKVFVGNCYAVSPLMVIKRFPELRSIALKGKPHFADFNLVPDGWGGYVCPWIAAMARAFPWLEEIRLKRMVITDESLELIAKSFKNFKVLVLTSCEGFTPDGLAAIAANCRNLRELDLRESEVVDDICGHWLSHFPDSYTSLVSLNISCLNNEVNLSALERLLSRCPNLRTLRLNRAVPLDRLANLLLRCPQLVELGTGVYTTEMRPEVFSNLEAAFSGCKQLKSLSGFWDVLPSYLPAVYPICSRLTSLNLSYAIIQSSDLIKLISQCPNLLRLWVLDYIEDAGLYALAASCKDLRELRVFPSDPFGLEPNVALTEHGRPFWFRXNVALTEQGLVSVSEGCPKLQSVLYFCRQMSNAALHTIARNRTNMTRFRLCIIEPRTPDYLTHEPLDSGFGAIVEQCKDLQRLSLSGLLTDRVFEYIGTYGKKLEMLSVAFAGDSDLGLHHVLSGCDNLKEGWRSTIGSLVTTALLANAEACKMLGSXKMPRLNGEVIDERGHPDSKSESSPVEKLYIYRIVFGRRLIMPGYVLRKQGEFALRIS

SEQ ID NO: 1754 - protein, 286 aa, Glycine max
  unsure (1)..(286): unsure at all Xaa locations
VAPFCSAFHCHASPLPWKPSSGSLLFCLPHSLFFLLSISNFPSSTRLLARSFFSDTVPIDNKEKEQLVTSVKPTYSPTPPNRHLRTPHSGXWYFKLSIPERRQSFCFMYSVESPSFRKPLTPLEVAQYGSRFTGVGAQILGADDKYICQFSPESQFFWGSRHELMLGNTFEPNQNSKPPNKEVPPQEFNDRVLEGFQVTPLWHQGFIRDDGRSNYVETVKTARWEYSTRPVYGWGDVGSTQKSTAGWLATFPVFEPHWQICMAGGLSTSWIEWDGERIEFDNAPSY

SEQ ID NO: 1755 - protein, 261 aa, Glycine max
MYKERERGGVSVSASKSEDRKRINDVLDKHLERSSPSTSRPINTASKNSNLQVEESETESEESDVSGSDGDDTSWISWFCNLRGNEFFCEVDDDYIQDDFNLCGLSSQVPYFDYALDLILDVESSHGDMFTEEQNELIESAAEMLYGMIHARYVLTSKGMAAMLDKYKSYDFGRCPRVYCSGQPCLPVGQSDIPRSSTVKIYCPRCEDLYYPRSKYQGNIDGAYFGTTFPHLFLMTYGQLKPQKPAQGYVPRVFGFKVHKP

SEQ ID NO: 1756 - protein, 277 aa, Glycine max
MAAAAEQDYWGLFREETGWYNEIFLSAVVPGGGGWWRALPHPLRSWLRNCIGGYLLYFATGFLWCFVIYYWKRNAYIPKDAVPTVEAMKKQIIVASKAMPFYCALPSISEHMIESGWTRCFFHISEVGWPMYIVYVSLYLIFVEFGIYWMHRELHDIKPLYKHLHATHHIYNKENTLSPFAGLAFHPLDGILQAISHVIALFLLPMHFRTHIALLFIEAVWTANIHDCIHGKIWPVMGAGYHTIHHTTYRHNYGHYTVWMDWLFGTLREPEDLLKKD

SEQ ID NO: 1757 - protein, 112 aa, Glycine max
  unsure (1)..(112): unsure at all Xaa locations
MASNQNQASYHAGETKARNEEKTGQVMGATKDKAGQTTEATKQKAGETTEATKQKAAETTEAAKQKASETAEATKQKAAEAKDKTAQTAQAAXEKTYETAQSAQERAAQGKD

SEQ ID NO: 1758 - protein, 229 aa, Glycine max
  unsure (1)..(229): unsure at all Xaa locations
CTIFCIIQGSFXHEDFEGHKGTIEAGDLQWMTAGKGIVHSEMPAAQGTRKGLQLWINLASKYKMIETRYQEMLSKDIXPDAEDDGIKFXVLAGEALGIMXPIYTKILNMFWVFSLRRGCFLKPNIPTCGNSSYYILWXGGILGNMEPKLSNSYHIFVLGPGDGLKAWNKCSKLLRFILVGAEPLGEPLVQFGPFVMNSQEEIDQTIDDFENFANGFEKARHWTFESQIN

SEQ ID NO: 1759 - protein, 562 aa, Glycine max
MFFNQKIVLFKSFALMGTSNLLLFFSLMSLCAMAASKVVLIGNNITLSFDDIEANFAPAVKGSGKYGVLYLAEPLDACAELTNKVEQLPNASSPFALVVRGGCSFEEKVRIAQKAGFKAVIVYDNEEGGILVAMAGNSAGIRIHAVFVSKASGEILKKYAGLTNVEIWLIPTFENSAWSIMAISFISLLAMSAVLATCFFVRKHRIRRERPRASLVREFHGMSSRLVKAMPSLVFTSVLEDNCTSRTCAICLEDYCVGEKLRILPCCHKFHAACVDSWLTSWRTFCPVCKRDARTGLTDPPPSESTPLLSSTPASMASSVLSSARSSLASSSAIQIARTASMASSALPSARSSLASSSAIQIARTASMASSVLSSARSSLASSSAIQIARTASMASSALPSARSSLASSSAIQIARTASMASSALHSARSSLASSSAIQISRAASQTPSVSRNHSIASTPYVQPSLRSSYHQSPSLSISRSSVDLRNASQRSLASHLNSPCSMGYPSLSSLNSRYMSPHIPSPSNASVSYMGSSSHQQHPLRYSESAASFSPFASTHSLPEC

SEQ ID NO: 1760 - protein, 545 aa, Glycine max
MEADVSIIFVAFQNPPPPQIPISPSVFLLWMFFNQKIVLFKSFALMGTSNLLLFFSLMSLCAMAASKVVLIGNNITLSFDDIEANFAPAVKGSGKYGVLYLAEPLDACAELTNKVEQLPNASSPFALVVRGGCSFEEKVRIAQKAGFKAVIVYDNEEGGILVAMAGNSAGIRIHAVFVSKASGEILKKYAGLTNVEIWLIPTFENSAWSIMAISFISLLAMSAVLATCFFVRKHRIRRERPRASLVREFHGMSSRLVKAMPSLVFTSVLEDNCTSRTCTSRTCAICLEDYCVGEKLRILPCCHKFHAACVDSWLTSWRTFCPVCKRDARTGLTDPPPSESTPLLSSTPASMASSVLSSARSSLASSSAIQIARTASMASSALPSARSSLASSSAIQIARTASMASSALHSARSSLASSSAIQISRAASQTPSVSRNHSIASTPYVQPSLRSSYHQSPSLSISRSSVDLRNASQRSLASHLNSPCSMGYPSLSSLNSRYMSPHIPSPSNASVSYMGSSSHQQHPLRYSESAASFSPFASTHSLPEC

SEQ ID NO: 1761 - protein, 131 aa, Glycine max
MYVFYRYLAEFKSGTERKDAAENTMVAYKAAQEIALKELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 1762 - protein, 386 aa, Glycine max
PLQAFNWESNKYNWWNNLEGKVSDIAKAGFTSVWLPPPTHSFSPEGYTPQNLYSLNSKYGSERQLKALLQKMKQYKVRAMADIVINHRTGTTQGRGGMYNRFDGIPLGWDERAVTSDSGGLGNRSTGAIFQGFPNIDHTQDFVRKDIIGWLRWLRHEVGFQDFRFDFVKGFSPKYVKEYIEGAKPLFCVGEYWDSCNYKGSTLDYNQDSHRQRIINWIDGTGQLSTAFDFTTKGILQEAVKGNFWRLRDPQGKPPGVIGWWPSRSVTFVDNHDTGSTQAHWPFPKDHIMEGYAYILTHPGIPTVFYDHFYDWGDSIREQIVKLIDVRKRQGIQSRSSVRILEAKHDLYSAVIGEKVCMKIGNGSWCPTGREWTLSTSGHNYAVWHK

SEQ ID NO: 1763 - protein, 100 aa, Glycine max
  unsure (1)..(100): unsure at all Xaa locations
MSGVWVFKNGVVRLVENHGSDRWVLAHTASNEIITPYAVLEHKPSSLGWERYYDDPDLLQFHKRSTVHLISLPRDXNKFRSMHMYDIVVKNKNYFEVRDM

SEQ ID NO: 1764 - protein, 187 aa, Glycine max
MKATKELSQHVEENEVTVLVDEEEDEEYESEDEVVDDGEDDEDDDDDDDDDDDNEDEEDDDEDDAPDGGDDDDDEDEEEESDVQRGGEPDDDDNDDDDEDEDEEDEEEQGEEADLGTEYLIRPLVTAEEEEASSDFEPEENGEEEEEDVDDEDGEKSEAPPKRKRSDKDDSDDDDGGEDDDERPSKR

SEQ ID NO: 1765 - protein, 103 aa, Glycine max; identical to SEQ ID NO: 683

SEQ ID NO: 1766 - protein, 810 aa, Glycine max
  unsure (1)..(810): unsure at all Xaa locations
MEHQRQATMKRIAYLLDKGVNGKKLPDGLWEEVLEGLQFVENEMGDILGNPLKPLLLSVRSGAAISMPGMMDTVLNLGLNDEVVAGLAAKSGERFAYDSYRRFLDMFGDVVMDIPHSLFEENNEKLKHTKGDKIDTDVKTYNHKILVEQYNKICLNEGVDAFISQIKKWVENVTQIDFGECYDWMFLQFMNLXSAVDIADRKAAAMLASSITANGTIAFMVDYPSKNRRLLPLRSKVDTTSFAANEIQVRYINRRCWLTKSPSYYISCGXLFRIGIQIGKCRYKIAVDMGHGGQVVICSGLMMVXEPEDLDQLLHPQFEDPSTNKNKVIAVCLPAYPGTAVAQVVFSAEXAEVWHANETIVILVMNDTRXECKGFVXADKGIFTPGGGMTSQATVVGRKWGRCCVXAFPHMLANHTEKLSIVGVKVIXKDXWILLNRSTREVILGKQPLSPPALSDDLEIFMASADEVSHLKVMANVDTPEYAVRAEQNGAQGIGFCIRIHIYFACFCSEETSAKXIMAETPETSTAALEFLLPYQRSDFEGIFRAMDGLPVTIRLLDPPLHEFLPEGDLEHIVRELTSDTGMKEEEILSWIKEQSEVNPMLGFRGCRLGISYPELTEMQARAIFQAAVSVSNHGITVHPEIMVPLIGTPQELRHQVNLIRNVADKVLSEMGSSLSYKVGTMIEVPRAALVADEIAKEAEFFSFGTNDLTQMTFGYSRDDVGKFLPIYLSGGILQHDPFEVLDQKGVGQLIKICTEKGRAARPNLKVGICGEHGGEPSSVAFFAEIGLDYVSCSPFRVPIARLAAAQVAV

SEQ ID NO: 1767 - protein, 161 aa, Glycine max
  unsure (1)..(161): unsure at all Xaa locations
MASNQNQASYAAGETKARTEEKAGQMVGTTKDKAGQATETTKQKAGEAKDKTAQTAQAAKDRAAESKDQTGSYLGEKTEEAARQKAAETAQYAQERTSDAAQYAKESAVAGXDKTGSVLQQAGETVVGAKDAVANTLGMGGDGTGNNAATKDTTERITRDH

SEQ ID NO: 1768 - protein, 148 aa, Glycine max
MSDAPPSPTHESGGEQSPRGSSSGAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSATPDQVGLAGQNSQLVH

SEQ ID NO: 1769 - protein, 174 aa, Glycine max
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQLVHQGSLNYIGLQVQPQHLVMPSMQGHE

SEQ ID NO: 1770 - protein, 111 aa, Glycine max
MERCDKVMNQRNMHDCPKTGPGYPSPLAAMSGPKETLLYVTAIYSGTGRDKPDFLATVDVDPSSPTYSKVIHRLPVPYLGDELHHFGWNSCSSCYGDPSAVRRYLILPSLV

SEQ ID NO: 1771 - protein, 145 aa, Glycine max
MGSSVGQVNVMQPACSNAASADSILSTKTEPILCFTGRQAQSNLSFSGVTGDSSAGDYQDCGASSMLLMGEPPWFAPCPENSLQSANRNNAVMRYKEKRLARMFDKKVRYASRKARADVRRRVKGRFVKAGDVYDYDPLSTTRSF

SEQ ID NO: 1772 - protein, 175 aa, Glycine max
MSGWFGGKTDAKADEAAKTGPSVQDRAIEAKDQTISFIGEKSEAVTKAASDTADAAMKMGSDAMGKASETGQAITDRAIESKDQTFGFFGEKTEAAKKMAADTGDAAKQKSAEAAKCVEENAAKFTGEPAAPKEPTGNMFQQAGGQVMGAATGARDAVMNTLGMGGDKADVGSAK

SEQ ID NO: 1773 - protein, 575 aa, Glycine max
KTIHNNVKYSPIFLAIFVLILASALSSANAKIHEHEFVVEATPVKRLCKTHNSITVNGQYPGPTLEINNGDTLVVKVTNKARYNVTIHWHGVRQMRTGWADGPEFVTQCPIRPGGSYTYRFTVQGQEGTLWWHAHSSWLRATVYGALIIRPREGEPYPFPKPKHETPILLGEWWDANPIDVVRQATRTGGAPNVSDAYTINGQPGDLYKCSSKDTTIVPIHAGETNLLRVINAALNQPLFFTVANHKLTVVGADASYLKPFTTKVLMLGPGQTTDVLITGDQPPSRYYMAARAYQSAQNAAFDNTTTTAILEYKSPNHRVKNKTKPIMPPLPAYNDTNAVTAFSKSFRSPRKVEVPTEIDQSLFFTVGLGIKKCPKNFGPKRCQGPINGTRFTASMNNVSFVLPNNVSILQAHHLGIPGVFTTDFPGKPPVKFDYTGNVSRSLWQPVPGTKAHKLKFGSRVQIVLQDTSIVTPENHPIHLHGYDFYIVAEGFGNFDPKKDTAKFNLVDPPLRNTVAVPVNGWAVIRFVADNPGAWLLHCHLDVHIGWGLATVLLVENGVGKLQSIEPPPVDLPLC

SEQ ID NO: 1774 - protein, 380 aa, Glycine max
  unsure (1)..(380): unsure at all Xaa locations
MSHQEQAVLSLLSKLALSFDGAVLGVALAFAAVRTLFKFTATSASLRKLRRAPSISVSDLRSLLAEPPSDADAGEIVIIRGTVDAKSAVDGTWKTLKPGVLVSRESGDKGVILQRTQTCIYNDWKVLSHXNDHXKILKNILRYNNDNMKVPFLLTDVGRRPNAEYVVVNMDGSRHPLPLTTVYHKLQPITASPYTFLQALFGHEYPVGLLDEEKILPLGKDITAVGLCSLKNGIAEIKSCKYLPYFLSDLSKDQMIMDLSIKTKILFWGGIALGSMSVGVLGYAVVRNWNKWKQWKQQRQLQQQRQAVSDVEPQMDDEIEDAPDGQLCVICLMRRRRSVFIPCGHLVCCQGCAISVEREVAPKCPVCRQEIRDSVRIYES

SEQ ID NO: 1775 - protein, 147 aa, Glycine max
MFKSKLDWWDYVGDMFTEEQNELIESAAEMLYGLIHARYILTSKGMAAMLDKYKNYDFGRCPRVYCSGQPCIPVGQSDIPRSSTVKIYCPRCEDIYYPRSKYQGNIDGAYFGTTFPHLFLMTYGQLKPQKPSQSYVPRVFGFKLHKP

SEQ ID NO: 1776 - protein, 111 aa, Glycine max
LFCLTDGTWVSVPPDQTSFFINVGDTLQVMTNGRFKSVKHRVLADPPKSRWSMIYFGGPPLCEKIAPLPSLMLKGEESFYKEFTWWEYKKAAYASRLADNRLGPFEKSAAD

SEQ ID NO: 1777 - protein, 69 aa, Glycine max
SINDAKQMFKFSSDKELEQYIAEEHPEWDVKDGRVLFQKVKESQPCKEIPAASVINQTLGYARELERIV

SEQ ID NO: 1778 - protein, 138 aa, Glycine max
  unsure (1)..(138): unsure at all Xaa locations
KRYQVKVKRRREGKTDYRAKIRLLTXDKNRYNTPKYRSVGRFSDKDIAAHIITASIAGDIVPAAAXAHELPRYGLEVRLTNDAAAYCTGLLLARRVLTTLETDEDDEANVEATGEDYSEEPAESRTTFRAILDVGLIR

SEQ ID NO: 1779 - protein, 41 aa, Glycine max
  unsure (1)..(41): unsure at all Xaa locations
MKGRVXWNEDNIXEIEAXKPVRQKITEPKTPYHPMIDDDSM

SEQ ID NO: 1780 - protein, 162 aa, Glycine max
  unsure (1)..(162): unsure at all Xaa locations
MSAAEGAVVFSEEKEALVLKSWAIMKKDSANLGLRFFLKIFEIAPSARQMFPFLRDSDVPLETNPKLKTHAVSVFVMTCEAAAQLRKAGKITVRETTLKRLGGTHLKYGVADGHFEVTRFALLETIKEGLPADMWGPXXRNXWGEAYDQLXAAIKQXMKPFE

SEQ ID NO: 1781 - protein, 224 aa, Glycine max
FVTEGMIWVWPGNDPPTATLPSLLPPSGFEVHAEIVMELPIEHGLLLDNLLDLAHAPFTHTSTFAKGWSVPSLVKFLTPASGLQGYWDPYPIDMEFRPPCMVLSTIGISKPGKLEGQSTSQCATHLHQLHVCLPSSKQKTRLLYRMSLDFAPVLKHIPFMQHLWRYFAEQVLNEDLRLVLGQQERMNNGANVWNFPVSYDKLGVRYRLWRNALEQGTKQPPFSK

SEQ ID NO: 1782 - protein, 388 aa, Glycine max
MADSGSASSSRMWCSIPERVQLHAAMLALQFGYAGFHVVSRAALNMGISKLVFPVYRNIIAFLLLLPFAYFLEKKERPAITLNFLLQFFLLALVGITANQGFYLLGLDNTSPTFASAIQNSVPAITFLMAVILRIEQVRLNRKDGIAKVAGTIFCVAGATVITLYKGPTIYSPSPPLQSESSVVVEFGTLSSLGDAKGKNWTLGCLYLIGHCLSWSAWLVLQAPVLKKYPARLSVTSYTCFFGLIQFLVIALIVERDAQAWIFQSGGEVFTILYAGVVASGIAFAVQIWCIDRGGPVFVAVYQPVQTLVVAIMASIALGEEFYLGGIIGAVLIVVGLYFVLWGKSEERKFAKEHAAITSTPEHSGIRSSSHAKTSLTQPLLPSSTENV

SEQ ID NO: 1783 - protein, 79 aa, Glycine max
LRWHAVASWTWDAQDETCGICRMAFDGCCPDCKLPGDDCPLIWGVCNHAFHLHCILKWVNSQTSQAHCPMCRREWQFKG

SEQ ID NO: 1784 - protein, 347 aa, Glycine max
MMFDFARIWTRNTLIGLGLGQFLSLLITSTGFTSSELAKKGINAPTSQSFLNYVFLTLVYGTVLLYRRKALKAKWYYYIILGLVDVEANFLVVKAYQYTSLTSVMLLDCWSIPSVMLLTWLFLKTKYRFKKITGVVVCVAGLVLVVFSDVHSGDRAGGSNPRKGDLLVIAGATLYAISNVSEEFLVKNADRVELMAMLGLSGGIISAIQISILERNELKSIHWSAGAVRFPFVGFAVAMFMFYSLVPVLLKINGSTMLNLSLLTSDMWAVLIRIFAYHEKVDWMYFVSFGAVTIGLIIYSGGDRDENQHPPNAADDAHRPAAKHDEEATSGNHNIAAAAGSSKTWVA

SEQ ID NO: 1785 - protein, 84 aa, Glycine max
MKVNILQWHAVASWTWDAQDETCGICRMAFDGCCPDCKLPGDDCPLIWGVCNHAFHLHCILKWVNSQTSQAHCPMCRREWQFKG

SEQ ID NO: 1786 - protein, 301 aa, Glycine max
MGSSLSNLNDGETNDSSMGPSLGDIPESCIAAVFMYLTPPEICNLAGLNRSFRGAASSDFVWEKKLPPNYQDLLDLLPPERVLGLSKKDIFAVLSRPIPFDGDNKELWIDRVTGRVCMAISARGMAITGIEDRRYWNWIPTNESRFHVVAYLQQIWWFEVDGTVTFHLPPGIYSLSFRIHLGGFAKKSGRRVCNYEHTHGWDLKPVRFSLSTSDGQEASCEYYLDDVKREESTGHHKRGFWIDYKVGEFVVTGSEPSTEIKWSMKQIDCTHSKGGLCVDSVFINPIGDLKDYRTKSFCEID

SEQ ID NO: 1787 - protein, 112 aa, Glycine max
  unsure (1)..(112): unsure at all Xaa locations
MAAAGDAGEKKMITLKSSDGEEFEVEEAVAMESQTIRHMIEDDCADNGIPLPNVNSKILSKVIEYCNKHVQAKPADGAAAGAGASDASAAAXAAPAEDLKNWDAEFVKVDQA

SEQ ID NO: 1788 - protein, 163 aa, Glycine max
  unsure (1)..(163): unsure at all Xaa locations
LIDEDHNARVADFGLSIMGPVDSGTPLSELPAGTLGYLDPEYYRLHYLTTKSDVYSFGVVLLEILSGRKAIDMQLEEGNIVEWAAPLIKAGDISGILDPALSPPSDLEALKKIAAVACKCVRMRGKDRPSMDKVTTSLERALALLMGSPCLEQXPILPTEVVL

SEQ ID NO: 1789 - protein, 287 aa, Glycine max
MAIQDQNGFFRSQGGPPEGGGVSLSSGHSVTHIQLNDQFSCGNDYALKVRKPYTITKQRERWTDEEHKKFLEALKLYGRAWRRIEEHVGTKTAVQIRSHAQKFFSKVLHDPTGNNTNTVESIEIPPPRPKRKPMHPYPRKLVETPNKEISIPEQPMKSNSLKSSDFDQENQSPKSVLSGVGSDSLGSSDSDTPNGSLSPMSSISGFHTSSFTRAKPKTTTSEEEAGMDTDSTHDEKPLMKFKLPPNGCVSIKEDNTAEESSGRTFKLFGMTLFVTDTCKPSPTIEEC

SEQ ID NO: 1790 - protein, 108 aa, Glycine max
APPPEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFN

SEQ ID NO: 1791 - protein, 117 aa, Glycine max
MMEDPTTLLNSEYSRLFGEDTDLYNRIVLGALLPHSVWGPLPRFLQTWLRNYLGGVLLYLLSGLLWCFYIYYWKRNVHVPKGDDLRFESRLKEVLIIFCVCSVSNMIVFKRGYLWGN

SEQ ID NO: 1792 - protein, 117 aa, Glycine max
  unsure (1)..(117): unsure at all Xaa locations
MAFFSHHHLQQPHPAAPPPQQQQQQPAPLSFRNALPVPVDGQIPAPLAFFNAPPAFPDQAGQPQIVDAAGLTAAAGMGWRQPREQELLGENSQMSSIDFLQTGSAVSTGLALSLEXR

SEQ ID NO: 1793 - protein, 141 aa, Glycine max
  unsure (1)..(141): unsure at all Xaa locations
MVSAREEFVYMAKLAEQAERYEEMVEFMEKVSASVDGDELTVEERNLLSVAYKNVIGARRASWRIISSIEQKEESRGNDDHVAAIRDYRGKIETELTGICEGILKLLDSRLVPAAASGDSKVXYLKMKGDYHRYLAEFKTG

SEQ ID NO: 1794 - protein, 128 aa, Glycine max
MSSSNYDGILLGMGNPLLDISAVVDEDFLTKYDVKLNNAILAEEKHLPMYDEMSSKFNVEYIAGGATQNSIKVAQWMLQIPGATSYMGSIGKDKYGEAMKKDATAAGVNVHYYEDESAPTGTCGVCVV

SEQ ID NO: 1795 - protein, 214 aa, Glycine max
MRTQRLNHLLLSLFLFAAAFSSLHPTATAGDEGAPSPGDGDGDADFIRTSCNTTLYPDVCFTSLSRYASAVQQNPGQLARVAISVSLSKVHRAASYVSNLTRDADYDGTTRAALALHDCFSNLGDAVDEIRGSLKQMRQIGAAGAGASSFLFQMSNVQTWMSAALTDEETCTDGFQDVADCPVKTDVCDRVTNVKKFTSNALALVNSYANKGMP

SEQ ID NO: 1796 - protein, 293 aa, Glycine max
MPPGMINTFDLPGEAMKDMAAVKPRQVAYVAAPDARGDKVLAPRIENGVKVFDIKAEIIRWNILPDVAVEAYAYNRQVPGPRLQVTEGDHVRINFRNALPESTTVHWHGLIVPNEMDGPANVTQDPVPPGGSYTYEFDVGQSGTYFYHSHDHPDRQQALGLYGALLIAPKDPSAEVKADLDYAIQLQEWLKREWLTYPAMLMEGALPNYFTINGKAYPSTDTVAMKVGQTIKLRFIGTNNNFVHPMHVHGGPFEVVAVDGVNLKESARYQADTVNVGPGQRYDVGGGPRVADS

SEQ ID NO: 1797 - protein, 151 aa, Glycine max
SRVFFFFFCTCRFQSVAYLQQMWWVEVVGELEFEFPVGSYSLIFRLQLGKASKRLGRRVCNVDQVHGWDIKPIRFQLSTSDGQLSLSECYLCGPGEWVYYHVGDFVVEKPNEPINIKFSLAQIDCTHTKGGLCVDSAIICPTEFKERLKQS

SEQ ID NO: 1798 - protein, 324 aa, Glycine max
MKFCKKYQEYMQGQEKKLPCVGFKKLKKILKKCRRNSSSLKPLNASLAAKTCPDHCPVCDGTFFPSLLNEMSDIVGCFNQRAQKLLELHLASGVRKYFFWIKGKLQGNHTALIQEGKDLVTYALINAIAIRKILKKYDKIHYSKQGQLFKSQIQSMHKEILQSPWLCELMAFHINLRETKVKSRKAHALFDGCSLTFKDGKPALTCELFDSIKVDIDLTCSICLDTVFDPVSLTCGHIFCYICACSAASVSIVNGLKSADPKMKCPLCREGAVYEGAVHLEELNILLSRSCQEYWEQRIQTERVERVKQIKEHWDSQCRAFVGV

SEQ ID NO: 1799 - protein, 261 aa, Glycine max
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMRVIDEHLIPSAAAGESTVFYYKMKRDYYRYLAEFKSGNEKKEAADQSMKAYESATAAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEDAE

SEQ ID NO: 1800 - protein, 261 aa, Glycine max
MAASKDRENFVYIAKLAEQAERYEEMVESMKNVANLDVELTVEERNLLSVGYKNVIGARRASWRILSSIEQKEETKGNELNAKRIKEYRQKVELELSNICNDVMTVIDEHLIPSAAAGESTVFYYKMKGDYYRYLAEFKAGNEKKEAADQSMKAYESATTAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEEAE

SEQ ID NO: 1801 - protein, 261 aa, Glycine max
  unsure (1)..(261): unsure at all Xaa locations
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMRVIDEHLIPSAAAGESTVFYYKMKGDYYRYLXEFKXGNEKKEAXDXSMKAYESATTAAEADLPPTHPIRLGLALNFSVFYYEILNSPEXACHLAKQAFDEAISELDTLNEESYKDSTLIMQLLRDNLTLWTSDIPEDGEDAQKVNGTAKLGGGEEAE

SEQ ID NO: 1802 - protein, 221 aa, Glycine max
STHASGEKTTEGKNVIGARRASWRILSSIEQKEETKGNELNAKRIKEYRQKVELELSNICNDVMRVIDEHLIPSAAAGESTVFYYKMKGDYYRYLAEFKSGNEKKEAADQSMKAYESATAAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEDAE

SEQ ID NO: 1803 - protein, 261 aa, Glycine max
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMRVIDEHLIPSAAAGESTVFYYKMKGDYYRYLAEFKSGNEKKEAADQSMKAYESATAAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEDAE

SEQ ID NO: 1804 - protein, 265 aa, Glycine max
MDLTQLVLVMFRSSSLLSPHPNFYTHTPPPSYLLQSQQSLIGFEQPPSSLLGLNHLSPSQISQIQAQIEAQQSQNQNPHSLNFLGPKPVPMKHVGGPPKPTKLYRGVRQRHWGKWVAEIRLPKNRTRLWLGTFDTAEEAALAYDKAAYRLRGDFARLNFPSLKGSCPGEEYKPVHSAVDAKLDAICANLAEMQKQGKTEKGARSAKKSKQGPNQEAKPEPQASAESEGSADSSPLSDLTFDVTEPQWEHFNLQKFPSYEIDWDSL

SEQ ID NO: 1805 - protein, 133 aa, Glycine max
  unsure (1)..(133): unsure at all Xaa locations
MIKPLNMSSATKGDRKTALDVASWMFNIVTSVGIILVNKALMATYGFSFATTLTGLHFATTTLLTVFLKWLGYVQTSHLPLPDLIKFVLFANFSIVGMNVSLMWNFVGFYQIAKLSMIPVSXFPEVILDNVRY

SEQ ID NO: 1806 - protein, 62 aa, Glycine max
  unsure (1)..(62): unsure at all Xaa locations
QSCKQYTPCGCQSMCGKECTCVNGGTCCEKYCGCSKSCXXRFRGCHCAKSQCRSRQCPCFAA

SEQ ID NO: 1807 - protein, 152 aa, Glycine max
MGLSSLPAPSEGVLCVLLVNTALSISIFKGIVRTILQIVGIRVSSLSPSPDISRNPPEPLEFNLSPSEGFIEEFRSRTPTLRFGSMCGSKQPQHECCCVCLTKFEPESEINCLSCGHIFHKVCMEKWLDYWNITCPLCRTSLMPEDDASCFW

SEQ ID NO: 1808 - protein, 105 aa, Glycine max
  unsure (1)..(105): unsure at all Xaa locations
ARLLVXYIXRLYSDDKYRYEIKDILEMXMXVXXXXXXYXVVYHXYRSLSPLLQDAGLNDLNMTQLTWGLXDXTYKMDLILVHPPXIDCLACIYIASVLREXDTLG

SEQ ID NO: 1809 - protein, 396 aa, Glycine max
  unsure (1)..(396): unsure at all Xaa locations
MAGPVVVTNGNLNPNDTRGKTITCKAAVAYGPGEPFVVERVLVHPPQKMEVRIKILFTTICHTDLSAWQGENEAQRAYPRIFGHEASGIVESVGEGVSDMNEGDLVVPIFNGECGDCKYCKCEKTNKCERFGVDAMKKVMVSDGATRFYTMDGKPIFHFLNTSTFTEYTVVDSACIVKIHIDGSNGDLNRNIKRLTLLSCGVSSGVGAAWNTADVHFGSTVAVFGLGVVGLAVAEGARARGASRIIGVDINSDKFIKAREMGITDFINPKDDERPVYEIIGEMTGGGVHYSFECAGNLNXLRDAFLSASXGWGLTVVLGIHASPTLLPIHPMELFDGRNIVGSVFGHAQLPYLLQSQCSVRLLKLLQMQLQKKRGEGSLGLHKAFQVMLLKLQLQQ

SEQ ID NO: 1810 - protein, 403 aa, Glycine max
NFSSSQLRIITQIEIEFKVKFGKTNLCHCTFTDLRLRASLCRSSVRKAVTISPLTTTKMESEKKSSAISDVGAWAMNVVSSVGIIMANKQLMSNNGYAFSFASSLTGFHFAVTALVGLVSNATGYSASKHVPMWELIWFSLVANMSITGMNFSLMLNSVGFYQISKLSMIPVVCVMEWILHNKHYSREVKMSVVVVVIGVGVCTVTDVKVNLKGFMCACIAVLSTSLQQISIGSLQKKYSIGSFELLSKTAPIQALFLLILGPFVDYYLSGKLITNYKMSSGAILFILLSCSLAVFCNVSQYLCIGRFSAVSFQVLGHMKTVCVLTLGWLLFDSELTFKNIMGMVIAVVGMVIYSWAVELEKQSNAKTLPHAKNSMTEEEIRLLRDGVEKSPLKDVELGEAQG

SEQ ID NO: 1811 - protein, 254 aa, Glycine max
MNFSLMLNSVGFYQISKLSMIPVVCVMEWILHNKHYSREVKMSVVVVVIGVGVCTVTDVKVNLKGFMCACIAVLSTSLQQISIGSLQKKYSIGSFELLSKTAPIQALFLLILGPFVDYYLSGKLITNYKMSSGAILFILLSCSLAVFCNVSQYLCIGRFSAVSFQVLGHMKTVCVLTLGWLLFDSELTFKNIMGMVIAVVGMVIYSWAVELEKQSNAKTLPHAKNSMTEEEIRLLRDGVEKSPLKDVELGEAQG

SEQ ID NO: 1812 - protein, 520 aa, Glycine max
  unsure (1)..(520): unsure at all Xaa locations
MLVLILERSLARRFLNYKKSGRLERLMFYENGXWLDFPKDVVDLVKKDLEVKQAAVEIESNGYHLLFDFLHLXRMDLKTGLQQPIALIDEAGCCFFPEIYAASDEEPYNLSKQEGGKSPDSYASNEIKLHLEVEINGVDQSRLSECSGESNALVKGIQIDTKENCCQYDVEVEDSINKKDCGNVGEDIQQHQDIGLDAYTESVYGKLDLNSVQKMFLKGMCSFGSTDSDIVEIYHCSGASMQARWELFQKQAEITKKNHGEANIRYAWLASSKGELSTMMNYGLSHYGLSGSKCTYGIGVHLAAVTCPDASVRYCDVDENGVRHLALCRVIMGNMEILRPGTDQFHPSSCEYDNGVDAIECPQYYVVWNMNMNTHIYPEFVVSFKVSSDAEGHFCGSEGKNVSGVNSACQGPHGLLHSESSTVDNGKAPSMVASTPKVPKSPWMPFPLLLXAIRNQVPPKGMDVIKIYYEQFRSKHISRDDFVKMLRLIVGDGLLRTTITNLQFKIPSGGELKGSIKKEV

SEQ ID NO: 1813 - protein, 116 aa, Glycine max
MSYYGQQQPPVGVPPQQGYPGKEEYPPAGYPPAGYPPPGQGQGYPPQGYPPQQGGYPPQQGGYPPQQGYPQQGYPQQGYPPQYAQQPPRQQQSSGPSFMEGCLAALCCCCLLDACF

SEQ ID NO: 1814 - protein, 107 aa, Glycine max
YLILSFIIAYQRGSAIGEKHLLVRFAVDRGGLVGPDGSTHYGAFDVTFTACLPNMVVMVASDDAEIFHTVATAAAISDQPCCFRYQKGNGVGVEIPPGNKGIPLEVS

SEQ ID NO: 1815 - protein, 212 aa, Glycine max
MGGCCCCCSSKETVLSAPPAYYYYPRASEEHVPLSSHPGAASAFSGRLLVDTNLDTSSPDTYRPPPAPIPFNVTLGTTQTPPAAQEIRSDKNNTSLPSTNSNAIQEPVARDIHGTSAKLEEPKESECKVQTDLELDSAKGSEIELAKSGKPIDLVEEEDACPICLEEYDAENPKLATNCDHHFHLACILEWMERSETCPVCDQDLVFDPPIE

SEQ ID NO: 1816 - protein, 215 aa, Glycine max
MGGCCCCCSSKETVLSAPPAYYYYPRASEEHVPLSSHPGAASAFSGRLLVDTNLDTSSPDTYRPPPAPIPFNVTLGTTQTPPAAQEIRSDKNNTSLPSTNSNAIQEPVARDIHGTSAKLEEPKESECIVQTDLELDSAKGSEIELAKSGKPIDLVEEEDACPICLEEYDAENPKLATNCDHHFHLACILEWMERSETCPVCDQVSPNHYQFLIYL

SEQ ID NO: 1817 - protein, 213 aa, Glycine max
MGGCCCCCCSAKETVLSAPPAYYYYPRASEEHVPLSSHQGAASAFSGRLLVDTNLDTSSPDTYRPPPAPIPFNVTLGTTQTPPAAQEIRSDKNNTSLHSTNSNAIQEPVAGDNHGTSAKLEELKESDCKVQTDLELDSAKGSEIELAKSGKPIDVVEEEDTCPICLEEYDAENPKLATKCDHHFHLACILEWMERSETCPVCDQDLVFDPPIE

SEQ ID NO: 1818 - protein, 145 aa, Glycine max
  unsure (1)..(145): unsure at all Xaa locations
MSPAEPTRDESVYMAKLAEQAERYEEMVEFMERVAKATGGAGPGEELSVEERNLLSVAYKNVIGARRASWRIISSIEQKEEGRGNDAHAATIRSYRSKIEAELAKICDGILALLDSHLVPSAGAAESKVFYXLKMKGDYHRYLAE

SEQ ID NO: 1819 - protein, 154 aa, Glycine max
MGLSSLPAPSEGVLCVLLVNTVLSISIFKGIVRTILHIVGIHLPSSSTSPSSPDPSQAAPESFEFHLSPSESYIEEFRSRTPTLRLDSVCCSKRLDHDCSVCLTQFEPESEINRLSCGHLFHKVCLEKWLDYWNITCPLCRTPLMPEDDTPCFQ

SEQ ID NO: 1820 - protein, 108 aa, Glycine max
  unsure (1)..(108): unsure at all Xaa locations
MTAPAELSREENVYMAKLAEQAERYEEMVEFMEKVAKTVDSEELTVEERNLLSVAYKNVIGARRASWRIISSIEQKEESRGXEDRVTLIKEYRGXIETELSKICDGIL

SEQ ID NO: 1821 - protein, 122 aa, Glycine max
MAGKGGKGLLAAKTTAAKTAEKDKGKKAPISRSSRAGLQFPVGRIHRQLKQRTQANGRVGATAAVYSAAILEYLTAEVLELAGNASKDLKVKRITPRHLQLAIRGDEELDTLIKGTIAGGGV

SEQ ID NO: 1822 - protein, 589 aa, Glycine max
MGGGGTLVQGIRRLFKRRASSPASDDHNHNNVNANNSRVLVRDLRAQLASIPNTLDPVSDFDFSTLKPIKVPTPIPFRPSSMDHHKKGAQETEFFTEYGEASQYQIQEVVGKGSYGVVGSAIDTHTGEKVAIKKINDVFEHVSDATRILREIKLLRLLRHPDIVEIKHIMLPPSRREFKDIYVVFELMESDLHQVIKANDDLTPEHHQFFLYQLLRGLKYIHTANVFHRDLKPKNILANADCKLKICDFGLARVSFNDAPSAIFWTDYVATRWYRAPELCGSFFSKYTPAIDIWSIGCIFAEMLTGKPLFPGKNVVHQLDLMTDLLGTPPPESIARIRNEKAKRYLNSMRKKQPIPFSQKFPNADPLALRLLERLLAFDPKDRPSAEEALSDPYFTGLANMDREPSTQPISKLEFEFERRKLTKDDVRELIYREILEYHPQMLQEYLRGGDQTSFMYPSGVDRFKRQFAHLEEHYGKGERSTPPLQRQHASLPRERVCAPKDESKQNNDSEKPSGSNLQQSPPGSDETGAQNGTSKPNYSARSLLKSASISASKCVVLKQNKDPEQEPITEVNDEAVDGVTGEIAALHA

SEQ ID NO: 1823 - protein, 314 aa, Glycine max
MYPRLIHPHDGIVTQDELQGGAASNLSHAHKGDPCLVLTADPKPRLRWTQDLHERFVDAVTQLGGASKATPKAIMRTMNVKGLTLFHLKSHLQKYRLGKQSGKDVGEGCKDGSYLLESPGADNTSPKLPTPDTNEGYEIKEALRAQMEVQSKLHLQVEAEKHLQIRQDAERRYMAMLERACKMLADQFISATVIDTDSQKFQGIGSKAPRGTLVDPLGFYSLPSTEVAGVNVPEEEILPSLPPQRADCSTESCLTSHESSGGLALEGSPGEGKRRMLGMDSMAAPLIWSEAKMRTQAINVAQGNLPQGITRYGM

SEQ ID NO: 1824 - protein, 288 aa, Glycine max
MYSRLIHPHDGIVTQDDLQGAASNLSHAHKGDPCLVLTADPKPRLRWTQDLHERFVDAVTQLGGASKATPKAIMRTMNVKGLTLFHLKSHLQKYRLGKQSGKDVGEGCKDGSYLLESPGADNSSPKLPTSDTNEGYEIKEALRAQMEVQSKLHLQVEAEKHLQIRQDAERRYMAMLERACKMLADQFIGATVIDTDSQKFQGIGSKAPRGTLVDPLGFYSMPSTEVAGVNVPEEEIPLSLPPQRADCSTESCLTSHESSGGLALEGSPWRGKKEDARHGLYGSTFDLE

SEQ ID NO: 1825 - protein, 353 aa, Glycine max
  unsure (1)..(353): unsure at all Xaa locations
MATLVEPPNRIKPKGKHYYTIWQTLFEIDTKYVPIKPIGRGAYGVVCSSINRETNEKVAIKKIGNIFENSIDALRTLRELKLLRHIRHENVIALKDVMMPIHKTSFKDVYLVYELMDTDLHQIIKSSQPLSNDHCKYFLXHRDLKPGNLLVNANCDLKICDFGLARTNGVDGQFMTEYVVTRWYRAPELLLCCDNYGTSIDVWSVGCIFAEILGRKPIFPGTECLNQLKLIISVLGSQHESHLEFIDNAKARRFIKSLPYTRGRHFSQLYPQADPLAIDLLQKMLLFDPTKRITVLEALQHPYMACLYDPRCNPPAQVPISLDIDEHWGEPMIREMMWNEMLHYHPEAASTNA

SEQ ID NO: 1826 - protein, 368 aa, Glycine max
MATLVEPPNRIKPKGKHYYTIWQTLFEIDTKYVPIKPIGRGAYGVVCSSINRETNEKVAIKKIGNIFENSIDALRTLRELKLLRHIRHENVIALKDVMMPIHKTSFKDVYLVYELMDTDLHQIIKSSQPLSNDHCKYFLFQLLRGLKYLHSANILHRDLKPGNLLVNANCDLKICDFGLARTNGVDGQFMTEYVVTRWYRAPELLLCCDNYGTSIDVWSVGCIFAEILGRKPIFPGTECLNQLKLIISVLGSQHESHLEFIDNAKARRFIKSLPYTRGRHFSQLYPQADPLAIDLLQKMLVFDPTKRITVLEALQHPYMASLYDPRCDPPAQVPISLDIDEHWGEPMIREMFWNEMLHYHPEAASANA

SEQ ID NO: 1827 - protein, 392 aa, Glycine max
IRHQAPSAVVEHDDAFGASPFLLVTDTGTSAGKLLGYVAKSDWTNHTDKGLRVGDYMAPPPKPVPWNADLNKINEIFESEKSGAVALEKDGEVVDLVVREEVERVKGYPKLVAPATVGADGEFMVGAAVGTREDDKERLEHLVKAGLNVVVLDSSQGNSIYQLEMVKYVKRVYPELDVIGGNVVTMYQAENLIQAGVDGLRVGMGSGSICTTQEVCAVGRGQATAVYKVSSIAYKSGVPVIADGGISNSGHIVKALSLGASTVMMGSFLAGSLEAPGAYVYQNGQRVKKYRGMGSLEAMTKGSDARYLGDTAKLKIAQGVVGAVKDKGSVLNFIPYTLQAVRQGFQDIGANSLQSAHDLLRSRVLRLGGPEWSSTSWKVEFMGLVSYEKKYF

SEQ ID NO: 1828 - protein, 146 aa, Glycine max
MGRGRVQLKRIENKINRQVTFSKRRAGLLKKAHEISVLCDAEVALIVFSHKGKLFEYATDSCMEKILERYERYAYAERQLVANDSESQGNWTIEYTRLKAKIDLLQRNHRHYMGEDLGSMSLKELQSLEQQLDTALKQIRTRRVYI

SEQ ID NO: 1829 - protein, 623 aa, Glycine max
  unsure (1)..(623): unsure at all Xaa locations
MDSPFIYSCFVQNSSPNLHELPVSQCQLEVHNNIQIYAVNNACVIVGGFGSYLLGLNRRTYEQAGVGTEGNNPGSTKEPGIGWMTAFLFVTSFVGLLALVPIRKIMIIDYKLTYPSGTATAVLINGFHTPKGDVMAKKQVHGFLKFFSASFLWAFFQWFYSGGDNCGFVQFPTFGLKAWKNSFYFDFSMTYVGAGMICSHLVNLSLLLGAVISWGIMWPLIRGLKGEWFPASISESSMKSLNGYNGLMLHLVFSKLEMFXYRVVYDITAMNIHATVKRKNPETFSDNQKPLPLDDLRRNEVFARESIPIWLACTGYILFSIVSIIVIPLMFPQLKWYYVVFAYLFAPSLGFCNAYGAGLTDMNMAYNYGKVALFVLSALAGKNDGVVAGLVGCGLIKSIVSISSDLMHDFKTGHLTFTSPRSMLLSQAIGTAIGCVVAPLTFFLFYKAFDVGNPDGDYKAPYAIIYRNMAILGVEGFSALPHHCLQLCYGFFTFAIAANLVRDLGPKKIGKWIPLPMAMAVPFLVGGYFAIDMCMGSLVVFLWHTLNRNEAGLMVPAVASGLICGDGLWILPSSILALLKIRPPICMSFLSAERTLQMKLKLLGVGGLGARRFQCQLELRSSQ

SEQ ID NO: 1830 - protein, 132 aa, Glycine max
  unsure (1)..(132): unsure at all Xaa locations
MVYIKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKNRDLDEEYEGXVEATGEDFSV

SEQ ID NO: 1831 - protein, 115 aa, Glycine max
  unsure (1)..(115): unsure at all Xaa locations
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEXAIFVDAPSAGS

SEQ ID NO: 1832 - protein, 156 aa, Glycine max
MKGRVRWNEDNIGEIEANKPMRQKITEPKTPYHPMLDDDSSPSPVLGDFDGYNGDKNLSPNAEQTGYNNGAYCSRKGTRQSDGWTSSEDEAEETEEDEEDRSLSFREHRKAHYNEFRKVKELQQKASLEDGSDEDNHAEVANGEKKNDSSSPTNGT

SEQ ID NO: 1833 - protein, 143 aa, Glycine max
MDFAPNPCPLRSSSFVNLVERIKQLGTLAVSAVIGNIFSAILTFCFALVGTLLGALTGALIGQETESGFIRGAAVGAISGAVFSIEVFESSLVLWQSDESGIGCVLYLIDVIVSLLSGRLVRERIGPAMFSAVQSQMGAVETS

SEQ ID NO: 1834 - protein, 232 aa, Glycine max
MDFALNPCPLRSSTFVNFVERVKQLGTLAFSAVIGNIFSAILTFCFALVGTLLGALTGALIGQETESGFIRGAAVGAISGAVFSIEVFESSLVLWQSDESGIGCVLYLIDVIASLLSGRLVRERIGPAMLSAVQSQMGAVEASFDEVQNIFDTGGSKGLSGDLVEKIPKIKITTDNNFDASGDRVSCSVCLQDFMLGETVRSLPHCHHMFHLPCIDKWLFRHGSCPLCRRDL

SEQ ID NO: 1835 - protein, 397 aa, Glycine max
  unsure (1)..(397): unsure at all Xaa locations
MACPAMANGNDSLNLKPNETKGKTITCKAAVEYGPGKPFEVKNILIYPPQKMEDQTKVLSSXSFHTDLSSWPGMNEAQSAYPGILDPEASGIVKSXGDERFRSGLISICCAYSTDEKIXSVSVGNKLMCNAWIIGWLILIYVRVETGQFKSSLSYGAPXFHLFKTSTFLEHMVEDSSXVVKFLYTYHSLSIKNLTLLSCGVSTGVGAAWNTANVHSGSTVAVFGLGAVGLAVAEGARARGASKIIGVDINPDKFIKAMGVTNFINPKDEEKPVYERIREMTDGGVHYSFECTGNVDVLRDAFLSAHEGWGLTVVLGIHASPTLLPIHPMELFDGRNIVGSVFGGFKGRSHLPHFAKQCGQGVVKLDNFITHELPLEEIDKAFDLLITGKSLRCLLHF

SEQ ID NO: 1836 - protein, 137 aa, Glycine max
MGLSNFPISASEGVLPVLVINTVFSVALLKSMFRSMLQVVLGGSAAANGSNIEHDDEISSSSSWERRVSITQYKSLCHSHDIGGTSMAMVECCVCLCRFEANQEVSELPCKHYFHRGCLDKWFDNKHTTCPLCRSID

SEQ ID NO: 1837 - protein, 282 aa, Glycine max
  unsure (1)..(282): unsure at all Xaa locations
MSQRSVPAPFLTKTYQLVEDQGTDQVISWGESGNTFVVWKHADFAKDLLPKYFKHNNFSSFVRQLNTYGFRKIVPDKWEFANEHFKRGQKELLSEIKRRKTVPQSSAHPPEAGKSGGDGNSPLNSGSDDAGSTSTSSSSSGSKNQGSVETNTTPSHQLSSENEKLKKDNETLSCELARARKQCDELVAFLRDRLMVGPDQIDRIMRQGSCGSENVVGEGGGGXCLKLFGVWLKGDTLTDKRNNHKRGREDQMGFGGPRLKESKPVVDFSRNRMMMINEKGKG

SEQ ID NO: 1838 - protein, 383 aa, Glycine max
MEVPEMEGKTESHVTSAEAFVEGGVQEACDDACSICLEDFCKSDPATVTNCKHEFHLQCILEWCQRSSQCPMCWQPISLRDTTSQELLEAVELERSLRDTPSRNAAIFHHPALGDFELQHLPMAMNEADIEERIIQHLTAAAAMRRSHHLGQREGHRTRSSAHGRPHFLVYSTQPSAPPFAAGGESEPAAIPVGIPSTPLTFDGNEQSSPQQIPIPQTRGSSLTSGSTVATTNLQGVHSNDRRFASHSFPASQDRAQPSEQSFSDSLRSRFNAVSTRYKESISKGTRGWKERLFSPNSSMSELGSEVKRELNAKIASVSRLMERLETTRENNRAAGTSLSNPNHLVNCSIAETSNQNNVEARGENSLRDNSTPTTFSASSDSK

SEQ ID NO: 1839 - protein, 165 aa, Glycine max
RIEPRYQEMLSKDIAETMIDGIKVRVIAGEALGIKSPIYTRTPTMYLDFTLKPGAHLQQLIPKSWNAFVYILEGEGVFGNQKSQPVTSHHILLLGPGDGLEAWNKSSKVLRFILVGGEPLGEPLVQCGPCVMNSQEEIDHTIDDFEYFANGFEMARHWTSESQIN

SEQ ID NO: 1840 - protein, 85 aa, Glycine max
MDPKLKEVSQLFDRFKASFIRNDFDTCSNLLSQLKVLLTGFRSLPPLFADTPNAVHELTIARDIYEHTQCTWMRITQIRSAVPSL

SEQ ID NO: 1841 - protein, 251 aa, Glycine max
MGTQTMGTHGGGGDSNGKQSPLQPLVRQNSMYSLTLDEVQNQLGDLGKPLTSMNIDELLKNVWTAEASQTIGMDNEGTAQASQASLQRQASLSLTGALSKKTVDEVWRDIQQNKIVGEKKFQDRHPTLGEMTLEDFLVKAGVVADNQMAMPSSLMGTMSDTQTPGRKKSTSEDMIEKTVERRQKRMIKNRESAARSRARKQAYTNELENKVSRLEEENERLRKRKELEQMLSCAPPPEPKYQLRRIASAPF

SEQ ID NO: 1842 - protein, 97 aa, Glycine max
LFYTTPGGNLPNGTNAITSKSKFDEKIESSSAKMYFHYYGQLLHQQNMLQDYVRTGTYYAAVLENRADFVGRVVIDVGAGSGILSLFAAQAGAKHVY

SEQ ID NO: 1843 - protein, 736 aa, Glycine max
  unsure (1)..(736): unsure at all Xaa locations
MLFRDSMFQPIGGVNGQQNVFTNSAPSNTSESQNNTVRLGTNTAVXLSLHAQKFFTKLENQALVKGVPIGQALDIHIPPPRPKRKPNNPYPRKTRIGTTSLHSGAKDGKLNLVESSHVNQALDLKKEPLSQKHDLEEGLTTLKENIDENHAKVFTLLQEVPCSXAVSSMSTGEAPALKAEQEKTTLQNPPLQDQMLDPEYSEAQQAQHSASKSPAAILSDSESGDAKLNTWLEDTDDEHIKTIPEHQASGIEWGXTPDGMQGNQNYPRHVTVHVVDGNLGTNTQNPSQDMLFRDSMFQPIGGVNGQRNVFTNTAPSNTSESQNNTARSSVHQSFLPYPPFTQHNQDDYQSFLHMSSTFSNLIVSTLMQNPAAHAAASFAATFWPYANPETSANSPRCSQGGFTNRQIGSPPSVAAIAAATVAAATAWWAAHGLLPLCAPLHTSFACPASVTTVPSMNTGEAPALKAEQEKTTLQNPPLQDQMLDPEYSEAQQAQHSASKSPAAILSDSESGDAKLNTSSKVTDHETNKTISEHLDSNKTKGRKPVDRSSCGSNTASSSDVETDALEKGEKGKEEPEIPDANQLAIEFSNRRRSVSNLTDSWKEVSEEGRLAFQALFSREVLPQSFSPPHALKNTDHQMDNANDNKQNIDDKDEDLDGSKKCSSNYEAMQKNLLFVENNEGLLTIGLGQGKLKTHRTGFKPYKRCSMEAKENRVGASSNQGEEQGCKRIRLEGETST

SEQ ID NO: 1844 - protein, 195 aa, Glycine max
  unsure (1)..(195): unsure at all Xaa locations
MSKARVYTDVNVLRPKEYSDYESLTLQWGDQDDYEVVRKVGRGKYSEVFEGINVNSNERCIIKILKPVKKKKIKREIKILQNICGGPNIVKLLDIVRDQHSKTPSLIFEYVNSTDFKVLYPTLTDYDIRYYIYELLKALDYCHSQGIMHXRDVKPHNVMIDHELRKLRLIDWGLAEFYHPAKEYNVRVASRTLRA

SEQ ID NO: 1845 - protein, 334 aa, Glycine max
  unsure (1)..(334): unsure at all Xaa locations
MSKARVYTDVNVLRPKEYWDYESLTVQWGDQDDYEVVRKVGRGKYSEVFEGINVNSNERCVIKILKPVKKKKIKREIKILQNLCGGPNIVKLLDIVRDQHSKTPSLIFEXVNSTXDFKVLYPTLTDYDIRYYIYELLKAIDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDELNAYLNKYHLELDPQLDALVGRHSRKPWSKFINADNQHLVSPEAIDFLDKLLRYDHQDRLTAREAMAHPYFSQVRAAESSRMRTQ

SEQ ID NO: 1846 - protein, 333 aa, Glycine max; identical to SEQ ID NO: 967

SEQ ID NO: 1847 - protein, 433 aa, Glycine max
MGGKSSKGSGRRYDFGASSSSRDNNYGGYHPQSPYPSYQTPQHPRASAPFYDYAQPKRKLDKKYSRIADNYRSLDEVTAALANAGLESSNLIVGIDFTKSNEWTGKRSFNRKSLHDIRSGQNPYEQAISIIGKTLSAFDEDNLIPCFGFGDASTHDQDVFSFYSEERFCNGFEEVLTRYRQIIPSLKLAGPTSFAPIIEMAMTIVEQSGGQYHVLLIIADGQVTRSVDTQNGNLSPQEQNTIDAIVKASEYPLSIVLVGVGDGPWEMMREFDDNIPSRAFDNFQFVNFTEIMTRNVDSTRKETDFALSALMEIPSQYKATLELGILGSRRGHSPDRVALPPPLYSRTSSSISTKSTRSNSFQQRTPTHTSYDSSVHTETSSSSLYDNKVCPICLTNAKDMAFGCGHQTCCECGEDLQFCPICRSTIHTRIRLY

SEQ ID NO: 1848 - protein, 448 aa, Glycine max
  unsure (1)..(448): unsure at all Xaa locations
MILVLFHLHGIITMGGYHPQSPYPFYQTPKHPRASAPFYDYGQPKRKLDKKYSRIADNYRSLDEDTAALANAGLESSNLIVGIDFTKSNEWTGKRSFNRKSLHDIRSGQNPYEQAISIIGKTLSAFDEDNLIPCFGFGDASTHDQDVFSFYSEERFCNGFEEVLTRYRQIIPSLKLAGPTSFAPIIEMAMTIVEQSGGQYHVLLIIADGQVTRSVDTQNGNLSPQEQNTIDAIVKASEYPLSIVLVGVGDGPWEMMREFDDNIPSRAFDNFQVWYNSPSRFYLPYLNLPVILNVIFLFGWMXFVNFTEIMTRNVDSTRKETDFALSALMEIPSQYKATLELGILGSRRGHSPDRVALPPPLYSRTSSSISTKSTRSNSFQQRTPTHTSYDSSVHTETSSSWLQVCPICLTNAKDMAFGCGHQTCCECGEDLQFCPICRSTIHTRIRLY

SEQ ID NO: 1849 - protein, 243 aa, Glycine max
MLMKRDVESGGDGNANPRPLYPAMLENPQLRWAFIRKVYTILTIQLLLTIAVASVVVFVRPIALFFVSSPGGLALYIVLLIAPLITVCPLYYYHQKHPLNYILLFIFTVTLAFAVGLTCAFTSGRIILESVILTTIVVVSLTLYTFWAAKRGHDFNFLGPFLFGALLVLMLFAFIQLLFPLGRISTMIYGVLASIIFSGYIIYDTNNLIKRYTYDQYIWASVALYLDVINLFLSLLTIFRAVN

SEQ ID NO: 1850 - protein, 354 aa, Glycine max
MGEGERFQLGTVGALTLSVVSSVSIVICNKALMSSLHFIFATTLTSWHLLVTFCSLHVALKMRFFEHKPFEQKAVMGFGILNGISIGLLNLSLGFNSVGFYQMTKLAIIPCTVLLETIFLGKRFSKRIQFALSILLLGVGIATVTDLQLNALGSFLSFLAVITGCVAQIMTNTIQKKYKVSSTQLLYQSCPYQAATLLIAGPYLDKLLTNQNVFGFKYTTQVTVFIILSCLISISVNFSTFLVIGKTSPVTYQVLGHLKTCLVLAFGYILLRDPFSWRNILGILIAMIGMILYSYYCTLENQQKTVEAASQSSQCFQAREDESDPLMNVENGSAVVSSNVGQRQMSPVWSKSKD

SEQ ID NO: 1851 - protein, 351 aa, Glycine max
MGEGERFQLGTVGALTLSVVSSVSIVICNKALMSSLHFIFATTLTSWHLLVTFCSLHVALKMRFFEHKPFEQKAVMGFGILNGISIGLLNLSLGFNSVGFYQMTKLAIIPCTVLLETIFLGKRFSKRIQFALSILLLGVGIATVTDLQLNALGSFLSFLAVITTCVAQIMTNTIQKKYKVSSTQLLYQSCPYQAATLLIAGPYLDKLLTNQNVFGFKYTTQVTVFIILSCLISISVNFSTFLVIGKTSPVTYQVLGHLKTCLVLAFGYILLRDPFSWRNILGILIAMIGMILYSYYCTLENQQKTVEAASQSSQAREDESDPLMNVENGSAVVSSNVGQRQMSPVWSKSKD

SEQ ID NO: 1852 - protein, 355 aa, Glycine max
  unsure (1)..(355): unsure at all Xaa locations
MDRMSQQGHYFHSESMHFTSTNICLPNICPVVTSSGNGTILDCHYILDAHDSYLGRHFQPAAPLWPDQQLNSYNNDGHALAWHLSLPMPYVQALSANGSSSENARIGPQRYHDTTGSRSGHRFPHPPPQYHSFHQHAQEIRGHSFYFHPPVIAPLYRVPTNPSRSSSILIHDAIEIGARHPGHVPFVGARIHQSHRGNMHEATLNLHVSLFLHAHLLATTFFLTNSYFGCYXLVDHHNDMRLDIEDMSYEELLALGERIGKVNTGLSEEMITSQMKTKTYLLLPTNAINLEEAASEEQENDSCIICQDEYKSQEKIGILQCGHEYHADCLKKWLLVKNVCPICKSEALTPGEKCV

SEQ ID NO: 1853 - protein, 729 aa, Glycine max
  unsure (1)..(729): unsure at all Xaa locations
MDDERDFELLFYSWNNKNPTDQLFIISFLVAALVGILTIAYTAFQWRRNINLSWMKAIARSKKNPKARHXFLPWQIRVEVDGDEIEVLELAEGVXCCKYLKLHGRCRIVAXEDERCCTCGAVAHLSCSSSAHKDCKCVSMIGYERVTHQWTVCWTDVADQPDETALCSYCEELCAXGLFLSGPPIWSIMWCHPXGSGDFRSPLAHETDXICDLGQFRRLILSPLYVKELNWNLPXGGFLSSITHGAXNEIASSVRASIRNQSKKYKHGNEPSVESGNSESIGEVSTESTGEFSSNXNGHHEVGEKSSSNKGVRHQDSELDNKLDRKPTLRRNSSINQKDESHSLGVKQKYDLIDLPLDARPLLVFINKKSGAQRGDSLRMRLNILLNPVQVFELSSTQGPEMGLYLFRKVSHFRVLVCGGDGTVGWVLNAIDKQNFVSPPPVAILPAGTGNDLARVLSWGGGLGPVERQGGLTTFLQHIEHAAVTVLDRWKVTISNPQGKQQLQPTKFLNNYLGIGCDAKVALDIHNLREENPDKFYNQFMNKVLYAREGAKSIMDRTFADLPWQIRVEVDGVEIEVPEDAEGVLVANIGSYMGGVDLWQNEDENYDNFDQQSMHDKILEVVSISGTWHLGKLQVGLSRARRLAQGQSIKIQLFAMFPVQIDGEPWFQQPCTINITHHGQAFMLKRVAEEPLGPASAIIAEVLENAETHNVINASQKRALLHEMALRLS

SEQ ID NO: 1854 - protein, 153 aa, Glycine max
  unsure (1)..(153): unsure at all Xaa locations
MENGGSKGDVPEDANAHCPGTQSEEAGKADSCAGCPNQQICATXPKGPDPDLVAIAERMATVKHKILVLSGKGGVGKSTFSAQLSFALAEMDHQVGLLDIDICGPSIPKMLGLEGQDIHQSNLGWSPIYVESNLGVMSIGFMLPNPDDAVIWR

SEQ ID NO: 1855 - protein, 127 aa, Glycine max
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNIHQHLLPKKASSSKA

SEQ ID NO: 1856 - protein, 188 aa, Glycine max
CLSYCSALLYMKGYQSLQVYRVAHALWGQGRKVLASALQSRVSEVVFALGKKNGEIFRKGIIFVADDPTLYFLYCRFLELIYIQGVTFGGTGKETGDRHPKISEGVLIGAHATILGNITIGECVMIAAGSLVLQEVPPHSIVAGVPAKVIGRVHEHYPSLTMQQDENKHLSEEFFYSKDETTENYYIN

SEQ ID NO: 1857 - protein, 84 aa, Glycine max
RDASGNVVEKIVERRQKRMIKNRESAARSRARKQAYTQELEIKVSQLEEENERLRRQNEIERALPSAPPPDPKHQLRRTSSAPL

SEQ ID NO: 1858 - protein, 52 aa, Glycine max
MMIINMHYHLISGLDPILAYTAGAEIEQLQWTSSQPDWVAIAFSTKLQILRV

SEQ ID NO: 1859 - protein, 172 aa, Glycine max
LGYATCPYRSYLSINLSTERKGVFINPAFIEPFGLTLIEAAAHGLPIVATKNGGPVDIHRVLDNGLLVDPHDQQSIADALLKLVSNKQLWAKCRQNGLKNIHLFSWPEHCKTYLSKIATCKPRHPQWQRSEDGGESSKSDSPGDSLRDLQDLSLNLKFSLDGEKSEGSGNDN

SEQ ID NO: 1860 - protein, 371 aa, Glycine max
MGKKKKRVSSKVWCYYCDREFDDEKILVQHQKAKHFKCHVCHKKLSTAGGMAIHVLQVHKESVTKVPNAKPGRESTDIEIYGMQGIPPDILAAHYGEEEDDVPSKAAKVDIPPTQLVGGMIPPPLGTGYPPRPTLPTMPPMYNPAVPVPPNAWMVPPRPQPWFSQPPAVSVPPAAPYTQQPLFPVQNVRPPLPATAPALQTQITPPGLPTSAPVPVSQPLFPVVGNNHTTTQSSTFSAPPLPSSVPSVTSVMSANVPVDTHLSSNSSVTSSYQAIGIPGGAASNSHSYASGPNTGGPSIGPPPVIANKAPATQPATNEVYLVWDDEAMSMEERRMSLPKYQVHDESSQMSSIDAAIDKRILESRLAGRMAF

SEQ ID NO: 1861 - protein, 172 aa, Glycine max
QTQITPPGLPTSAPVPVSQPLFPVVGNNHTTTQSSAFSAPPLPSSVPSVTPVMSTNVPVDTHLSSNSSVTSSYQAIGVPGGAASNSHSYASGPNTGGPSIGPPPVIANKAPAPQPATNEVYLVWDDEAMSMEERRMSLPKYQVHDESSQMSSIDAAIDKRILESRLAGRMAF

SEQ ID NO: 1862 - protein, 312 aa, Glycine max
MGKKKKRVSSKVWCYYCDREFDDEKILVQHQKAKHFKCHVCHKKLSTAGGMAIHVLQVHKESVTKVPNAKPGRESTDIEIYGMQGIPPDILAAHYGEEEDDVPSKAAKVDIPPTQLVGGMIPPPLGTGYPPRPTLPTMPPMYNPAVPVPPNAWMVPPRPQPWFSQPPAVSVPPAAPYTQQPLFPVQNVRPPLLATAPALQTQITPPGLPTSAPITVFQPLFLVIYNNHTTTQISTFSALPLPSRLPLVTLVMSANVVVDQFLCSYSTVSSRIHALGIPRDGHIIILPYAFWPEHLVTSILMLLVLILVASFN

SEQ ID NO: 1863 - protein, 210 aa, Glycine max
  unsure (1)..(210): unsure at all Xaa locations
LARQKKQLESETAQRVNKRRLERERGRREATADMSEDLSEGEKGDPVSDVSAHGGDAANNRARLPRISSADAMETWANSQKGKKLYIVLISIHGLIRGENMELGRDSDTGGQVKYVVELARALGSMPGVYRVDLLTRQVSAPDVDWSYGEXPTEMLSPRDTDDFGDDMGESSGSYIVRIPFGPRDKYIPKELLWPYIPEFGXGALNHIIQ

SEQ ID NO: 1864 - protein, 1062 aa, Glycine max
  unsure (1)..(1062): unsure at all Xaa locations
MAGNYWLNSYLEAILDVGPGLDDAKSSLLLRERGRFSPTRYFVXEVIGFDETDLYRSWVRASSTRSPQERNTRLENLCWRIWNLARQKKQLESEAQFWVNKRRLERERGRKEATADMSEDLSEGEKGDPLSDLSAHGGVGDFNRSRLPRISSADAMETWAMASEESQXQAPQRAVHYRTHHEREAGGGGAEMGPEGEKGQGGEGQLGSLPGVSPRRGGNIXMSSSETDXSEMGRKGLLFPRDTEDFRDDTQKISGLNMKKVVVGXEDLNIFAKNFSXHYITEFLNVALNDIIQMSXLLVKRLTASIEVXPVGIQGHYADXAGDSAALXLSGSLNVLMLFTGYFLGKVKFLLFLTQGRLSKDAINXSYKFMCILKGQKAAFEGSSIVITNILGGVEEQWRLYDGFDPVLERKLRARIRRNVSCYGRFMPRMATIPPGMEFHHIVPHDGDIEGEPEGNLDHPAPQDPPIWSEIMRFFTNPRKPMILALARPDPKKNITTLVKAFGECRPLQELANLTLIMGNRDGIDEMSSTNASVLLSVLKLIDKYDLYGQVAYPKHHKQYDVPDIYRLAAKTKGVFINPAFIEPFGLTLIEAAAHGLPIVATKNGGPVDIHRVLDNGLLIDPHDQQSIADALLKLVSNKQLWAKCRQNGLKNIHLFSWPEHCKTXKLPSCKCHAIRQPQHQRSDGGESGCXYSRVDRKSGLSHWMLNIENHFSREKSEGSGNDNSLNSDGNAADRGAKLENAVLSWSKGISKDTRRGGATEKSDQNPNAGKFPPLRRRKHLFVIAVDCDTTSSLLETIKAIFESAGKDRAESTVGFILSTSLTISEIQSFLISGGLSPIDFDAYICNSGSDLYYPSLNPGDRPFVVDLYYHSHIEYRWGGEGLRKTLVRWADSITDKKGDNDEQIVSPAEQLSTDYCYAFKVRKPGMAPPVKELRKLLRIQALRCHPIYCQNGTRLNVIPVLASRSQALRYLYVRWGFELSKMVVFVGECGDTDYEGLLGGLHKSVILKGVGSSAISQLHNNRSYPLSDVTPLDSPNIVEATEGSSGADIQALIEKVGYLNG

SEQ ID NO: 1865 - protein, 219 aa, Glycine max
  unsure (1)..(219): unsure at all Xaa locations
ELTAPFVYFTSIINSATSYLLVRFFTGFSLATFVSTQFWMSSMFSAPVVGSANGLSGGWGNLGGGATQLIMPLVFSLIRDIGATKFTAWRIAFFVPAMFQMLTAFSILIFGQDMPDGNFRRLKKSGEKAKDDFSRVLYHGVTNYRGWILALTYGYCFGVELTIDNIIAEYFYDRFNLKLHTAXGIIAARLGLAYIFSKAGGGIYLDVWRKRXMKGKLWA

SEQ ID NO: 1866 - protein, 162 aa, Glycine max
  unsure (1)..(162): unsure at all Xaa locations
TAITYFRRVYTRKSMSEYDPRLVAPACLYLASKVEESTVQARLLVFYIKKMCAGSDDKYRFEIKDILEMEMKLLEALDYYLVVYHPYRPLLHLLQDAGVTDLTQFAWGXVNDTYKMDLILVQPPYMIALACIYIASVLKDKDTTSWFEELHVDXNIVKXXSM

SEQ ID NO: 1867 - protein, 80 aa, Glycine max
SGTYLAVAGSDIRVYQVANVKTEWNLIKTLPDLSGTGKVTSAKFGTDAKYIAVGSMDRNLRIFGLPGDDQMDDDAKPSAE

SEQ ID NO: 1868 - protein, 424 aa, Glycine max
MGNSEDEKSVKTGSPSSSPATTDQTNQPNIHVYPDWAAMQYYGPRVNIPPYFNSAVASGHAPHPYMWGPPQPMMPPYGPPYAAFYSHGGVYTHPAVAIGPHLHGQGVSSSPAVGTHSSIESPTKLSGNTDQGLMKKSKGFDGLAMSIGNCNAESAEHGAENRQSQSVDTEGYSDGSDGNTAGANQTKRKRCREGTLTTDGEGKTELQNGPASKETSSSKKIVSATPASVAGTLVGPVVSSVMATTLELRNPSTVDSKANSTSAPQPCAIVPNETCLQNERELKRERRKQSNRESARRSRLRKQAETEELARKVDMLTAENVSLKSEIIQLTEGSEQMRMENSALREKLRNTQLGQREEIILSSIESKRAAPVSTENLLSRVNNSSSNDRTTENENDFCENKPNSGAKLHQLLDTNPRADAVAAG

SEQ ID NO: 1869 - protein, 424 aa, Glycine max
MGNSEEEKSVKTGSPSSSPATTEQTNQPNIHVYPDWAAMQYYGPRVNIPPYFNSAVASGHAPHPYMWGPPQPMMQPYGPPYAAFYSHGGVYTHPAVAIGPHSHGQGVPSSPAAGTPSSVESPTKFSGNTNQGLVKKLKGFDELAMSIGNCNAESAERGAENRLSQSVDTEGSSDGSDGNTAGANQTKRKRSREGTPITDAEGKTELQNGPASKETASSKKIVSATPASVAGTLVGPVVSSGMATALELRNPSTVHSKANSTSAAQPCAVVRNETWLQNERELKRERRKQSNRESARRSRLRKQAETEELARKVEMLTAENVSLKSEITRLTEGSEQMRMENSALREKLINTQLGPREEITLSSIDSKRAAPVSTENLLSRVNNSGANDRPAENENDICETKPNSGAKLHQLLDTNPRANAVAAG

SEQ ID NO: 1870 - protein, 136 aa, Glycine max
  unsure (1)..(136): unsure at all Xaa locations
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIXDGKSRXSID

SEQ ID NO: 1871 - protein, 212 aa, Glycine max
MRTLCDVCESAAAILFCAADEAALCSACDHKIHMCNKLASRHVRVGLADPTDVPRCDICENAPAFFYCEIDGSSLCLQCDMIVHVGGKRTHGRYLLLRQRAQFPGDKPAQMEELELQPMDQNESRRDESQSLKLKTRDSQQNHSVSPFPRQENNIDGHGKMDKKLIDLNTRPLRLNGSAPNNQEQCMDILRGNNHESASVPPVESFKQESEK

SEQ ID NO: 1872 - protein, 187 aa, Glycine max
  unsure (1)..(187): unsure at all Xaa locations
MEVRTNEVAKQRIEDEGYRAHNNPFGLNLFLFSSFCQPYMASLATVQDERCVQRSYWIEHTTDLSVESMMLDSNASDLDKEERPEVLSLLPAYEGKSVVELGAGIGRFTGELAKKAGQLLAVDFIESAIKKNESINGHHKNVKFMCADVTSXTCIFLKXSVDLXVSXWLLMYLSDKEVENLAXRMIK

SEQ ID NO: 1873 - protein, 236 aa, Glycine max
ESVFGQGFVSTGGLETTKEFVAKLGLKPGQKVLDVGCGTGGGDIYMAENFDVEVVGIDLSINIISLAIERAIGLKCCVEFECADCTKKTFPVNTFDVIYSRDTLLHIKDKPSLFRSFYKWLKRGGTLLITDYCKSEGSLSLGYAEYIKKGGYYIHDMKTYCRMLENAGFDDVVAEDRTNLFMKTLQQELNALHSKKDDFIDDFSEEDYNEITERWKAKQMRGADGEQIWSLFIAKK

SEQ ID NO: 1874 - protein, 106 aa, Glycine max
  unsure (1)..(106): unsure at all Xaa locations
XGGALIQQFMXLTFGSLXNSTPYLGGILLLIVSAWLAAAKSLDTQFTALRKEEELEKEMERAATVXIPXVVAEXEXGNGXXXXGSPXNPSSGDSSXSPXEXXTPXN

SEQ ID NO: 1875 - protein, 623 aa, Glycine max
MDAVVQTRGLLSLPTNPKTRVSHHLHPSHGLKHRFLSLKPKPLSAPSLSAAAAKFHPFGPKPQNLFICRAEAAAAADGPAQPAFGEAEVAEKPKLLGIEITTLKKIIPLGLMFFCILFNYTILRDTKDVLVITARGSSAEIIPFLKTWVNLPMAVGFMLLYTKLSNVLSKQALFYTVILPFIAFFGAFGFVLYPLSNYIHPEAFADKLLNILGPRFLGPLAIMRIWSFCLFYVMAELWGSVVISVLFWGFANQITTIEEAKRFYPLFGLGANVALIFSGRTVKYFSNLRQNLGPGVDGWAISLKAMMSIVVGMGFAICFLYWWVNNYVPLPTRSKKKKEKPKMGTMESLKFLVSSKYIRDLATLVVAYGISINLVEVTWKSKLKAQFPSPNEYSSFMGDFSTATGIATFTMMLVSQFIFDKYGWGVAATITPTVLLLTGVGFFSLILFGGPLAPGLASIGMTPLLAAVYVGALQNIFSKSAKYSLFDPCKEMAYIPLDEDTKVKGKAAIDVVCNPLGKSGGALIQQFMILTFGSLANSTPYLGGVLLLIVSAWLAAAKSLDTQFTALRKEEELEKEMERAAAVKIPVVAETESGNGSLATGSPLNPSSGDSSSSPSEASTPRN

SEQ ID NO: 1876 - protein, 623 aa, Glycine max
  unsure (1)..(623): unsure at all Xaa locations
MDAVVQTRGLLSLPTNPKTRVSHHLHPSHGLKHRFLSLKPKPLSAPSLSAAAAKFHPFGPKPQNLFICRAEAAAAADGPAQPAFGEAEVAEKPKLLGIEITTLKKIIPLGLMFFCILFNYTILRDTKDVLVITARGSSAEIIPFLKTWVNLPMAXGFMLLYTKLSNVLSKQALFYTVILPFIAFFGAFGFVLYPLSNYIHPEAFADKLLNILGPRFXGPLAIMRIWSFCLFYVMAELWGSVVISVLFWGFANQITTIEEAKRFYPLFGLGANGALMFSGRTVKYFSNLRQNLGPGVDGWAISLKAMMSIVVGMGFAICFLYWWVNNYVPLPTRSKKKKEKPKMGTMESLKFLVSSKYIRDLATLVVAYGISINLVEVTWKSKLKAQFPSPNEYSSFMGDFSTATGIATFTMMLVSQFIFDKYGWGVAATITPTVLLLTGVGFFSLILFGGPLAPGLASIGMTPLLAAVYVGALQNIFSKSAKYSLFDPCKEMAYIPLDEDTKVKGKAAIDVVCNPLGKSGXALIQQFMILTFGSLANSTPYLGGVLLLIVSAWLAAAKSLDTQFTALRKEEELEKEMERAAAVKIPVVAETESGNGSLATGSPLNPSSGDSSSSPSEASTPRN

SEQ ID NO: 1877 - protein, 174 aa, Glycine max
  unsure (1)..(174): unsure at all Xaa locations
PPHEAAGIVESVGEXVTDVQPGDHVIPCYQAECKECKFCKSGKTNLCGKVRSATGVGVMMNDMKSRFSVNGKPIYHFMGTSTFSXYTVVHDVSVAKINPQAPLDKVCLLGCGVPTGLGAVWNTAKVESGSVVAVFGLGTVGLAVAEGAKAAGASRVXGIDIDNKKFDVAKNFGV

SEQ ID NO: 1878 - protein, 76 aa, Glycine max
  unsure (1)..(76): unsure at all Xaa locations
ESTLISERSRCCLKGRESFVYIAXLAEQAARYDEMVESMKNVANLDVELTVEERTLLSVGYKHVIGARRASWRILS

SEQ ID NO: 1879 - protein, 449 aa, Glycine max
  unsure (1)..(449): unsure at all Xaa locations
SRFPDIRKTNGNSVIELASTPTKISGVHYVQGVVIFHDVFDNEYDVGGSQIRIEGVYIWPFRQLRMVANRTRGGDLNQNEDYILSNPYHLLGVFSSQVLQDSSRDKMWRRKHSLIHDMEKHCNIEIAAQISHLPSQNNEGEHDHFHLEGLMESPSADDDGDCFSPLLLNATSVKIEVYYNKAVNYTLMVTFVSFLQVLLLIRQMEHSSTQSGAAKVSILMIGQQAIMDAYLCLLHLTAGIXLVESLFNAFATAAFFKFVVFSIFEMRYLLAIWKANRPLSNGEGWETMRRELSVLYSXSIITNVIRDSRKPLHPHYILGITVTRLAIPLYIFGCPNNFMRIKPDKSWCVCLAVFIGLQAAILLLQHYLGSRWFIPREILPEKYSYYRRVDQDTRHATDCVICMTAIDLSPRSNDCMVTPCDHFFHSGCLQRWMDIKMECPTCRRPLPPA

SEQ ID NO: 1880 - protein, 147 aa, Glycine max
  unsure (1)..(147): unsure at all Xaa locations
MAVSSREDYVYMAKLSEQAERYEEMVEFMEKLSAAADGTELTVEERNLLSVAYKNVIGARRASWRIISSIEQKEESRGNEDRVKTIRDYKAKIESELAGICDGILKLLESALVPSAASEDSKVFYLKMKGDYYRYLAEFKIGXERDD

SEQ ID NO: 1881 - protein, 91 aa, Glycine max
MSYYNQQPPVGAPPPQGYGDKAGYPPPGYPPAGYPPPAQGYPPAGYPQQGYPPQYAQQPPPHQQQQQSSGPSFMEGCLAALCCCCLLDACF

SEQ ID NO: 1882 - protein, 241 aa, Glycine max
  unsure (1)..(241): unsure at all Xaa locations
HLCLFRLPDDFDKPEFATVNIQRDLFYGYDTLMENVSDPSHIEFAHHKVTGRRDRAKPLPFKMDSRGSWGFSGANEGNPQISAKFVAPCYMMNKIQIDTKLPVVGDQKWVVWICSFNVPMAPGKTRSIVCSARNFFQFSVPGPAWWQVVPRWYEHWTSNXVYDGDMIVLQXQEKIFLSXTKEGGDINKQYTNITFTPTQADRFVLAFRNWLRRHGNGQPEWFGNSSDQPLPSTVLSKRQVQ

SEQ ID NO: 1883 - protein, 193 aa, Glycine max
MARSQQRYRGVRQRHWGSWVSEIRHPILKTRIWLGTFETAEDAARAYDEAARLMCGARARTNFPFNPNVSHSSSSKLLSATLTAKLHRCYMASLQMTRQALASESQRMAPPNATTSTTSNNFMKSNQTHAVLLPHKRQEEEQEAEANWVFKKVKVENAQQFKPLEEDHIEQMIEELLDYGSIELCSVISPQAL

SEQ ID NO: 1884 - protein, 157 aa, Glycine max
MASTKKITLKSSDGEAFEVEEAVAVAVESQTIKHMIEDNCADSGIPLPNVTSKILAKVIEYCKKHVEANCADEKPSEDELKAWDADFVKVDQATLFDLILAANYLNIKSLLDLTCQTVADMIKGKTPEEIRKTFNIKNDFTPEEEEEVRRENQWAFE

SEQ ID NO: 1885 - protein, 128 aa, Glycine max
MAGKGGKGLLAAKTTAAKGAADKDKDKKKAPVSRSSRAGIQFPVGRIHRQLKQRVSANGRVGATAAVYSAAILEYLTAEVLELAGNASKDLKVKRITPRHLQLAIRGDEELDTLIKGTIAGGGVIPHI

SEQ ID NO: 1886 - protein, 315 aa, Glycine max
  unsure (1)..(315): unsure at all Xaa locations
MVLLSKATTEQYSYIKNCMPHTKSSTIPIVDLSKPDAKTLKLXLVLWEFGFFKVINHGVSMEAISELEYEAFKFFSMSLNEKEKVGPPNPFGYGSKKIGHNGDVGWFSVYGKNPEKFRCLLNSYMSSVRKMACEILELMAEGLKIQQKDVFSKLLMDKQSDSIFRVNHYAACPEMTLNDQNLIGFGEHTDPQIISLLRSNNTSGLQIYLRDGNWISVPPDDKSFFINVGDSLQVMTNGRFRSVRHRVLANGFKSRLSMIYFGGPPLSEKIAPLSSLMKGKESLYKEFTWFEYKKSIYGSRLSKNRLEHFERIAAS

SEQ ID NO: 1887 - protein, 575 aa, Glycine max
MEVLLLCGQERHTKRAFVSFPVFLPRLSLCLCYLLRSSLLLSNMALVNPFLCTTRTSLPLRVSGPPNQVLPRWTLCSQYSFKTSSLRSKQLRCGATADIKADHAVLVGPTSEEERKGDYDWTQEWYPLYLTQNVPEDAPLGLRVFDKQLVLFKDGNGQFRCYEDRCPHRLAKLSEGQLIDGRLECLYHGWQFEGEGKCVKIPQLPADAKIPRAACVKTYEVRDSQGVIWVWMSLKTPPNVSKLPWFENFARPGFQDVSTIHELPYDHSILLENLMDPAHIPISHDRTDWTAKREDAQPLCFEVTERTDRGFAGWWGREKDGSMPNFLRFEAPCVLQNNREIVDKNGEINYFSGLFLCRPTGQGKSMLIVRFGGTKRSPLAKVFPKWYFHQNASKVFEQDMGFLSSQNEILLREKVPTKELYLNLKSSDTWVAEYRKWMDKAGHGMPYHFGHSTISLPKEPAVVEHAPAGLVAGQSASSPTKGGIGTMHAPNFANRYFRHVIHCKGCRTVVKAFEAWKNALSAVAIALTALAILLSGRQWKVLLLASAALCSVGVYACSTAIAMNTTNFIRTHRRL

SEQ ID NO: 1888 - protein, 311 aa, Glycine max
MNQAQAKPVRNSQGSLGFVINFFSGGLSGIIAKTSTAPIERIKLLLQTQHENHKVVRPYKGIGDCFTRTLKEEGVLAFWRGNTANIIRYFPTQALNFAFKEIYRDFLLPKNSETKTSAKVVLANLMAGGLAGSTSTLFVYPLDMARTRLGVDIGKNPSERQFRGVFDCISKIHRTDGFKGLYKGLGMSLFGIFMYRGLYFGTYDSGKGHVINPETSTFLQKFLFAQACVIFSESISYPTDTIKRKLMLQAASKEVLYTGAIDCIKKVMKNDGIKGFFRGNLSNVFRSVGSSLCLVLYDEMKRHSDKYAASH

SEQ ID NO: 1889 - protein, 89 aa, Glycine max
  unsure (1)..(89): unsure at all Xaa locations
SNNTEFQIVPSIIRDGLKTVLNKYQKMKDRIVGVSEDTRTSVNRLXQMQVNGSLLFTAINVNDSINKSKFDNLXGCRHSLHDGQMQATD

SEQ ID NO: 1890 - protein, 299 aa, Glycine max
  unsure (1)..(299): unsure at all Xaa locations
SVGDQVINLKEGDVVITTYIGECQECENCVSRKTNLCLTYPIRLTGLLPDNTXRMSILGQRLLHVLSCATWSEYMFSDANYTLKVYPTIDTAHASFILCGFSTGFGAAWKEAKVESGSTVAVFGLGAVGLGAVIGSKMQGASRIIGIDTNENKRAKGEAFGITDFINPGDSNKSASELVKELSGGMGADYSFECTGVSTLLSESLEATKIGTGKAIVIGVGIEITLPLGLFAILLGRTLKGXVFGGLRAISDLSILAAKATKRNSSSRTLTHXXHYRHNKAFDSKHQLCQVHNMHIYTH

SEQ ID NO: 1891 - protein, 177 aa, Glycine max
  unsure (1)..(177): unsure at all Xaa locations
MPRGSRDPLXVVGRVIGDVLDPFECSIPMRVTYQXKDVSNGCEFKPSQVVNQPRINIGGDDFRNFYTLXXVDPDAPSPSDPNFREYLHWLVTDIPATTGPTFGHEVVTYENPRPMMGIHRIVFVLFRQQGRETVYAPGWRQNFITREFAELYNLGLPVAAVYFNIQRESGCGGRRLC

SEQ ID NO: 1892 - protein, 163 aa, Glycine max
MPNTSQVISCKAAICWGAGKPVTVEEIQVDPPKATEVRVKMLCASLCHTDISSIQGFPYINFPLALGHEGVGVVESVGDQVRNLKEGDVVIPTYIGECQECENCVSGKTNLCLTYPIRLTGLLPDNTSRMSIRGQRLHHVLSCATWSEDMVSDANYTLKVDPT

SEQ ID NO: 1893 - protein, 629 aa, Glycine max
  unsure (1)..(629): unsure at all Xaa locations
ESLVRGLFVSMIIGITFSIIITKLILTXGMVPNCNVSAALLAFVFIRTWTKLLHKAGFVAKPFNRQENTIIQTCAVTYYSIARPGGFASYLLGLNRTTYELTGVENEGNNPGAIKEPGFGWMTGFLFVVCFVGLFVLIPLRKIMIVDLKLTYPSGLATAVLINGFHTQGDKMAKKQVRGFTKYFCTSFLWGLFKWFFSGIEDCGFEQFPTFGLQAWKQTFYFDFSMTFVGAGMICSHLVNCSLLLGAVLSFGVMYPLIDRLKGDWFPDNLEETNMKGLYGYKVFVSIALILGDGIYNFTKILISTVLNVNERMRSKNNKNVAADRHENPTEDLKQTDEFLRETIPLRIGVIGYVVFTMISIIIIPQMFPQLKWFYVVVAYIFAPSLAFCNAFGTGLTDMNMAHNYGKVALFVIAAMSGRDNGVVAGLVGCGLVKSVVSVACTLMLDFKTAHYTCTSPKAMFICQLVGTAMGCVIAPLSFFLYYKAFDVGNPHGEFKAPYALIYRNMAIIGVQGFSALPLHCLQLCFGFFAFAIGVNMIRDFAPQKIGKWMPLPMVMAVPFLVGAYFAIDMFIGTVVVFAWQKLDSKKAELMVPAAASGLICGEGLWTLPAAILALARIKPPICMKFVPT

SEQ ID NO: 1894 - protein, 221 aa, Glycine max
MIMMMMMGSNTKPLVHLSLLILVLFSSSTESLRFELQSGHTKCISEDIKSNSMTVGKYQIVNSNEGQPLPDSHRVTVRVTSSYGNNYHYGDRVQTGHFAFAAVEAGDYMTCFWAVDHNPVETLTVDFDWKTGVAAKDWSNVAKKGQVDVMELELKKLQDTVSSIHEEMFYLREKEEEMQELNRTTSSRMFWLSLLSLFVCLSVAGMQIWHLKTFFEKKKLI

SEQ ID NO: 1895 - protein, 229 aa, Glycine max
  unsure (1)..(229): unsure at all Xaa locations
EMVEFMDKVAKTVDVDEFTVEERNLLSVAYKNVIGARRAIGRIIFYIEHNEESRGNEDHVRIIKEYGGKIEAELSKISHGILNLLXSNLMRSSGCGGGEXFYLKMXGDYHRDLAEFKTGAEGKEAAESTLLAYKSAQEIALADLAPTXPIRLGLALNFSVVCYEILSSPDRAWNLAXKQAFDGAISELHTLGEESYKDRAWIGQLLRGNLTLWASDMRVWVGKECVYCS

SEQ ID NO: 1896 - protein, 282 aa, Glycine max
MSQQQRSTPAPFLTKTYLLVDDPATDDVVSWSEGGNTFVVWKHADFAKDLLPKYFKHNNFSSFVRQLNTYGFRKTVPDKWEFANEYFKRGQTDLLAEIRRRKVVSPVTGKSTGGGVNISASHSGGDDMGSTSTGSMEAATAAGADISGENEKLKKDNEKLSGELALAKKQCEELVAFLRDSLNVSPDVIERIIRQGTCVSSNNDAVRFDAIINNDLDDDENAVGECEPQQPPPKGDNGESLKLFGVWLKGQNGKENSIGKCRKRGRQDYPIAATAKELKTLV

SEQ ID NO: 1897 - protein, 400 aa, Glycine max
MQSTATTPLYQLVSFKPKLQTFPSKSQLCPLGTPFCRLEMASVSGFGLKPLRAVGGSSSSSASSDDGFVTLIEYVGKEGMNVKDDLVVLLDHIQYACKKIAALVASPFNYSLGKQTALGSVGSDRDAPKPLDIVSNEIILSSLRKSGRVAVMASEENDAPTWISDDGPYVVVTDPLDGSRNIDASIPTGTIFGIYKRLEELDDLPTEDKAMLNSLQSGSRLIAAAYVLYSSATILCITFGSGTQAFTLDHSTGDFILTNPSIKIPPRGQIYSVNDARYFDWPEGLRQYIDTVRQGKGRYPKKYSARYICSLVADLHRTLLYGGVAMNPRDHLRLVYEANPLSFIVEQAGGRGSDGKNRILSLQPVKLHQRLPLFLGSLEDMEELESYGDIQQKVNPGYEV

SEQ ID NO: 1898 - protein, 286 aa, Glycine max
  unsure (1)..(286): unsure at all Xaa locations
MEKEYLIIQYSPFMPSFAEIEINPCIITSEKSRKVAVMASEENEXPTWIXNNGPYVVVXNPLDGSRNIDASIPTGTIFGIYKRLEELDNLPTEEKAMLNSLQSGSKLIAAAYVLYSSATILCITFGSETQAFTLDHSTGDFILTNPSIKIPXRGQIYSVNDARYFDWPEGLRQYIDPVRQGKGRYPKKYSARYICSLVADLHRTLLYGGVTMNPRDHLRLVYEANPLSFIVEQAGGRGSDGKNRILSLQPVKLHQRLPLFLGSLEDMEELESYGDIQQKVNPGYEV

SEQ ID NO: 1899 - protein, 266 aa, Glycine max
  unsure (1)..(266): unsure at all Xaa locations
MMWSFASNALTSIRLKIGSKQPSQTSAECSDDEVCSNASRDEGLECPICWESFNIVENVPYVLWCGHTLCKNCVIGLQWAVVKFPTQQIKIPFFISCPWCHLLSFRIIYKGNLKXNLKYPCKNFFLLWMVESLNGDRNKLVSTCTDNQPIWSPKCNLLGSQVTNCNLRRASVSPCSRLLGSNHDVGVNDGETHHFSLHKSLDFFLHFTSKFPLVVIFLLIALFLIPCCAVILVLYFLVTILFAIPSFLVLYFAYPTIQRLVREITS

SEQ ID NO: 1900 - protein, 360 aa, Glycine max
MLGVIRHKSIRPAFSAIRHFSSAAKEITVRDALNSALDEEMSADPKVFLMGEEVGEYQGAYKISKGLLDKYGPERVLDTPITEAGFAGIGVGAAYYGLRPVVEFMTFNFSMQAIDHIINSAAKSNYMSAGQISVPIVFRGPNGAAAGVGAQHSQCYASLYGSCPGLKVLSPYSSEDARGLLKAAIRDPDPVVFLENELLYGESFPVSAEVLDSSFCLPIGKAKIEREGKDVTITAYSKMVGYALKAAETLAKEGISAEVINLRSIRPLDRSTINASVRKTNRLVTVEEGFPQHGVGAEICTSVIEESFGYLDAPVERIAGADVPMPYAANLERMAVPQVEDIVRAAKRACYRSVPLAASA

SEQ ID NO: 1901 - protein, 151 aa, Glycine max
  unsure (1)..(151): unsure at all Xaa locations
RVSYVGPPPSVYQAIRCMSSKLFVGGISYQTDDHSLRDEFAKYGQVIEARIIIDRESGRSRGFGFVTYTSSEEASAAITALDGKTLDGRSIRVNHANEKTGGFRGGGGYGGGGYGGGGGYGGGGGGYGGGGGYGGGGGGGGYGGGDYGXNN

SEQ ID NO: 1902 - protein, 162 aa, Glycine max
MDADSSGEEVVIKTRKPYTITKQRERWTEEEHNRFLEALKLYGRAWQRIEEHIGTKTAVQIRSHAQKFFTKLEKEAFVKGVPIGQALDIDIPPPRPKRKPSNPYPRKTNVGAPTLHSEAKHGKSLISIASSHGKQALDLEKEPLPEKHNVDLRPTTVKKKKK

SEQ ID NO: 1903 - protein, 160 aa, Glycine max
EFGSRIVKDGYQWRKYGQKVTRDNPCPRAYFKCSFAPSCPVKKKVQRSVDDQSVLVATYEGEHNHPQFSSQMEATSGSGRSVTLGSVPCTASLSTSTPTLVTLDLTKSQGSNDSKSTKPKGDSPKVPQVLVEQMATSLTTDPNFRAALVAAISGRLLHNN

SEQ ID NO: 1904 - protein, 273 aa, Glycine max
  unsure (1)..(273): unsure at all Xaa locations
MSFVFRGTRADIENGFPGFIPERRALRVHATRPSNSNSLTFLVTVLLLFMILNSHQMSPNFLVCLVHGVFLIAILLRMYARCQQXRPKPSALAGASSXLMATMMRLHATXTIVLGSRGRLQGLRLAIALLIQSGXRSRIXILSALDSDNVSTAPSMTEEEINALPVHKYKVSGPQCGGSSMQQASSSTPAEKKQDNSNAVGSMKASDDDLTCSVCLEQVDVGDVLRSLPCLHQFHANCIDPWLRQQGTCPVCKFRAGSGWSDNGHNDIIADMV

SEQ ID NO: 1905 - protein, 143 aa, Glycine max
KTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILAKEGAKSLFKGAGANILRAIAGAGVLSGYDQLQILFFGKKYGSGG

SEQ ID NO: 1906 - protein, 227 aa, Glycine max
MAMMWIRVILILAACMLPLSVEAMVRHYKFNVVVKNVTRLCSTKPIVTVNGKFPGPTIYAREDDTVLVKVVNHVKYNVSIHWHGVRQLRTGWADGPAYITQCPIQPGQAFVYNFTLTGQRGTLWWHAHILWLRSTVHGALVILPKLGVPYPFPKPHTEKVIILSEWWKSDTEAVINEALKSGLAPNVSDAHTINGHPGSVQNCASQGGYELQFNLETLLTKNINAAL

SEQ ID NO: 1907 - protein, 159 aa, Glycine max
MEHKVATTTEGQSIRCKAAICRKAGEPLCIEEIIVAPPMPGEARIRIICSSLCQTDISFRNMQDHPAIYPRILGHEAIGVVESVGEDVTEVTKGDVVVPIFLPDCGECIDCKSSKSNLCSKFPFEVSPWMPRYATSRFTDLKGEIIHHFLSVSSFSEYT

SEQ ID NO: 1908 - protein, 210 aa, Glycine max
  unsure (1)..(210): unsure at all Xaa locations
TGMAVGRDLKGDKNNVVAVIGDGAMTAGQAYEAMNNAGYLDSDRIVILNDNQQVSLPTANLEGPIPHXGALTSALSKAQSNRPLRELREAANGVTNQIGGPMHELAAKVDEYARGMISGSGSTLFEELGLYYIGPVDGHNIDDLVSILNEVKSTKTTGPVLLHVVTEKGHGYPYAERAADKYHGKCGITNFLTFIDMTHQINSSHFAHSN

SEQ ID NO: 1909 - protein, 171 aa, Glycine max
SGRRASAAWSPPRSRTRDPEKPRAPKAQAVGWPPVRSFRRNMLAATAERGGAALVKVSMDGAPYLRKVDMGTYKSYQELSKALEKMFSSFTIGNDCSQAQGMTGMNESKLVDLLNGSDYVPTYEDKDGDWMLVGDVPWEMFVASCKRLRIMKGSEAIGLAPRAMEKCKSRS

SEQ ID NO: 1910 - protein, 473 aa, Glycine max
  unsure (1)..(473): unsure at all Xaa locations
MQPPRRKNNNLPNSETSTTMKGKRNSSISISIVVVVFSIFLFGVFMYNEDVKSMAEFTFLRPKAQEIQEETXPTTIQELNQRETRVEDSEESQEPIDLKAVVAEERIVEEYEEENEEVVLPPEECDLFTGEWVFDNLTHPLYKEDQCEFLTSQVTCMRSGRSDSLYQNWRWQPRDCSLPKFKPRLLLEKLRGRRLMFVGDSLNRNQWESMICLVQSVVPQGKKSLSKNGSLSIFTIEDYNATVEFYWAPFLVESNSDDPKMHSILNRIIMPESIEKHAVNWKNVDYLIFNTYIWWMNTDTMKVLRGSFDEGSTEYDEVPRPIAYGRVLNTWSKWVEDNINPNRTKVFFSSMSPLHIKSEAWNNPDGIKCAKETIPILNMSTTLQVGTDRRLFVVANNVTQSMKVVPVNFLNIPTLSEFRKDAHTSVYTIRQGKMLTPEQQADPATYADCIHWCLPGLPDTWNEFLYTRIISQS

SEQ ID NO: 1911 - protein, 88 aa, Glycine max
MSQYNQPPVGVPPPQGYPPEGYPKDAYPPQGYPPQGYPPQGYPQQGYPPPYAPQYPPPQHQQQQKGSPGFLEGCLAALCCCCLLDACF

SEQ ID NO: 1912 - protein, 810 aa, Glycine max
  unsure (1)..(810): unsure at all Xaa locations
MSTQPKLGRIPSIRDRVEDTLSAHRNELISLLSRYVAQGRGILQPHNLIDELDNTLEQXNTSLIKETXSFARNIGAAANGSTRSFPPIEATFQDHNVLYPSIFLVLLKIIDKPPSTSWATNLTXSAVEDESVFAFNCLNEIXRCYRRKCRLRNEETPICVRRSSSHRPLHRRRRCLDXRLRERSCDPVMYDILRAXSHIQTISKLQSALAKAEDYLSKLAHDTLYSEFEYVLQGMGFERGWGDTAEWVVDMMHLLLDILQAPDPSTLETVLGRVPMVFNVAILSPHGYFGQANVLGFTDTGGQVVYILDQVRALENEMLLRIKKQGLDFTPRILIVTRLIPDAKGTTCNQRLERVSGTDHTHILRVPFRSESGTLRKWISRFDVWPYLETYAEDVASEIAAELQGYPDFIIGNYSDGNLVASLLAYKMGVTQCTIAHALEKTKYPDSDLYWKKFEDKYHFSCQFTADLIAMNNADFIITSTYQEIAGTKNTVGQYESHAGFTLPGLYRVVHGIDVFDPKFNIVSPGADMSIYFPYSEKQNRLTALHGSIEQLLFAPEQTDEYIGLLKDKSKPIIFSMARLDRVKNITGLVESFGKNSKLRELVNLVIVAGYIDVKKSSDREEIAEIEKMHELMKKYNLVGDFRWIAAQTNRARNGELYRYIADTQGAFVQPAFYEAFGLTVVEAMNCGLPTFATCHGGPAEIIEHGISGFHIDPYHPDQASQLLVEFFQKSKEDPSHWKKISDGGLQRIYERYTWKIYSERLMTLAGVYSFWKYVSKLERRETRRYLEMFYILKFRDLANSVPLAKDDAS

SEQ ID NO: 1913 - protein, 694 aa, Glycine max
HLLTSHSQWGLHFLSYTHRLNQMKKRPCGVYASLSERGEYYSHRPPTPLLDTVNYPIHMKNLSTKELKQLADELRSDVIFSVSRTGGHLGSSLGVVELTVALHYVFNAPQDKILWDVGHQSYPHKILTGRRDKMHTMRQTNGLSGFTKRSESEFDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGPMHELAAKVDEYARGMISGSGSSLFEELGLYYIGPVDGHNINDLVAILNEVKSTKTTGPVLIHVITEKGRGYPYAEKAADKYHGVTKFDPPTGKQFKSKATTQSYTTYFAEALIAEAEADKDVVAIHAAMGGGTGMNLFHRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAINDRPSCFRYPRGNGIGVQLPTGNKGTPLEIGKGRILIEGERVALLGYGSAAVQNCLAAASLVECHGLRLTVADARFCKPLDRSLIRSLAKSHEVLITVEEGSIGGFGSHVAQFMALDGLLDGKLKWRPIVLPDRYIDHGSPADQLSLAGLTPSHIAATVFNVLGQTREALEVMS

SEQ ID NO: 1914 - protein, 686 aa, Glycine max
  unsure (1)..(686): unsure at all Xaa locations
TVGVTPSDPRKSLPQWGLHFLSYTHRLNQIKKRSSGVYASLSERERGEYYSQRPPTPLLDTVNYPIHMKNLSTXVSRTGGHLGSSLGVVELTVALHYVFNAPQDKILWDVGHQSYPHKILTGRRDKMHTMRQTNGLSGFTKRSESEFDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGPMHELAAKVDEYARGMISGSGSSLFEELGLYYIGPVDGHNINDLVAILNEVKSTNTTGPVLIHVITEKGRGYPYAEKAADKYHGVTKFDPPTGKQFKSKATTRSYTTYFAEALIAEAEADKDVVAIHAAMGGGTGMNLFHRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAINDRPSCFRYPRGNGIGVQLPTGNKGTPLEIGKGRILIEGERVALLGYGSAVQNCLAAASLVEHHGLRVTVADARFCKPLDRSLIRSLAKSHEVLITVEEGSIGGFGSHVAQFMALDGLIDGKLKWRPIVLPDRYIDHGSPADQLSLAGLTPSHIAATVFNILGQTREALEVMS

SEQ ID NO: 1915 - protein, 131 aa, Glycine max
MSSPREENVYLAKLAEQAERYEEMVEFMEKVAKTVDSEELTVEERNLLSVAYKNVIGARRASWRIISSIEQKEESRGNEDHVAIIKDYRGKIETELSKICDGILNLLDSHLVPAASLAESKVFYLKMKGDY

SEQ ID NO: 1916 - protein, 190 aa, Glycine max
  unsure (1)..(190): unsure at all Xaa locations
MHSQKVVEMEDKTESHMSSAAAFVEGGIQESCDDACSICLEEFGASDPSTVTTCKHEFHLQCILEWCQRSSQCPMCWQPISLKDPTSQELFEVVEQERSSRATPSRNADILHHPAFGDFQMEHLXDMHANDAAFEERIIQHLAAAATMRSVNQLGRRXGQQTHSSPHVHPHFLVFSNQPIGPSSSSNSLS

SEQ ID NO: 1917 - protein, 412 aa, Glycine max
IRLEAGACLFEELGLFYIGPVDGHDIEDLVHILKSVKGMPTLGPVLIHVITEKGKGYHPAEVAPDKMHGVVKFDPKSGKQLKSKASTRSYTQYFAESLTAEAEDSARARAESARVGGGTGLNLFQKRFPERCFDVGIAEQHAVTFAAGLAAEGLKPFCAIYSSFLQRGYDQVAHDVDLQKLPVRFALDRAGLVGADGPTHCGAFDTTFMACLPNMVVMAPSDETELMHMIATAAAIDDRPSCFRYPRGNGIGTILPPNNKGTPLEVGKGRVLKEGSRVALVGYGTMVQSCMEAAKVLEAHGISTTVVDARFCKPLDGDLMRRLAREHEILITVEEGSIGGFGSHVSHFLGLNGLLDGNLKWRALTLPDRYINHGSQTDQIQMAGLSSNHIAVTALSLTNVHWDSRLLLSLQI

SEQ ID NO: 1918 - protein, 387 aa, Glycine max
  unsure (1)..(387): unsure at all Xaa locations
MSIPIPHRQLFIDGDWKVPVLKNRIPIINPSTQHIIGDIPAATKEDVDLAVAAAKAALSRNKGADWASASGSVRARYLRAIAAKITEKKPELAKLEAIDCGKPLDEAAWDIDDVAGCFEFYADLAEKLDAQQKAHVSLPMDTFKSYVLKEPIGVVALITPWNYPLLMATWKVAPALAAGCAAILKPSELASVTCLELAEICKEVGLPPGVLNILTGLGPEAGAPLAAHPDVDKISFTGSSATGSRIMFGSASCWQPVSLELGGKSPIIVFEDVDLDKTAEWTIFGCFFTNGQICSATSRLIVHESIATEFVNRLVQWAKNIKISDPFEEGCRLGPIVSEGQYKKVLNCISTAKSEGATILIGGSRPEHLKRGTFVXPTIITDVTTSM

SEQ ID NO: 1919 - protein, 101 aa, Glycine max
MASRIQAFLNHPAGPKTIHFWAPTFKRGINIANIADFAKPPEKISYPQQIAVACTGVVWSRYSMVITPKNWNLFSVNVAMAGTGLYQLSRKIRQDYFSDGG

SEQ ID NO: 1920 - protein, 133 aa, Glycine max
  unsure (1)..(133): unsure at all Xaa locations
KLLGHTAPAQAASLLILGPFVDFWLTRNRIDTFHYTSTVTFFIVLSCVISVGTNLSQFICIGRFTAVTFQVIGHMKTILVLTLGFLLFGKEGLNFHVAFGMILAIVGMIWYSSASSKPGGXERQGLASEKARS

SEQ ID NO: 1921 - protein, 806 aa, Glycine max
MANHPLTHSHSFRERFDETLTGHRNEILALLSRLEAKGKGILQHHQVVAEFEEIPEESRKKLQDGVFGEVLRSTQEAIVLPPFVALAVRPRPGVWEYLRVNVHMLVVDELRPAEYLRFKEELVEGSSNGNFVLELDFEPFNASFPRPTLNKSIGNGVEFLNRHLSAKLFHDKESMQPLLEFLRLHSYKGKTMMLNDKVQSLDSLQHVLRKAEEYLISVAPETPYSEFENRFREIGLERGWGDTAERVLEMIQLLLDLLEAPDPCTLETFLGRVPMVFNVVILSPHGYFAQDNVLGYPDTGGQVVYILDQVRALENEMLNRIKKQGLDITPRILIITRLLPDAVGTTCGQRLERVYDTEYCDILRVPFRTEKGIVRKWISRFEVWPYLETYTEDVALELAKELQAKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDPFDPKFNIVSPGADMGIYFPYTETERRLTEFHSDIEELLYSSVENEEHICVLKDRNKPIIFTMARLDRVKNITGLVEWYGKNARLRELVNLVVVAGDRRKESKDLEEKAEMKKMYGLIETYKLNGQFRWISSQMNRVRNGELYRVICDTRGAFVQPAVYEAFGLTVVEAMTCGLPTFATCNGGPAEIIVHGKSGYHIDPYHGDHAAEILVEFFEKSKADPSHWDKISQGGLKRIHEKYTWQIYSDRLLTLTGVYGFWKHVTNLERRESKRYLEMFYALKYRKLAESVPLAIEE

SEQ ID NO: 1922 - protein, 153 aa, Glycine max
  unsure (1)..(153): unsure at all Xaa locations
QPFVGRELFAAGFVSCWAQLNETSQKQLVRNLEMAFSSPNIPPEILATLLNLAEFMEHDEKPLPIXLRLLGALAEKCRAFAKALHYKEMEFEGARSKKMDANPVAVVEALIHINNQLHQHEAAVGILTYAQQHLDFQLKESWYEKLQRWDDAL

SEQ ID NO: 1923 - protein, 139 aa, Glycine max
  unsure (1)..(139): unsure at all Xaa locations
LDSRLIPCFFSGDSEVFYLMRKGDDLRYLAXFKTGAQRLEGAESTVFAYKAAQDIGNAELPPTGPIMLGLALSFSVFYYEILNSPDRACNLAKQACDEAIAELDTLGEESYRDSTVIMQLLRDNLTLWTSDMADDGADE

SEQ ID NO: 1924 - protein, 249 aa, Glycine max
MAWFIFANNLACIGGQMCERAPATVICCADEAALCAKCDVEVHAANKLASKHQRLLLQCLSSKLPTCDICQDKPAFIFCVEDRALFCQDCDEPIHSAGSLSANHQRFLATGIRVASSSNCTKDNEKSHSEPPNRSAQQVSAKIPPQQVPSFTSSWAVDDLLELTGFESPEKKESLQFGELEWLTDVGIFGEQFAQEALAAAEVPQLPVTHNSSSVASYRTSKSYMSHKKPRIEVLNDDDDEYFTVPDLG

SEQ ID NO: 1925 - protein, 251 aa, Glycine max
  unsure (1)..(251): unsure at all Xaa locations
MAPKQTKAEKKIAYDAKLCDLMEEYGQILVVNSDNVGSNQLQNIRKGLRGDSVVLMGKNTMMKRSVRMHAEKTGNNAYLNLIPLLVGNVGLIFTKGDLKEVSEEVAKYKVGAPARVGLVAPIDVVVPPGNTGLDPSQTSFFQVLNIPTKINKGSVEIITPVELIKNGDKVXSVEAALLANLWIRPFSYGLDVLSCYDIGSVISPEVLDLSEDDLIDKFVAGVSLVTSLSLAISYPTLAAAPHMYGNAYKNV

SEQ ID NO: 1926 - protein, 211 aa, Glycine max
MHVNVTILPRVRPRVRPRVRGRVGGPRVRPRVRKKLGFVTLSFACESESNNNQSIIMSSAKKITLKSSDGEAFEVDEAVALESQTIKHMIEDDCADSGIPLPNVTSKILAKVIEYCKKHVEAANPEDKPSEDDLKAWDADFVKVDQATLFDLILAANYLNIKSLLDLTCQTVADMIKGKTPEEIRKTFNIKNDFTPEEEEEVRRENQWAFE

SEQ ID NO: 1927 - protein, 152 aa, Glycine max
EKVLVSSESEIQGNWCHEYRKLKAKVETIQKCQKHLMGEDFESLNLKELQQLEQQLESSLKHIRSRKNQLMHESISELQKKERSLQEENKVLQKELVEKQKAHVAQQDQTQPQTSSSSSSFMLRDAPPAANTSIHPAATGERAEDAAVQPQA

SEQ ID NO: 1928 - protein, 261 aa, Glycine max
  unsure (1)..(261): unsure at all Xaa locations
MEQYEKVEKIGEGTYGVVYKARDRVTNETIALKKIRLEQEDEGVPSTAIREISLLKEMQHRNIVRLQDVVHSEKRLYLVFEYLDLDLKKHMDSSPEFVKDPRQVKMFLYXDFGLARAFGIPVRAFAHEVVTLWYRAPEILLGSRQYSTPVDIWSVGCIFAEMVNQRPLFPGDSEIDELFKIFRXIIMGTPNEDTWPGVTSLPDFKSAFPKWQPKDLKNVVPNLEPAGLDLLSSMLYLDPSKRITARSALEHEYFKDIKFVP

SEQ ID NO: 1929 - protein, 297 aa, Glycine max
  unsure (1)..(297): unsure at all Xaa locations
MDQYEKVEKIGEGTYGVVYKARDRATNETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGXSRHYSTPVDVXSVGCIFAEMVKKRPIFPGDSXIDELFKIFRIVGTPNXEDTWPGRXSSLPDFKSTFPKWQPKDLEIVVPNLEPAGLDLLSSMLCLDPSKRITARSAVEHEYFKDIKFVP

SEQ ID NO: 1930 - protein, 294 aa, Glycine max
MEQYEKVEKIGEGTYGVVYKARDRVTNETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEDTWPGVTSLPDFKSTFPKWPSKDLANVVPNLDAAGLNLLSSMLCLDPSKRITARSAVEHEYFKDIKFVP

SEQ ID NO: 1931 - protein, 119 aa, Glycine max
NVWTCVCVCEGNVRRHYRGVRQRPWGKWASEIRDPKKAARVWLGTFETAEAAALAYDEAALRFKGTKAKLNFPERVHFSKEFGYLTNRPSLFHASATPLSDQHSQVFGGTATNNDAMPR

SEQ ID NO: 1932 - protein, 158 aa, Glycine max
  unsure (1)..(158): unsure at all Xaa locations
MASADVEYRCFVGXLAWATDDHALERAFSQYGEIVETKIINDRETGRSRGFGFVTFASEXQSMKDAIGAMNGQNLDGRNITVNEAQSRGGGGGGGGGGYNRGGGGYGGRSGGGGGGYRSRDGGYGGGYGGGGGGGYGXGGRDRGYSRGGDGGDGGWRN

SEQ ID NO: 1933 - protein, 153 aa, Glycine max
  unsure (1)..(153): unsure at all Xaa locations
HASAESNKLVGNLSWRIRTPDAGFITRSAEQRFVQDPSYPGILYNHDNEYLHYQDDXNDAWDGYGGAVVYTRSAVLPESIVPELEKASKSVGRDFSKFIRTDNTCGPEPSLVERLEKKVEEGEETIVREVEQIEEEVEKVGKTEATLFQKLAE

SEQ ID NO: 1934 - protein, 339 aa, Glycine max
MATWGAHSMLLSHGEGTGTPKVCVKAGLTVRGDLRFHRTRGFKYAPSVVVLKVLATARKPTRLRLLRPYCSVRGQHDHGKGYFSPTNSQIPRQHILKFAADRMLAFLKDWSNLRITAVAGILVSVLMIIPPADAVDALKTCACLLKDCRIELAKCLSNPSCAANIACLQTCNNRPDETECQIKCGDLFENSVVDEFNECAVSRKKCVPKKSDVGEFPAPNPDVLVNSFNIADFSGKWFITSGLNPTFDTFDCQLHEFHTESNKLVGNLSWRIRTPDAGFITRSAEQRFVQDPSYPGILYNHDNEYLHYQDDWYILSSKIENKPDDYVFVYYRGRNDAWD

SEQ ID NO: 1935 - protein, 188 aa, Glycine max
  unsure (1)..(188): unsure at all Xaa locations
MKFGSIYEEYLRAEQDKYLEKCSHVEYKRLKKVLKRCRLDRSLQADGTNGDQQEDRSDDSSDACDCNSCTLCDQMFFTELTKEASDIAGYFSSRVQHLLNLHVPSGLQRYIWRVRQCFIDDQQIMVQKGGLLVNYXTMNAIAIXKISKKYEQGDGLWLTGKRFSRGKMQTRTHLELVADPPWAEPNLG

SEQ ID NO: 1936 - protein, 222 aa, Glycine max
  unsure (1)..(222): unsure at all Xaa locations
MASNQNQASYMAGETKARTEEKTGQMMDKAGQATEATKQKAGETAEATKQKAGEAKDKTAQTAQAAKDRAAESKDQTGSFLGEKTEAAKQKAAETAEAAKQKASETAQYAKERSSDAAQYTQERSSDAAQYTKESAVAGKDKTSGVLQQASETVVNAVVGAKDAVANTLGMGGDNTNTAKDTTTEXDHQGSLANLLPLLVWSFAGLLHNCRFPSCVISAHLV

SEQ ID NO: 1937 - protein, 411 aa, Glycine max
MAKKAVLIGINYPGTKAELKGCINDVWRMHRCLIDRYGFSEDDITVLIDTDESYTEPTGKNIRSALTRLIRSARPGDVLFVHYSGHGTRLPAETGEDDDTGFDECIVPSDMNLITDDDFREFVDGVPRECKLTIVSDSCHSGGLIDGAKEQIGTSTKGEGQQHSGSGSGFGLSSFLRRSVEDAIESRGVHIPSALRHHRHKHEHEADDDRDIELPHVDHGYVKNRSLPLSTIIDILKQKTGKNDIDVGKLRLSLYDIFGADASPKVKKFMKVILNKLQQGDGGSGKQGGILGLVGSLAQEFLKQKIDSSDDGGYAKPAMETKVESKYEAYAGTSSAKPRLSDGGILMSGCQTDQTSADASPAGNSASAYGAFSNAIQAVIEESDGAVTNQEIVLKAREKLKRGGFKQRPGL

SEQ ID NO: 1938 - protein, 255 aa, Glycine max
  unsure (1)..(255): unsure at all Xaa locations
MAEASIGSKSSRWSLQGMTALVTGGSKGIGYAIVEELAQLGATVHTCARNEAELNESLNEWNTKGYRVTGSVCDVASRAERQDLIARVSNEFNGKLNILVNNVGTNVPKHTLDVTEEDFSFLINTNLESAYHLSQLAHPLLKASEAANIIFISSIAGVLSIGIGSTYGATKGAMNQLTKNLACEWGXIRTPLGDKHFKEEKLNNSLIARTPLGRIGEAEEVSSLVAFLCLPAASYITGQTICVDGGFTVNGLYIS

SEQ ID NO: 1939 - protein, 136 aa, Glycine max
  unsure (1)..(136): unsure at all Xaa locations
MSTKKIVLKSSDGESFEVDEAVALESQTIAHMVEDDCVDNGVPLPNVTSKILAKVIEYCKKHVDAAASKSEAVDGGGSSDDDLKAWDAEFMKIDQATLFELILAANYLNIKNLLDLTCQTVADMIXGKTPEEIRTT

SEQ ID NO: 1940 - protein, 216 aa, Glycine max
MADRANHPSVMQKFGGQFHLASSFSEGVRARNICPSVPSYERRFTTSCYMTQNLGISVPMMSSSPMFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLAND

SEQ ID NO: 1941 - protein, 86 aa, Glycine max
MASNQDQASFRAGEAKGHTQEKAGQVMGAAKDKAYEAKDRAAGLAGHASGQGQGATEATKHKAGEATDRASQTAQAAKDRAAGTAQ

SEQ ID NO: 1942 - protein, 169 aa, Glycine max
  unsure (1)..(169): unsure at all Xaa locations
MEGGRSSASNGNGEVRYRGIRRRPWGKFAAEIRDPTRKGTRIWLGTFDTAEQAARAYDAAAFHFRGHRAILNFPNEYQSHNPNSSLPMPLAVPAPPSYSSSSSTSNYSGDDNNHLVRPGEIMQGGDXDDTFELEYLDNKLLEELLQMQDNRXYKNIQANQGSTAMYGMK

SEQ ID NO: 1943 - protein, 213 aa, Glycine max
MAKGDVNQGDKSFMGMPGFVVDFLMGGVSAAVSKTAAAPIERVKLLIQNQDEMLKQGRLDRKYNGISDCFKRTAASEGVMSLWRGNTANVIRYFPTQALNFAFRDTYKSMFAYKKDRDGYAKWMMGNLASGGAAGATSLLFVYSLDYARTRLANDAKSAKGSGDRQFNGLVDVYRKTLASDGIAGLYRGFGPSVLGIVVYRGLYFGMYDSIKP

SEQ ID NO: 1944 - protein, 178 aa, Glycine max
MAESDNDSGGAQNAGNSGNLSELSPREQDRFLPIANVSRIMKKALPANAKISKDAKETVQECVSEFISFITGEASDKCQREKRKTINGDDLLWAMTTLGFEEYVEPLKIYLQRFREMEGEKTVAARDSSKDSASASSYLEPLEPQGHVYGSAYHHQVPGGAIMGGSAYPGGGSNARPR

SEQ ID NO: 1945 - protein, 111 aa, Glycine max
MAMQKAKEIVSGNAVVVFSKSFCPYCVRVKELLQQLGAKFIAVELDKESDGSQVQSALAEWTGQRTVPNVFIGEKHIGGCDSVTNLHRDGKLVPMLTEAGAIAATAGTTSA

SEQ ID NO: 1946 - protein, 190 aa, Glycine max
SSQLRRPPPRAIRWPTTWAYYPQPNSDNGIAEQQGLPLGAMAVGGVDSESQQRGSLSLFYGNGSGRQGIPGVPPMAPQFTRAHGNINDQFQQTASLFAGSQQSGGMRPLGAVGPSVPPPPENTSFCLFPPASSVPSTMEAEDVNRANQFYAWERDRLAPYPLMPVNSEGTWWSSSQQQPPPEPAASASRR

SEQ ID NO: 1947 - protein, 183 aa, Glycine max
  unsure (1)..(183): unsure at all Xaa locations
AGSAYEAISNALSPVSTMVVILNDSRHSLLPKIEEGPKTFVNALSSTLSKLQSSKSFRRFREAAKGVTKRIGXMHELAAKVDEYARGMMGPLGSTLFEELGLYYIGPVDGHNIEDLICVLQEVASLDSMGPVLVHVITDENQGDENSQKSDISDGQQDEGSVKSDSLDNPVRPQTYGICFVET

SEQ ID NO: 1948 - protein, 128 aa, Glycine max
  unsure (1)..(128): unsure at all Xaa locations
MMLDFARIWTRNTLIGLGXGQFLCLLITTTGFTSFELAXKGINAPTSQGLLNYVLLTLDYGTGVLYRRTALKAKWYYYIILGLDDVEAHVLVVKAYQYTSLTSVMLLDCWTIPTVMLATRLSLKTKYR

SEQ ID NO: 1949 - protein, 503 aa, Glycine max
MSIPIPHRQLFIDGDWKVPVLKNRIPIINPSTQHIIGDIPAATKEDVDLAVAAAKAALSRNKGADWASASGSVRARYLRAIAAKITEKKPELAKLEAIDCGKPLDEAAWDIDDVAGCFEFYADLAEKLDAQQKAHVSLPMDTFKSYVLKEPIGVVALITPWNYPLLMATWKVAPALAAGCAAILKPSELASVTCLELAEICKEVGLPPGVLNILTGLGPEAGAPLAAHPDVDKIAFTGSSATGSKIMTAAAQLIKPVSLELGGKSPIIVFEDVDLDKAAEWTIFGCFWTNGQICSATSRLIVHESIATEFLNRIVKWVKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGLGSAVISNDLERCERITKAFKAGIVWINCSQPCFTQAPWGGIKRSGFGRELGEWGLDNYLSVKQVTQYISDEPWGWYQSPSRL

SEQ ID NO: 1950 - protein, 503 aa, Glycine max
MSIPIPHRQLFIDGDWKVPVLKNRIPIINPSTQHIIGDIPAATKEDVDLAVAAAKAALSRNKGADWASASGSVRARYLRAIAAKITEKKPELAKLEAIDCGKPLDEAAWDIDDVAGCFEFYADLAEKLDAQQKAHVSLPMDTFKSYVLKEPIGVVALITPWNYPLLMATCCFVRCLVSSLLCCHVLLCAIFRTCLELAEICKEVGLPPGVLNILTGLGPEAGAPLAAHPDVDKIAFTGSSATGSKIMTAAAQLIKPVSLELGGKSPIIVFEDVDLDKAAEWTIFGCFWTNGQICSATSRLIVHESIATEFLNRIVKWVKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGLGSAVISNDLERCERITKAFKAGIVWINCSQPCFTQAPWGGIKRSGFGRELGEWGLDNYLSVKQVTQYISDEPWGWYQSPSRL

SEQ ID NO: 1951 - protein, 341 aa, Glycine max
MELDGVLLGMCNPLLDISAVVDDAFLQKYGIKLNDAILAEDKHKPMYEELANNPNVEYIAGGATQNSIRVAQWMLQAPGATSYIGCIGKDKFGEEMKKKCTLDGVKVNYYEIDTTPTGTCAVCVVGDDRSLVANLAAANCYKSDHLKRPENWALVEKAKYIYIAGFFLTVSPDSIQLVAEHAAANNKIFSMNLSAPFICEFFRDVQEKALPYTDFVFGYETEARTFSKVHGWETDNVEEIALKISQWPKASGTHKRITVITQGVDPVCVAEDGKVKKFPVQLLPKEKLVDANGTGDAFVGGFLSQLVQEKPIEECVRAGCYAANVIIQRSGCTYPEKPDFH

SEQ ID NO: 1952 - protein, 462 aa, Glycine max
  unsure (1)..(462): unsure at all Xaa locations
MATATLSPADADKLSNLKSSVAALSQISENEKNGFTSLVARYLSGEAQHVEWSKIETPTDEVVVPYDSLAPTPDGSLEVKNLLDKLVVLKLNGGLGTTMGCTGPKSVIEVRDGLTFLDLIVVQIENLNSKYGSNVPLLLMNSFNTHDDTQKIVEKYKNSNIEIHTFNQSQYPRLVVDDFLPFPSKGHTXKDGWYPPGHGDVFPSLVNSGKLDALLSQGKEYVFVANSDNLGAIADLKILNHLIQNKNEYCMEVTPKTLADVKGGTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARANPENPSIELGPEFKKVSNFLGRFKSIPSIVELDSLKVAGNVWFGAGVILKGKXSIVANPGVKLGVPDGA

SEQ ID NO: 1953 - protein, 476 aa, Glycine max
MHEIRDPAIRLFGQKIPFPEDVVVDKEEKEIESGEEREQEMEKYEDQGHKDAGVENVTEEELEVDPPPNAEETKNSGSSPEAIVNPKTPSIEEETEKSKGDKTEKEQGDAANSQEKTLKKPDKVLPCPRCKSMDTKFCYYNNYNVNQPRYFCKDGCEKTTEGGTMRNVPVGAGRRKNKNSTSHYRHITISEALQAARIDAQNGTHLPTLKGNGRVLSFGLDAHAPICDSMASLMNLGEKKALNGTRNGFHHGFEDQRLPVPCKSGENGDDSSTTSSITISSPKGENNKSTFQQQPLPQNHGFLPQVPCIPGVPWPYTWNSPVPPPALCPSGFPLPFYPATFWNCGMPGNWNVPWFSSSSPASNLKSPSSSPNSPTLGKHSRDSDMIKQDSLHKEEASTPRNGSVLVPKTLRIDDPSEAAKSSIWATLGIKNESVSGGAMFKAFQSKKGEKNHVEASPMLMANPAALSRSLNFHENS

SEQ ID NO: 1954 - protein, 156 aa, Glycine max
MGFPVGYSELLFPKLLLHILSLLGLLRKLICSLLRFMGLHDFLEPDIAWAETQTRVPEEFESVSATLIREILPVVKFRELVDPPETCAVCLSEFEENDEIRRLANCRHIFHRGCLDRWMGYDQRTCPLCRTAFIPDEMQGAFIQRLWAASGIADPL

SEQ ID NO: 1955 - protein, 503 aa, Glycine max
  unsure (1)..(503): unsure at all Xaa locations
MDFTTPPIEDGFTAXKLFTQGFSYTYDDVIFLPHYIDFAADAVDLSTRLTRRLPLAVPFVASPMDTVSESAMAAAMASLGGIAVVHSNVPAAVQAAILRRAKSRRVPILSDPAFAAPSAVVEHDDAFGASPFLLVTDTGTSVGKLLGYVARSDWTNQTDKGLRVGDYMAPPPKPAPWNADLNKINEIMESEKSGAVALERDGEVVDLVVREEVERVRGYPKLVAPATVGADGEFMVGAAVGTREDDKERLEHLVKAGLNVVVLDSSQGNSIYQLEMVNYVKRVYPELDVIGGNVVTMYQAENLIQAGVDGLRVGMGSGSICTTQEVCAVGRGQATAVYNVSLIAYKSGVPVIADGGISNSGHIVKALSLGASTVMMGSFLAGSLEAPGAYVYQNGQRVKKYRGMGXSLEAMTKGSDARYLGDTAKLKIAQGVVGAVKDKGSVLNFIPYTLQAVRQGFQDIGASSLQSAHDLLRSRELRLEVRSGAAQVEGGVHGLVSYEKKYF

SEQ ID NO: 1956 - protein, 163 aa, Glycine max
  unsure (1)..(163): unsure at all Xaa locations
MPQRKGCSSLNEPRLVARKFLARPQIEGVGTVVRRSIGGFELKYFDPFIVLDEFSGSYXHEDFEGHKGTIEAGDLQWMTAGRGIVHSEMPAAQGTQKGLQLWINLASKYKMIEPRYQEVLSKDIAEAEDDGIKVRVIAGEALGIKSPIYTRTPTMFLDFSLKP

SEQ ID NO: 1957 - protein, 129 aa, Glycine max
MSTKKIVLKSSDNESFEVDEAVARESQTLAHMVEDDCTDNGIPLPNVTGKILAKVIEYCKKHVDAAAAKTEAAADGGASSDDDLKAWDAEFMKIDQATLFELILAANYLNIKNLLDLTCQTVADMIKGK

SEQ ID NO: 1958 - protein, 550 aa, Glycine max
MGRVWTSMIALLLCLMTSSVRGEDPYIYYTWNVTYGTIAPLGVPQQGILINGQFPGPEINSTSNNNVVINVFNNLDEPLLFTWHGVQQRKNSWQDGTLGAQCPIAPGTNYTYRFQVKDQIGTYFYYPTTGLQRAVGGFGGLRIFSRLLIPVPYADPADEYWVLIGDWFGKSHTALKQTLDSGRSIGRPSGVHINGKNGGLEALYTMEPGKTYKYRICNVGLKEALNFRIQGHPMKLVETEGSHVVQNTYDSLDVHVGQCFTVLVTADQEPRDYFMVASTRFTKKVITATRVIRYSNGVGPASPLLPPAPHQGWAWSLNQFRSFRWNLTASAARPNPQGSYHYGQINITRTIKLVGTRSKIGGKLRYALNGVSHVDPETPLKLAEYYGVADKVFKYNLISDAPDAAIASRDPIIAPNVINATFRNFIEVILENPTKVTQSYNLDGYSFFAVAVEPGQWSPEKRKCYNILDAVSRHTIQVFPKSWAAIMLTFDNAGMWNLRSEMAENRYLGQQLYVSVLSPNRSLRDEYNLPETQLVCGIVKDMPKPPPYSS

SEQ ID NO: 1959 - protein, 296 aa, Glycine max
  unsure (1)..(296): unsure at all Xaa locations
MDIRKRGRPEPGFSLNGGFKKSKQEMESLSTGVGSKSKPCTKFFSTAGCPFGEGCHFLHYVPGGYNAVAHMMNLTPAAPPPPSRNVAALPHVPNGSAPSAVKTRICNKFNTAEGCKFGDKCHFAHGEWELGKHIAPSFDDHRAMGPPGVGRLAGRMEPXPGPAASFGANSTAKISVEASLAGAIIGKGGVNSKQICRQTGAKLSIREHESDPNLRNIELEGSFEQIKEASNMVKDLLLTLQMSAPPKTTPGVPGAPASHGSNFKTKLCENFAKGSCTFGDRCHFAHGASELRKSGV

SEQ ID NO: 1960 - protein, 294 aa, Glycine max
MDTRKRGRPEPGFSLNGGFKKSKQEMESLSTGVGSKSKPCTKFFSTAGCPFGEGCHFLHYVPGGYNAVAHMMNLTPAAPPASRNVAALPHVPNGSAPSAVKTRICNKFNTAEGCKFGDKCHFAHGEWELGKHIAPSFDDHRAMGPPGAGRLAGRMEPPGPAASFGANSTAKISVEASLAGAIIGKGGVNSKQICRQTGAKLSIREHESDPNLRNIELEGSFEQIKEASNMVKDLLLTLQMSAPPKTTPGVPGAPASHGSNFKTKLCENFAKGSCTFGDRCHFAHGASELRKSGV

SEQ ID NO: 1961 - protein, 295 aa, Glycine max
  unsure (1)..(295): unsure at all Xaa locations
MDTRKRGRPEPGFSLNGGFKKSKQEMESLSTGVGSKSKPCTKFFSTAGCPFGEGCHFLHYVPGGYNAVAHMMNLTPAAPPASRNVAALPPVPNGSAPPAVKTRICNKFNTAEGCKFGDKCHFAHGEWELGKHIAPSFDDHRTMGPTGVGRLAGRMEPXPGPAASFGANATAKISVEASLAGAIIRKGGVNXKQICRQTGAKLSIREHESDPNLRNIELEGSFEQIKEASNMVKDLLLTLQMSAPPKTTPGVPGAPASHGSNFKTKLCENFTKGSCTFGDRCHFAHGAAELRKSGV

SEQ ID NO: 1962 - protein, 339 aa, Glycine max
MDHSADAQRTDLMTITRFVLNQQSNHPESRGDFSILLSHIVLGCKFLCSAVNKAGLAKLIGLAGETNVQASEQKKLDVLSNDVFIKALVSSGRTCILVSEEDEEATFVEASKRGKLYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 1963 - protein, 233 aa, Glycine max
DIFFQCILVSEEDEEATFVEASKRGKLYCVVFDPLDGSSNIDCGVSIGTIFGIYLIKEDHEPTIEDVLQPGKNMLAAGYCMYGSSCTLVLSTGSGVNGFTLDPALGEFILTHPDIKIPKKGKIYSVNEGNAKNWDGPTTMYVENCKYPKDGSSPKSLRYIGSMVADVHRTLLYGGIFLYPADKKSPNGKLRVLYEVFPMSFLMEQAGGQAFTGNQRALDLVPKKLHERSPIFL

SEQ ID NO: 1964 - protein, 340 aa, Glycine max
MDHSADAQRTDLMTITRFVLNEQSKHPESRGDFSILLSHIVLGCKFVCSAVNKAGLAKLIGLAGETNVQASEQKKLDVLSNDVFIKALVSSGRTCILVSEEDEEATFVEASKRGKLYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERFPIFLGSYEDVEEIKALYSADEK

SEQ ID NO: 1965 - protein, 255 aa, Glycine max
  unsure (1)..(255): unsure at all Xaa locations
DIFFQCILVSEEDEEATFVEASKRGKLYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKXGKIYSVNEGNAKNWDRPTATYVEKCKFPEDGSSPKSLRYIGSMVADVHRTLLYGGIFLYPADKKXPNGKLRVLYEVFPMSFLMEQAGGQSFTGKERALDLVPTKLHERSPIFLGSYDDVEEIKALYAAAEGEQE

SEQ ID NO: 1966 - protein, 341 aa, Glycine max
FGSRDHSADAQRTDLMTITRFVLNQQSNHPESRGDFSILLSHIVLGCKFLCSAVNKAGLAKLIGLAGETNVQGEEQKKLDVLSNDVFIKALVSSGRTCILVSEEDEEATFVEASKRGKYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 1967 - protein, 139 aa, Glycine max
MREDRIEEINTNLLRHANVDTFIVFRSLTPLLVALADTVFRSQPCPCNLSFLCLLVILAGAFGYVATDSAFTLTAYSWAFAYLITITTEMVYIKHMVMSLGLNTWGFVFYNNLLSLMMAPFFSFVTGENVEIIAAVRSG

SEQ ID NO: 1968 - protein, 299 aa, Glycine max
MGAPKQKWTAEEEQALKAGVVKHGVGKWRTILKDPEFSGVLYLRSNVDLKDKWRNLSVMANGWSSREKSRLSVRRVHQVPRQDENSMAITPVVPSDEEIVDVKPLQVSRDIVHIPGPKRSNLSLDKLIMEAITSLKENGGSNKTAIAAFIEDQYWALPGLKSMLSAKLKFLTASGKLIKVNRKYRIAPIAAYSDRRRNSSMLYLKGRQKASMKIDRDETNILTRSQIDLELEKIRSMTPQEAAAFAARAVAEAEAAIAEAEEAAKEAEAAEADAEAAQAFADATTKSAKGRKSPKRIHT

SEQ ID NO: 1969 - protein, 136 aa, Glycine max
  unsure (1)..(136): unsure at all Xaa locations
MPPAGELQHQSPSKDKQPTDTQSAEAAAAAIAAAAADAEAAGLWTQIKAEARRDAEAEPALASYLYSTILSHSSLERSISFHLGNKLCSSTLLSTLLYDLFLNTFTSDPSLRNATVADLRAARVRDPACISFSXCL

SEQ ID NO: 1970 - protein, 169 aa, Glycine max
  unsure (1)..(169): unsure at all Xaa locations
HHTTRTNLSPFANRPQISLSPPCAAVVESSKKMAASNLEGVLLGMGNPLLDISAVVDEAFLAKYDVKPNNAILAEDKHLPMYDELSSKDNVEYIAGGATQNSIRVAQWMLQTPGATSYMGCIGKDKYGEEMKSAAKAAGVTAHXYYEDEAAPTGTCAVCVVGGERSLIA

SEQ ID NO: 1971 - protein, 118 aa, Glycine max
  unsure (1)..(118): unsure at all Xaa locations
MASTTFRXXGVAAAAAAFIALAAFGSASASKTAFVKSTVKAHDVVIFSKSYCPYCKRAKAVFKELELKKDPYXVELDQREDGGDIQDALSDMVGRRTVPQVFIRGXHLGGSDDIVDAY

SEQ ID NO: 1972 - protein, 166 aa, Glycine max
MAETEQKEVEEKGSLISGLLDKAKGFFAEKLANIPTPEATVDDVDFKGVTRQGVDYHAKVSVKNPYPQHIPICQISYILKSDTRMIASGTIPDPGSLIANGSTVLDVPVKVPYSIAVSLMKDMCLDWDIDYQLDIGLTIDIPIVGDITIPVSTQGEMKLPSLRDFF

SEQ ID NO: 1973 - protein, 259 aa, Glycine max
MASTKERENFVYTAKLAEQAERYEEMVEAMKNVAKLNVELTVEERNLLSVGYKNVVGARRASWRILSSIEQKEEAKGNDVSVKRIKEYRQKVESELSNICSDIMTVIDEHLIPSSSAGEPSVFFYKMKGDYYRYLAEFKSGDERKEAADHSMKAYQLASTTAEAELAPTHPIRLGLALNFSVFYYEILNSPERACHLAKQAFDEAISELDTLSEESYKDSTLIMQLLRDNLTLWTSDIPEEGAEEQKVDSARAAGGDNA

SEQ ID NO: 1974 - protein, 302 aa, Glycine max
MADRARMAKIHQPDAALKCPRCESTNTKFCYYNNYNVNQPRYFCKACQRYWTAGGTMRNVPVGGGSRKNKNSASHYRHITISEALQAARIDAAPNGTHHLLKPNGRVLSFGLELDPPICDSMASVLNLTAEKKGTLNNNSRNNNNNNNNNGDDCSSASSITVSNEENGKSTSQESIVVPNSNGFIHHVPCISTLPWPYPFPSGAPAMCPPGFPMSFYPAAFWNIPWFPSQHSHHSSAPTPRSPNSPTLGKHSRDDDATKQYHLQEEQPPSRQRNGSVLVPKTLRIDDPSEAAKSSIWATLGI

SEQ ID NO: 1975 - protein, 262 aa, Glycine max
  unsure (1)..(262): unsure at all Xaa locations
MASTKERENFVYVAKLAEQAERYEEMVEAMKNVAKLNVELTVEERNLLSVGYKNVVGARRASWRILSSIEQKEEAKGNDVSVKRIKEYRLKKVESELSNICSDIMTVIDEHLIPSSSAGEPSVFFYKMKGDYYRYLAEFKSGDERKEAADHSMKAYQLAXSTTAEAELAXSTHPIRLGLALNFSVFYYEILNSPERACHLAKQAFDEAISELDTLSEESYKDSTLIMQLLRDNLTLWTSDIPEEGAEEQKVDSARAAGGDNA

SEQ ID NO: 1976 - protein, 298 aa, Glycine max
  unsure (1)..(298): unsure at all Xaa locations
MGEVAVMHSEPLQFECNDITVNMTEKEVYPPESNVDHLPGEESSQSTDHKKINYLRERGFMKYGCQHYRRRCRIRAPCCDEIFDCRHCHNEAKNDINIDLKLRHDIPRHEVKQVICSLCGTEQEVQQNCINCGVCMGKYFCGTCKLFDDDISKQQYHCCGCGIXRTGGSENFFHCHKCGCCYVEGAMHHDCPVCFEYLFESRNDVTVMPCGHTIHKSCLNEMREHFQYACPLCSKSVCDMSKVWEKFDLEIAATRMPEQYQNKMVWILCNDCGKTSHVQFHFVAQKCPNCKSYNTRQT

SEQ ID NO: 1977 - protein, 293 aa, Glycine max
  unsure (1)..(293): unsure at all Xaa locations
MSKARVYTDVNVLRPKEYWDYESLTLQWGFYVVGPETEGGRESPCAALCXDQDDYEVVRKVGRGKYSEVFEGINVNSNERCIIKILKPVKKKKIKREIKILQNICGGPNIVKLLDIVRDQHSKTPSLIFEXLDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDELNAYLNKYHLELDPQLDALVGRHSRKPWSKXINADNQHLVSPEAMDFLDKAL

SEQ ID NO: 1978 - protein, 153 aa, Glycine max
MSCAMLLFLRYFKGPELLVDLQDYDYSLDMWSLGCMFAGMIFRKEPFFYGHDNHDQLVKIAKVLGTDELNAYLNKYHLELDPQLDALVGRHSRKPWSKFINADNQHLVSPEAIDFLDKLLRYDHQDRLTAREAMAHPYFSQVRAAESSRMRTQ

SEQ ID NO: 1979 - protein, 164 aa, Glycine max
MGASSDPTQDGSDEQQKRSEIYTYEAPWHIYAMNWSVRRDKKYRLAIASLLEQYPNRVEIVQLDDSNGEIRSDPSLSFEHPYPPTKAIFIPDKDCHRPDLLATSSDFLRVWHISESAVELKSLLNGNKNSEYCGPLTSFDWNEAEPRRIGTFSIDTTCTIWDIE

SEQ ID NO: 1980 - protein, 137 aa, Glycine max
  unsure (1)..(137): unsure at all Xaa locations
MAEEKHHHHLFHHKEGEDFQPAADGGVDTYGYSTETVVTATGNEGEYERITKEEKHHKHKEHLGEMGAAAAGAFALYEKHEAKKDPEHAHKHKIEEEVAAAAAVGAGGFVFHEHHXKKQDHKEAKEASGEKKHHHFG

SEQ ID NO: 1981 - protein, 261 aa, Glycine max
MASAPTPREEFVYMAKLAEQAERYEEMVEFMEKVSASAESEELTVEERNLLSVAYKNVIGARRASWRIISSIEQKEESRGNEDHVAVIRDYRSKIEAELSNICDGILKLLDTRLVPSAASGDSKVFYLKMKGDYHRYLAEFKTGADRKEAAESTLSAYKAAQDIANTELPPTHPIRLGLALNFSVFYYEILNSPDRACSLAKQAFDEAIAELDTLGEESYKDSTLIMQLLRDNLTLWTSDMQDDGADEIKEAAPKGDGEQN

SEQ ID NO: 1982 - protein, 162 aa, Glycine max
MEEACEFRSWAELIPDALGVIFTNLSLQERVTVIPRVCKSWANAVTGPYCWQEIDIKDWSNRCQPDQLDRLLEMLITRSSGTLRKLSVSGLQTESIFTFIAENACSLHTLRLPRSSMNDSIVEQIAGRLSMISFLDVSYCIKIGPYALEMIGKNCKLLERVV

SEQ ID NO: 1983 - protein, 133 aa, Glycine max
YFRCSFAPGCPVKKKVQRSAEDKTILVATYEGEHNHTQPPPSQPQQQNDGSGAGKNAGKPPQAPTATPHHPQQQHKQEAAAAAVSGESAVAASELIRRNLAEQMAMTLTRDPSFKAALVSALSGRILELSPTR

SEQ ID NO: 1984 - protein, 431 aa, Glycine max
  unsure (1)..(431): unsure at all Xaa locations
MVLSWTRRNVFRRAKKEKEQSQLEVEVVIPNHFRCPVSLELMTDPVTLSTGITYDRVSIEKWIEGGNRTCPVTNQVLTTFDLIPNHAIRMMIQDWCVXNSSYGIDRIPTPRIPISAYEVSDTCTRILSACQRGDDKRCQELVGKIKVWSRESERNKRCIVGAGAGAVLAYAFDCFSSNSIEKHVVVLEEVLEVMTWMIPFGEEGVSKLSSGASLNSLVWFLEGKDLASRQSAALLLKEVCVQELAKVGKVVEALVKMVREPIGSTSTKACLATIFNLVSLAANREGIAQRFVELGLVSLLLEAIVDGEKGVCEKALGVLDCICDCEKGKEVVKSNALALPLVVRKLLRVSPLASGFAVSILRKICDKREEGILIEALQVGLFQKLLVLLQVGCDESTKENATGLLKLLNGYRNKAECTDSSLNFEHLKKPF

SEQ ID NO: 1985 - protein, 122 aa, Glycine max
METEREKQVYSAKLSEQTERYDEMVEAMKKVAQMDVELTVEERNLVSVGYKNVIGARRASWRILSSIEQKEESKGNEENVKRIQNYRKRVEEELAKVCNDILSVIDKHLIPSSTAVESTVFF

SEQ ID NO: 1986 - protein, 371 aa, Glycine max
  unsure (1)..(371): unsure at all Xaa locations
MAGVNPNGVADFPATPTHGGQFIQYNIFXNLFEVTAKYRPPIMPVGRGAYGIVCSLLNTETNELVAVKKIANAFYNHMDAKRTLREIKLLRHLDHENVIGLRDVIPPPLRREFNDVYIATELMDTDLHHIIRSNQNLSEEHSQYFLYQILRGLKYIHSANVIHRDLKPSNLLLNSNCDLKIIDFGLARPTLESDFMTEYVVTRWYRAPELLLNSSDYTSAIDVWSVGCIFMELMNKKPLFPGKDHVHQMRLLTELLGTPTEADLGLVKNEDARRYIRQLPQYPRQPLAQVFPHVHPAAIDLVDKMLTVDPTKRITVEEALAHPYLEKLHDVADEPICMEPFSFDFEQQQLDEEQIKEMIYREALALNPEYA

SEQ ID NO: 1987 - protein, 332 aa, Glycine max
  unsure (1)..(332): unsure at all Xaa locations
MDTCNVFEGSWVRDDSYPLYDASHCPFVERGFNCLANGRKDRDYTKWRWKPKNCEIPRFDVRGILEQLRGKRVVFVGXSLSRTQWESMICLLMTGVEDKKSIYEIKGNKITKQIRFLGVRFSTFDVRIDFYRSVFLSEPXRCPTTVLTNLFRVMRFPTTVLTPXVQSDSEVLIFNSGHWDTXKLFXVGWYFQVDNSLELCMNPFAERGLNCLANGLKDRGYTKWRWKAKICEPPNXSHWSGQNHNSCKVTKRPWKRTNRKERNPISNMINKVVKSMSAPVTVMHVTPMTAYRSDGHVGTWSDQPSVPDCSHWCLPGVPDMWNEILLSYLLPK

SEQ ID NO: 1988 - protein, 204 aa, Glycine max
  unsure (1)..(204): unsure at all Xaa locations
ILVPAERLFSLCRVIMGNMEILLXCTDQFHPSSCEYDNGVDAIECPQYYVVWNMNMNTHIYPEFVVSFKVSSDAEGHFCGSEGKNVSGVNTACDGPHGLLNSESSTVDNGKAPSMVSSTPKVPKSPWMPFPVLLDAIRDQVPPTGMDVIKTYYEQFRSKHISRDDFVKMLRLIVGDGLLRTTITNLQYKIPSGGELKDSIKKED

SEQ ID NO: 1989 - protein, 404 aa, Glycine max
PRVRSYASNEIKLHLEVEINGVDQSRLSECSGESNALVKGIQIDTKQNCCQYDVEVEDSINKKDCGNVGEDIQQHQDIGLDAYTESVYGILDLNSVQKMFLKGMSSFGSTDSDIAEIYQCSGASMQARWELFQKQAELTKKNHGEANIRYAWLASSKGELSTMMNYGLSHYGLSGSKCTYGIGVHLAAVTCPDASVRYCDVDENGVRHLALCRVIMGNMEILQPGTGQFHPSSCEYDNGVDSIECPRYYVVWNMNMNTHIYPEFVVSFKVSSDAEGHFCGSEGKNVSGVNSACQGPHGLLHSESSTVDNGKAPSMVASTPKVPKSPWMPFPLLLDAIRNQVPPKGMDVIKIYYEQFRSKHISRDDFVKMLRLIVGDGLLRTTITNLQFKIPSGGELKGSIKKEV

SEQ ID NO: 1990 - protein, 108 aa, Glycine max
CIGRSSSACLLYSKGDRKASIDAASWLFNVVTSVGIILVNKALMATYGFSFVTDVSVNAKGFIAAVIAVWSTALQQYYVHFLQRKYSIGSFNLLGHTAPAQAASLLLV

SEQ ID NO: 1991 - protein, 333 aa, Glycine max
MSSVSKGDRKASIDAASWLFNVVTSVGIILVNKALMATYGFSFATTLTGLHFATTTLLTLILKSLGYIQTSHLPLSDIIKFVLFANFSIVGMNVSLMWNSVGFYQIAKLSMIPVSCFLEVVLDNVRYSRDTKLSIFLVLLGVAVCTVTDVSVNAKGFIAAVIAVWSTSLQQYYVHFLQRKYSIGSFNLLGHTAPAQAASLLLVGPFLDYWLTGKRVDAYGYGLTSTLFIILSCTIAVGTNLSQFICIGRFTAVTFQVLGHMKTILVLILGFIFFGKEGLNLHVVLGMIIAIAGMVWYGSASSKPGGKERRSFSLPKTQDYSSLPVSSEPDTKE

SEQ ID NO: 1992 - protein, 235 aa, Glycine max
KLQIAKLSMIPVSCFLEVILDNVRYSRDTKLSISLVLLGVAVCTVTDVSVNAKGFIAAAVAVWSTSLQQYYVHFLQRKYSLGSFNLLGHTAPVQAASLLLVGPFLDYWLTNKRVDAYNYGFTSTLFIIISCTIAVGTNLSQFICIGRFTAVSFQVLGHMKTILVLALGFVFFGKEGLNLQVILGMTIAIAGMIWYGNASSKPGGKERLSLPINHTTNKTQEYNVLPVSSETDQEI

SEQ ID NO: 1993 - protein, 119 aa, Glycine max
MASRQDQASYHAGEAKARAEEKTGYVVGAAQDKAREAKDTASDAAGRAMGRGGDAKEATKEKAYEAKDAASDATGRAMDKGRGAAEATKEKGYEAKDNAADTAQQTGSYIAQTAEAAKQ

SEQ ID NO: 1994 - protein, 268 aa, Glycine max
  unsure (1)..(268): unsure at all Xaa locations
MEGSVIERLDFGKMGYGCNHYRRRCEDGPSLHDEIYSCRHCHNEATSLLNNPFDSPRARPLAKMFNKLFVVCDTEQPVAQVCTNCXVKMGEYFCTICKFFDDDVGKKQFHCDDCGICRIGGRENFFHCNKCXSCYSNSLRDNHLCVENSMRHHCPICYEYLFDSLKDITVMKCGHTMHSECYLEMLKRDKYCCPICSKSVMDMSRAWKRIDEEIEATVMPRXYRYRKVWILCNDCNDTTEVYFHILGQKCGHCSSYNTRAIAPPVLSQ

SEQ ID NO: 1995 - protein, 618 aa, Glycine max
MDAVLQTRGLLSLPANPVNRISLLHPSHGLRHRLFSPKPKNLSGSSLSSNGFPKLSPRPNNVFAQRDQNKNFFLCRAEAAAAAAASFGEPESEKQKLLGIEVATLKKIVPLGMMFFCILFNYTILRDTKDVLVVTARGSSAEIIPFLKTWVNLPMAIGFMLLYTKLANVLSKQALFYSIILPFIAFFGAFGFVLYPLSNYIHPEAFADKLLNILGPRFLGPLAIMRIWSFCLFYVMAELWGSVVISVLFWGFANQITTVDEAKRFYPLFVLGANVALVFSGRTVKYFSNLRSTLGPGVDGWAISLKAMMSIVVGMGFAICFLYWWVNNYVPLPTRSKKKKEKPKMGTMESIKFLVSSKYIRDLATLVVAYGISINLVEVTWKSKLKAQFPSPNEYSSFMGDFSTATGIATFIMMLLSQFIFDKYGWGVGAKITPTVLLLTGVGFFSLILFGGPIAPVIAKFGMTPLLAAVYVGAMQNIFSKSAKYSLFDPCKEMAYIPLDEDTKVKGKAAIDVVCNPLGKSGGALIQQFMILTFGSLANSTPYLGGVLLVIVLVWLSAAKSLDTQFTALRREEELEKEMERAAAVKIPVVAKDEDENGSLKSVPLLNPTAGDSSSILN

SEQ ID NO: 1996 - protein, 570 aa, Glycine max
MKLSVFWFAWAFSLLISMASAATVEHTFIVQNKAVTLLCKERVIVTVNGLYPGPRIDVREGDAVVVHVINKSPYNITIHWHGVFQLFSAWADGPEYITQCNIRPQNSYTYKFNVIQQEGTLWWHAHSGVLRATVHGAFIIHPRSGLFPFPKPHKQVPIILGDWYDGNIVDIYQQVLLLGDVRPSAAYTINGLPGDLYNCSRNQMFKLKVKPGKTYLLRMINAAFNNNLFVKIANHSFTVVAMDASYIEPYVTDIITIAPGQTADVLFKADQPIGSYYMAASPYVVGQPEALFDTTTTRGIVAYEGYTTSLKDSKPIVPLLPPFNATPIAHKFFSNITSLVGGPHWVPVPLEVDQHMFITININLERCPRNGTCQGVFGQKFSASMNNESFVHPVGKGYSMLEASFYNVSGVYTTDFPDKPPIIFDFTNPKIALDTKYLFTPPKSTKVKKLKFNSTVEVVFQNTQIMNAQSHPMHLHGFSFHVLAQDFGNFNYTKDKYKFNLVNPIFRNTIAVPVGGWAVIRFKANNPGMWFVHCHVDDHQLWGLDMVFEVENGPTPSTSLPPPPADLPKC

SEQ ID NO: 1997 - protein, 366 aa, Glycine max
MATHLPDYFKCPISLEIMSDPVILSSGHTFDRSSIQRWLDAGHRTCPITKLPLPDHPSLIPNHALRSLISNYTFLSPLHQTISQPETLISTLTSNSSSSDSKIEALKHLTRLSMRDSAFRRRLAESGAVPAVLAAVDDPSLQEKALPLLLNLTLDDDSKVGLVAEGVVARVVAVLLHAPSPDCRAVAATIVTSLAVVEVNKATIGAFPAAIAALVAILRDGGKGRERKEAATALYALCSFPDNRRRAVSCGAVPILLTNVGIGLERCVEVIGVLAKCKEGREQMECYDGCVQILVNVLRNGSSRGIQYALFALTSVCSYSQRMVMVALEEGGLEASLGFVEDDNEKVRRNACNFIKVLRFNHSRVR

SEQ ID NO: 1998 - protein, 522 aa, Glycine max
RLREDDRRGRVLSCDYPCNTHCLVGKIFHQQHTAMAGSNILSHSPSLPKTYSHSLNQNALSQKLFFLPLKFKATTKPRALRAVLSQNAVKTSVEDTKNAHFQHCFTKSEDGYLYCEGLKVHDIMESVERRPFYLYSKPQITRNVEAYKDALEGLSSIIGYAIKANNNLKILEHLRHLGCGAVLVSGNELRLALRAGFDPTRCIFNGNGKILEDLVLAAQEGVFVNIDSEFDLENIVEAAKRAGKKVNVLLRINPDVDPQVHPYVATGNKNSKFGIRNEKLQWFLDAVKELPNELKLVGAHCHLGSTITKVDIFRDAATIMINYIDQIRDQGFEVDYLNIGGGLGIDYYHSGAILPTPRDLIDTVRDLVISRGLNLIIEPGRSLIANTCCLVNRVTGVKSNGSKNFIVIDGSMAELIRPSLYDAYQHIELVSPAPSNAETATFDVVGPVCESADFLGKGRELPTPAKGTGLVVHDAGAYCMSMASTYNLKMRPPEYWVEDDGSVSKIRHGETFEDHIRFFEGL

SEQ ID NO: 1999 - protein, 379 aa, Glycine max; identical to SEQ ID NO: 1190

SEQ ID NO: 2000 - protein, 331 aa, Glycine max
MCSMATTVAATKLTSLKATAGKLGYREICQVRQWSPLQSAMPHFGMLRCRQPFATSTVVNAQAQAQAQATGVEQTTTEEEEAVPKVESPVVVVTGASRGIGKAIALSLGKAGCKVLVNYARSAKEAEEVSKQIEEYGGQAITFGGDVSKEADVDAMMKTAVDKWGTIDVVVNNAGITRDTLLIRMKKSQWDEVMDLNLTGVFLCSQAATKIMMKKRKGRIINIASVVGLIGNIGQANYAAAKAGVIGFSKTAAREGASRNINVNVVCPGFIASDMTAKLGEDMEKKILGTIPLGRYGQPEDVAGLVEFLALSPAASYITGQTFTIDGGIAI

SEQ ID NO: 2001 - protein, 532 aa, Glycine max
MNAIATASALSLPIFLRAGKLDTKRDLKGRFRVFAVFGEEEKKNAWGALFDVEDPRSKFPQNKGKVLDISQALEVARHDIQYLDWRARQDVLTIMHLHEKVVEVLNPLAREYKSIGTLKKELAELQDELAQAHTQVHISEARVTTALDKLAYMEELVNDRLLQDRSTTDVAQTSSSPSTSANSLVTEKRRQPRKSLNVSGPVQSYHTHLKNFWYPVAFSTDLKDDTMIPIECFEEPWVIFRGKDGKPGCVQNTCAHRACPLHLGSVNEGRIQCPYHGWEYTTDGKCEKMPSTRQLNVKIKSVPCFEKEGMIWIWPGNDPPAATLPSLLPPSGFEIHAEIVMELPIEHGLLLDNLLDLAHAPFTHTSTFAKGWSVPSLVNFLTPASGLQGYWDPYPIDMEFRPPCMVLSTIGISKPGKLEGQSTRECSTHLHQLHVCLPSSKQKTRLLYRMSLDFAPLLKHIPLMKYLWRHFAEQVLNEDLRLVVGQQERMNNGANVWNFPVAYDKLGVRYRMWRDALERGAKQLPFSPQHID

SEQ ID NO: 2002 - protein, 578 aa, Glycine max
MVTMGLKALFVWCIIWLAFAQLSLGGRVRHYKFDVEYMIRKPDCLEHVVMGINGQFPGPTIRAEVGDILDIALTNKLFTEGTVIHWHGIRQVGTPWADGTAAISQCAINPGETFQYRFTVDRPGTYFYHGHHGMQRSAGLYGSLIVDLPKGQNEPFPYDGEFNLLLSDLWHTSSHEQEVGLSSKPFKWIGEAQTLLINGRGQFNCSLASKFINTTLPQCQLKGGEECAPQILHVEPNKTYRIRIASTTALASLNLAISNHKLVVVEADGNYVSPFAVDDIDIYSGESYSVLLRTDQDPNKNYWLSIGVRGRRAPNTPQGLTILNYKPISASIFPTSPPPITPIWNDFERSKAFTKKIIAKMGTPQPPKRSDRTIFLLNTQNWLDGFTKWAINNVSLTLPPTPYLGSIKFKIKNAFDKTPPPVTFPQDYDIFNPPVNPNASIGNGVYMFNLNEVVDVILQNANQLSGSGSEIHPWHLHGHDFWILGYGEGKFKSGDEKKFNLTHAPLRNTAVIFPYGWTALRFKADNPGVWAFHCHIEPHLHMGMGVIFAEAVQKVGKIPRDALTCGLTGNKLVGNRHY

SEQ ID NO: 2003 - protein, 243 aa, Glycine max
  unsure (1)..(243): unsure at all Xaa locations
MDAFNSFFDSRNRWNYDTLKNFRQISPVVQNHLKQVYFTLCFAVVAAAVGAYLHVLLNIGGFLTTVACMGSSFWLLSTPPFEERKRVTLLMAASLFQGSSIGPLIDLAIHIDPSLIFSAFVGTALAFACFSGAALVARRREYLYLGGLVSSGLSILLWLHFASSIFGGSTALFKFELYFGLLVFXYIVVDTQEIVERAHLGDLDYVKHALTLFTDLVAVFVRILVIMLKNSTERNEKKKKRRD

SEQ ID NO: 2004 - protein, 246 aa, Glycine max
MAFLNKIGNLLKNSAVKHINQDFSASTPSLFQAIRSMSSAKLFVGGISYSTDDMSLRESFARYGEVIDVKVIMDRETGRSRGFGFVTFATSEDASSAIQGMDGQDLHGRRIRVNYATERSRPGFGGDGGYRGSGGGDGYNRGGNYGSGGGYNSGSGYNRGGNYGSGNYNVTSSYSDGNAETSYTGGANAGNYQFNENSGGVFGSASGEFSSNQNDTAGADNDEFIEPLEDNVRENNDGPTDYAQNR

SEQ ID NO: 2005 - protein, 228 aa, Glycine max
MAFLNKIGNLLKNSAVKHINQDFSASTPSLFQAIRSMSSAKLFVGGISYSTDDMSLRESFARYGEVIDVKVIMDRETGRSRGFGFITFATSEDASYAIQGMDGQDLHGRRIRVNYATERSRPGFGGDGGYRGSGGSDGYNRGGNYGSGNYNVTSSYSDGNAETSYTSGANAGNYQFNENSGGVFGSASGEFSSNQNDATGADNDEFIEPLEDNVRENNDEPTDYAQNR

SEQ ID NO: 2006 - protein, 57 aa, Glycine max
HDDSLQDYMFEESVCLLLRASWFTPLSVEEHVVHEDAYEDLGDYYQYDDDDDDDDMD

SEQ ID NO: 2007 - protein, 216 aa, Glycine max
MVRGKTQMKRIENATSRQDALIIFSPRGKLYEFASSSMQESIERYRRHTKHVNPTTFRSVEQNMQHLKQEAENMMKKIDLLEAAKRKFLGEGLGACSIEELQRIEQQLERSLSNVRARKVQVFKEQIEQLKEKEKALLDENAKLTENARLSEKHDIHLQPATKNQNVNQPQCNAAASKYQKVNQPHSNAGSSSSDVETELFIGLPDTRARHISHHV

SEQ ID NO: 2008 - protein, 312 aa, Glycine max
  unsure (1)..(312): unsure at all Xaa locations
MDYSSWMINTSLDLNINPHRLHEELPKKEVENNFLSLNLEVKKSSVKQESAGALAEELKRVSAENKKLTEMLTEMCENYNTLRSNLMEYMRKNPDKELSSSRKRKSASSNNNSTIPMGVNXEPSESSSTDEESCKNPKEDMKTKISRVYMRTEASDTSLIVKDGYQWRKYGQKVTRDNPSPRAYFKCSFAPSCPVKKKVQRSVDDQSVLVATYEGEHNHPHPSQMEVTTGSNRCMTLGSVPCSASLSSSPPTATLDWTKSKSSSESKNTSPKTESPEVPQVLVEQMATSLTKDPNFRAALVAAISGKMLHNN

SEQ ID NO: 2009 - protein, 100 aa, Glycine max
FQRGIPHQDFAGHKGTIRAGDVQWMTAGRGIIHSEMPAEANNNKGLQLWINLSSRDKMIEPNYQELPSENIATAEKEWVEVRVIAREAIGVHSPVYTRTP

SEQ ID NO: 2010 - protein, 270 aa, Glycine max
RQRSWGKWAAEIRDPRKGVRVWLGTFSTAEEAARAYDAEARRIRGKKAKVNFPDEPSSAASSKRLKANPEAQPMKKNLNSVKPEINQMFNFGDNLEGYYSPIDQVEQKPLVNQYVNRAPFAGNGVQVSPVTPSADVTAYFSSEHSSSSFDYSDLGWGEQVPKTPEISSMLSAAPLDGESQFVQGAADQNQKKNNLLDMASVQDDSAKTLSEELADIESQLKFFETPSFLDEAWADAALASLLSEDASQDAAGNPMNLWSFDDLPSMAGVF

SEQ ID NO: 2011 - protein, 379 aa, Glycine max
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHSKPVQEVLVEMTNGGVDRAVECTGHIDAMIAAFECVHDGWGVAVLVGVPHKEAVFKTYPMNFLNERTLKGTFFGNYKPRTDLPEVVEMYMRKELELEKFITHSVPFSQINTAFDLMLKGEGLRCIMRMDQ

SEQ ID NO: 2012 - protein, 122 aa, Glycine max
MSTAEATREENVYMAKLAEQAERYEEMVEFMEKVAKTADVGELTVEERNLLSVAYKNVIGARRASWRIISSVQQEEGRRGDAADVASIEEYRTRIETELSKICDGILKLLDSHLVPSATAAE

SEQ ID NO: 2013 - protein, 147 aa, Glycine max
  unsure (1)..(147): unsure at all Xaa locations
LDQSNYSVCDGTFGPXLLNEMSDIVGCFNQRAQQLLELHLASGFRKYFLMLKGQLHKNHTALIEEGKDLVIYALINSIAIRKILKKYDKIHYSKQGQLFKSKVQTMHKEILQSPWLCELIALHINLRETKSKPREASALFDGFISIH

SEQ ID NO: 2014 - protein, 181 aa, Glycine max
MGRSPCCDKVGLKKGPWTPEEDQKLLAYIEEHGHGSWRALPAKAGLQRCGKSCRLRWTNYLRPDIKRGKFSMQEEQTIIQLHALLGNRWSAIATHLPKRTDNEIKNYWNTHLKKRLDKMGIDPVTHKPKNDALLSSEGPSKTAANLSHMAQWESARLEAEARLVRESKIRSHSHHHHCTTP

SEQ ID NO: 2015 - protein, 280 aa, Glycine max
  unsure (1)..(280): unsure at all Xaa locations
FRMWNFASNCIAGTVGLKNDSKPTHSASECSDDENSVIGREEGLECPICWESFNIVENVPYVLWCGHTLCKNCILGLQWAVVKFPTXGFLWLVVYFSTLPIRLPLFISCPWCNLLSLRXLVYQGNLKFPHKNYFLLWMVENMNGDRVKSHSTVCGDHQPVWPIIDSLTNGSQVSHDSLQGGQVCHPESSSSNHYHGDTSNYLSIETLHTSLRKSLVLFVHLTAKFPLIIIFLLIVLYAIPVIAAILALYILVTILFALPSFLILYFAYPSLDWLVREIIT

SEQ ID NO: 2016 - protein, 438 aa, Glycine max
FGSRMGADDFEPLTMIGKGAFGEVRVCREKATGHVYAMKKLKKSEMLRRGQVEHVKAERNLLAEVDSNCIVKLYYSFQDEEYLYLIMEYLPGGDMMTLLMRKDILTENEARFYVGETVLAIESIHKHNYIHRDIKPDNLLLDRNGHMKLSDFGLCKPLDCSNLQEKDFSIGSNRSGALQSDGRPVAPKRSQQEQLQHWQKNRRMLAYSTVGTPDYIAPEVLLKKGYGMECDWWSLGAIMYEMLVGYPPFYSDEPMLTCRKIVNWRNYLKFPEEVKISAEAKDLISRLLCNVDQRLGTKGADEIKAHPWFKGIEWDKLYQIKAAFIPEVNDELDTQNFEKFEEADNQTQPSSKSGPWRKMLSSKDVNFVGYTYKNYEIVNDDQLPEIAELKKKSTKPKRPSIKTLFDDESATAANQPTQGSFLKLLPTQPEVPEKSESQ

SEQ ID NO: 2017 - protein, 168 aa, Glycine max
  unsure (1)..(168): unsure at all Xaa locations
MWSLKLSLGFNSVGFYQXMTKLAIIPCTILLEILFLGKKFSKRVQFSLSILLLGVGIATVTDLQLNALGSFLSLLAVITTCVAQIMTNTIQKKFKVSSTQLLYQTCPYQSATLLIFGPYLDKLLTNLNVSAFKYTTQVTMVIILSCMISIAVNFSTFLVIGKTYRAEL

SEQ ID NO: 2018 - protein, 161 aa, Glycine max
MTTTLERGFSEEQEALVVKSWNVMKKNSGELGLKFFLKIFEIAPSAQKLFSFLRDSTVPLEQNPKLKPHAVSVFVMTCDSAVQLRKAGKVTVRESNLKKLGATHFRTGVANEHFEVTKFALLETIKEAVPEMWSPAMKNAWGEAYDQLVDAIKSEMKPPSS

SEQ ID NO: 2019 - protein, 144 aa, Glycine max
  unsure (1)..(144): unsure at all Xaa locations
AKRAMXDEIGPDGKKIRPGINPVMIDEXXECNTMLSAQRKKRQVPPSLASXDELXRYTQISSHPLHKTNKPGIXSMDIHPSXDIXATGGIDTNAVLFDRTSGQILCTLAGHSKKITTLKFXPRXEXVVTGSAXKTVRIXQGGEE

SEQ ID NO: 2020 - protein, 267 aa, Glycine max
MLDGLDEEGCVEEPGYQSEKKRRLSVDQVKALEKNFEVENKLEPERKVKLAQELGLQPRQVAVWFQNRRARWKTKQLERDYGVLKANYDALKLNFDTLDQDNEALRKQVKELKSRLLQEENTGGSGVSVKEEIITTSETSNINPSSESEEDHLNYECFNNNDDCVGGTAASLLQVDFKDGSSDSDGSSAILNEDNMYSPLKFNNCSISTSPSSSSMMNCFQFQKPYHHHAQYVKMEEHNFLSADEACNFFSDEQAPTLQWYCPEQWS

SEQ ID NO: 2021 - protein, 259 aa, Glycine max
MSVEKERETQVYLAKLAEQAERYEEMVECMKKVAKLDLDLTVEERNLLSVGYKNVIGARRASWRIMSSIEQKEESKGNEHNVKLIKSYCQKVEEELSKICGDILTIIDQHLIPSSGSAEASVFYYKMKGDYFRYLAEFKTDQERKEAAEQSLKGYEAASATANTDLPSTHPIRLGLALNFSVFYYEIMNSPERACHLAKQAFDEAIAELDTLSEESYKDSTLIMQLLRDNLTLWTSDLPEDGGEDNIKAEEAKPSEPEH

SEQ ID NO: 2022 - protein, 178 aa, Glycine max
MSRVYVGNLDSRVTERDLEDEFRVFGVIRSVWVARRPPGYAFIDFDDRRDAQDAIRELDGKNGWRVELSHNSRGGGGGRGGRSGGSDLKCYECGEPGHFARECRMRGGSRRRRSRSPPRFRRSPSYGRRSYSPRGRSPRRRSLSPRGRSYTRSPPYRGREEVPYANGNGLRDRRTSRI

SEQ ID NO: 2023 - protein, 180 aa, Glycine max
MSRVYVGNLDSRVTERDLEDEFRVFGVIRSVWVARRPPGYAFIDFDDRRDAQDAIRELDGIKNNGWRVELSHNSRGGGGGRGGRSGGSDLKCYECGEPGHFARECRMRGGSGRRRSRSPPRFRRSPSYGRRSYSPRGRSPRRRSLSPRGRSYSRSPPYRGREEVPYANGNGLRERRRSRS

SEQ ID NO: 2024 - protein, 179 aa, Glycine max
  unsure (1)..(179): unsure at all Xaa locations
MSRVYVGNLDSRVTERDLEDEFRVFGVIRSVWVARRPPGYAFIDFDDRRDAQDAIRELDGKNGWRVELSHNSRGGGGGRGGRSGGSDLKCYECGEPGHFARECRMRGGSGRRRSRSPPRFRRSPSYGRRSYSPRGRSPRRRSLSPRGRSYSRSPPYRGREEVPYANGNGXLRERRRSRS

SEQ ID NO: 2025 - protein, 180 aa, Glycine max
  unsure (1)..(180): unsure at all Xaa locations
MSRVYVGNLDSRVTERDLEDEFRVFGVIRSVWVARRPPGYAFIDFDDRRDAQDAIRELDGXGKNGWRVELSHNSRGGGGGRGGRSGGSDLKCYECGEPGHFARECRMRGGSGRRRSRSPPRFRRSPSYGRRSYSPRGRSPRHRSSSPRGRSYSKSPPYRGREEVPYANGNGLRERRRSRS

SEQ ID NO: 2026 - protein, 238 aa, Glycine max
MSSGGGGGKPFFCHVCSQRITCSDESEPFCPMCMESFVEECNPNNPNPNLFPDSDESSDPELPFHRFSLLPLLLSSVSRSRSEPDVFDPMVFLQNHLQDLRADGANIQVDFDHPSNENQGFRLANIGDYFMGPGLEQFIQQLADNDPNRYGTPPAAKDAVENLPTVTVDDDLLNSELNQCAVCQDEFEKGSKVTQMPCKHAYHGDCLIPWLRLHNSCPVCRYELPTDDADYENEVSRW

SEQ ID NO: 2027 - protein, 598 aa, Glycine max
MGVCTSKPQKPSPYALREAEAEADPSQIPKTPLSPAAADTPRRKDDAITGKRSPFYPFYSPSPARFLKKSPAPAGGSRSASSTPRRFFRRPFPPPSPAKHIRAVLARRQGKKASATAAIPEEGEEGAADLDKRFGFSKEFTSRLEVGEKVARGHFGYTCSAKFKKGELKGQQVAVKVIPKAKMTTAIAIEDVRREVKILRALNGHSNLIQFYDAFEDQDNVYIVMELCEGGELLDMILSRGGKYSEDDAKAVMVQILNVVAFCHLQGVVHRDLKPENFLYAKKDESSELKAIDFGLSDFVRPDERLNDIVGSAYYVAPEVLHRSYSTEADVWSIGVIAYILLCGSRPFWARTESGIFRAVLKADPSFDETPWPSLSLEAKDFVKRILNKDPRKRISAAQALSHPWIRNCNNVKVPLDILIFKLMKTYMRSSSLRKAALRALSKTLTADELYYLRGQFALLEPSKNGSISLENVNKALMKYATDAMKESRILDFLSSLNSLQYRRMDFEEFCAAALSVHQLEALDRWEQHARCAYELFDKDGNRAIVIEELVSELGLGPSIPVHVVLHDWIRHTDGKLSFLGFVKLLHGVSSRSLAKVQ

SEQ ID NO: 2028 - protein, 181 aa, Glycine max
MGRGKIEIKRIENSSNRQVTYSKRKNGILKKAKEISVLCDAQVSLIIFGVSGKMHEYISPYTTLIDVLDRYQRASGKTLWDAKHENLSNEIDRLKKENDSMQIELRHLKGEDITSLNYKELMALEDALENGLSGVREKKMEVHRMFKRNGKILEEQNKELSFLLQQHLAVEGIGNMHEQWI

SEQ ID NO: 2029 - protein, 118 aa, Glycine max
  unsure (1)..(118): unsure at all Xaa locations
GSKVFLRLTVPILGDELINTGWNXCRSCNGNPXADRHLLMVPALDXGQVYVVDVKTDPGAASWPKVAEPAIIVQKTGLANPHPSDCLAYGDIMISSLGNEDGNAAGNGSLSIDSELNV

SEQ ID NO: 2030 - protein, 147 aa, Glycine max
  unsure (1)..(147): unsure at all Xaa locations
MDRLKSSPQLMIVSDLDHTMVDHHDSENWSLFRFNALWEAQLSXDSLLVFSTGRSPTLXKQLRKEKPLITPDIAIMSVXGTEITYGKSMVPDXGWVRCLNQKWDKDIVIEETSKFPELKXKAETEQRPHKVSFYVEKDKAKHVTETL

SEQ ID NO: 2031 - protein, 493 aa, Glycine max
MDNLESRISIGLTFNDVLLVPQYSTVNSRSEIDLRTRFSKNVPLNVPIVSSPMDTVTETDMAIEMARWGGLGIVHRYNTIEDQANMISQVKRAESFVITTPYTISQSTTVRAVQALSKAYRVQTFLVTDDTHKPNELADPVQKHKLVGILTGRDLRIALNGDQLVEEIMTPRERLTTTYDPEISLKEAKSLMINNRVEKLPIITEKNDVLGLITLRDIILREQRPLANLDTFGRLRVGAAVGAKDDYLERAKKLIDVGTDVLVVDIANGHAQLCIDAVERLKEQFTVDVVAGSIASREGAENLIKAGADGIRCGIGSGAICTTRLVAGSGVPQLSAIFDAASVCNEAGVPLISDGGNGNSGNMCKALAAGADCVMVGRLIAGCDESPGQVLLKDGKRVKIYRGMAGYGANLSKAQRTNAAEPHSLNFTPEGVEGYIPYCGPLKDVLNQFAQGIKSGMSYCGSHEIMEMKKKAKFIRLSQSAIVESGVHDINKL

SEQ ID NO: 2032 - protein, 82 aa, Glycine max
GQRQRATAAVYLASILEYLTAEVLELAGNASKDLKVKRITPRHLQLAIRGDEELDTLIKGTIAGGGVIPHIHKSLINKTAKD

SEQ ID NO: 2033 - protein, 136 aa, Glycine max; identical to SEQ ID NO: 1603

SEQ ID NO: 2034 - protein, 121 aa, Glycine max
  unsure (1)..(121): unsure at all Xaa locations
VRWCSCNIVSTQDHAGAAITRDSAYVFAWKGETLQEYWWCTERTLDWCPGKGPDLIFDHGCNTTLIIHEGVKDAANSAKTWQFPEPRSCATAATQRXLSTTRGALDTDPKKCHKMQATIRG

SEQ ID NO: 2035 - protein, 114 aa, Glycine max
MPRATSDAKLLIQSLGKAYAATPTNLKIIDFYVGFAVATALIQVAYMGLVGSFPFNSFLSGVLSCIGTAVLAVCLRIQVNKDNKEFKDLPPERAFADFVLCNLVLHLVIMNFLG

SEQ ID NO: 2036 - protein, 132 aa, Glycine max
MTMIRSISMLTLLVTLAASISMVSSASSADFVKKTISSHKIVIFSKSYCPYCRRAKSVFSELNQVPHVVELDEREDGGSIQSALGEIVGRRTVPQVFINGKHIGGSDDTVDAHESGELAKLLGVSESTRAEL

SEQ ID NO: 2037 - protein, 267 aa, Glycine max
  unsure (1)..(267): unsure at all Xaa locations
MAETKWVMKDKRWSLHGMTALVTGGTRGIGHAIVEELAEFGATVHICARNQDDIDKCLEEWKNKGLNVTGSVCDLLCSDQRKRLMEIVGSIFHGKLNILVNNAATNITKKITDYTAEDISAIMGTNFESVYHLCQVAHPLLKDSGNGSIXVFISSVAGLKALPVFSVYAASKGAMNQLTKNLALEWAKDNIRANAVAPGPVKTKLLECIVNSSDGNESINVLVSRTYRGDIGASNHISTLVAFLYVRVMNTLRDTASVLLVDGAHII

SEQ ID NO: 2038 - protein, 123 aa, Glycine max
  unsure (1)..(123): unsure at all Xaa locations
HASDQVKFKRRREGKTDYRARIRLINQDKNKYNTPKYRFVVRFSNKDIVAQIISASIAXLTNYAAAYCTGLLLARRVLKTLEMDEEYEGNVEATGEDYSVEPAESRRPFRALLDVGLVRTTTG

SEQ ID NO: 2039 - protein, 150 aa, Glycine max
HEGNVEATGEDYSVEPAESRRPFRALLDVGLVRTTTGNRVFGALKGALDVFGGHVAAYMKILAEDEPEKYQSHFSEYIKRGIEADGIEALYKKVHAAIRADPTLRKSDKEPPKEHKRYNMKKLTYEERKAKLIARVAAINSAADSDEDDE

SEQ ID NO: 2040 - protein, 298 aa, Glycine max
MVYVKAQKSKAYFKRYQVKFKRRREGKTDYRARIRLINQDKNKYNTPKYRFVVHFSNKDIVAQIISASIAGDIVLAAAYAHELPRYGLEVGLTNYAAAYCTGLLLARRVLKTLDMDEEYEGNVEATGEDYSVEPAESRRPFRALLDVGLVRTTTGNRVFGALKGALDGGLDIPHSDKRFAGFDKEKKELDAEVHRKYVFGGHVAAYMKILAEDEPEKYQSHFSEYIKRGIEADGIEALYKKVHAAIRADPTLKKSDKQPPKEHKRYNMKKLTYEERKAKLVARVAAINSAADNDEDDE

SEQ ID NO: 2041 - protein, 222 aa, Glycine max
  unsure (1)..(222): unsure at all Xaa locations
MASTKERENFVYTAKLAEQAERYEEMVEAMKNVAKLNVELTVEERNLLSVGYKNVVGARRASWRILSSIEQKEEAKGNDVSVKRIKEYRQKVESELSNICSDIMTVIDEHLIPSSSAGEPSVFFYKMKGDYYRYLAEFKSGDERKEAADHSMKAYQSASTTAEAELPPTHPIRLGLXLNFSXFYYEILNSXERACHLAKXAXFDEAISEFGYSEPRSLSKDP

SEQ ID NO: 2042 - protein, 202 aa, Glycine max
MARPQQRYRGVRQRHWGSWVSEIRHPILKTRIWLGTFETAEDAARAYDEAARLMCGARARTNFPFNPNVSHSSSSSSKLLSATLTAKLHRCYMASLQVTRQALASESQRTPPSVQNATTSTTTPISNNFSVKSEQTHAVLPHKRPEEEQESEANRGVKRVKAVENVPLQFKPLEEDHIEQMIEELLDYGSIELCSVISPQAL

SEQ ID NO: 2043 - protein, 278 aa, Glycine max
GFRKIDPDRWEFANEGFLRGHRHLLANIRRRKQPSSQPSSSSSSSSYYYYSSSSQQAQQGHCVEVGRFGLDEEIDRLRRDKHVLMMELVKLRQQQQNTRSYLQAMEERLRGTEIKQQQMMAFLARALKNPTFIQQLLQQKEKRKELEEAMSKKRRRPIERGPNHGVVGEESSSVKVESLVFGDEYGFGVSELEVLAMEMQGYGKGRREQEEEPDEALDQSQERLEKELDEGFWEELFSEGFEGELDTNPTNSQDQDEEEEDHVNVLANRFGYLGSSPK

SEQ ID NO: 2044 - protein, 281 aa, Glycine max
MNERSRDEASPQLLDLISNEREWQMNKRNEGKSSEERKLELRLGPPGEDWSLGGKMKNNNTEREDQSLLSLGCFSPNINMFSPSSANTAVSQPNTSQKRTAPAPVVGWPPIRSFRKNLSSSSSASKPPPPPESQAEQQHNKVAGKKPVDNYANNKGLFVKINMDGVPIGRKVDLNAYDSYENLSSAVDELFRGLLAAQRDSSAGGVHNKQEEEKAITGLLDGSGEFTLVYEDNEGDRMLVGDVPWHMFVSTVKRLRVLKSSEPFWLLPLAVSRTRYHLTQQ

SEQ ID NO: 2045 - protein, 379 aa, Glycine max
  unsure (1)..(379): unsure at all Xaa locations
MSLRKVFRSRKFSKSFKEVLPAEGAAVEGGVAGTVEEAANGNNNGWSSMLPEILGEIVRRVDAAEEQWPNRQNVVACACVCKRWRDITREVVRVPSHTGKITFPSCLKQPGPRDVPHQCLIKRNQKTSTFYLYLALTPXTFTDKGKFLLAARRYRCGTHTEYIISLDADDLSQGSNAYVGKLSSDFLGTNFTIYDSQPPHSGAKPSSGRASRRFASKQISPQVPAGNFEVGQVSYKFNLLKSRGPRRMVCSLKCPVTPVSPTSGSSDSTPVNGHKMHDKEQAASGYTILKNKAPRWHEHLQCWCLNFHGRVTVASVKNFQLVATVDQSQPGGKGDEETVLLQFGKVGDDTFTMDYRQPLSAFQAFAICLTSFGTKLACE

SEQ ID NO: 2046 - protein, 298 aa, Glycine max
MVYVKAQKSKAYFKRYQVKFKRRREGKTDYRARIRLINQDKNKYNTPKYRFVVRFSNKDIVAQIISASIAGDLVLATAYSHELPRYGLEVGLTNYAAAYCTGLLLARRVLKTLEMDEEYEGNVEATGEDYSVEPAESRRPFRALLDVGLVRTTTGNRVFGALKGALDGGLDIPHSDKRFAGFDKEKKELDAEVHRKYVFGGHVAAYMKILAEDEPEKYQSHFSEYIKRGIEADGIEALYKKVHAAIRADPTLRKSDKEPPKEHKRYNMKKLTYEERKAKLIARVAAINSAADSDEDDE

SEQ ID NO: 2047 - protein, 410 aa, Glycine max
  unsure (1)..(410): unsure at all Xaa locations
MRRTGLLHLLCLVIALVSVQAEDAYKYYTWTVTYGTISPLGSPQQVILINGQFPGPRLDLVTNENVILNLINKLDEPFLLTXNGIKQRKNSWXDGVLGTNCPIPPNSNYTYKFQAKDQXGTYTYFPSTQLHKAAGGXGALNVYHRSVIPIPYPNPDGDXTLLXGDXYKTNHKTLRQTLESGKPLAFPDGLLINGQAHSTFTGNPGKTYMFRISNVGFSTSINFRIQGHTLKLVEVEGSHTVQNLYDSLDVHVGQSVAVLVTLNQPPKDYYIVASTRFTETPLTTTAVLHYANSFSSALGPVPAPPVDKYDFDWSMKQARTYRLNLTANAGWANPQGSFHYGKITPTKVIKLANSAPLINGKLRYAVNRVSYVTLDXPLKLADXFNIPGIFSVNLLQNSPSNGPGYIGTSV

SEQ ID NO: 2048 - protein, 128 aa, Glycine max
  unsure (1)..(128): unsure at all Xaa locations
MICAISGEVPDEPVVSKRSGLLFERRLIERYIEDHGKCPVTKEELSMDDIVLVKTNKVVRPRPLQAASIPGLLGIFQNEWDALMLSNFALEQQLHTARQELSHALYQHDAACRVIARLXKERDESXAL

SEQ ID NO: 2049 - protein, 690 aa, Glycine max
FGSSRSHAQKFFTKLEKEAFVKGVPIGQALDIDIPPPRPKRKPSNPYPRKTNVGAPTLHSEAKHGKSLISIASSHGKQALDLEKEPLPEHNVDLRPTTVKENKDGSCLNVFTIIQEAPCSSVSSANKNSTSISVPLRNSCALREFIPSVKEVITRDETNESFVTDELENQKLEIDDGKHTQKTNDTCEVSKLENSGASELVQTEKTDGRNCALTIDGVPGNQNYPRHVPVHVVDGNLGTSTQNLSPDMVFQDSIFQPKGGVNRQPNLVTNSATSHISECQNNAARSSIHQSFPPSPPFAQDDYHSFLHMSSTFSSLIVSTLLQNPAAHAAASFAATFWPYANAETSADSPVCTPDFPSRQIGSPPSVTAIAAATVAAATAWWAAHGLLPLCGPLHTAFACPPASATTVPSMIIDESPQKTERGEIKPQNPPLQDQIPDPEHSEAQHSAPKSPAVSSSKSEDRGDANLDTSPKATNHEMNQAISENPDSNKMKGRKPVDRSSCGSNTTSSSEETELLEKDEKEKEEPKTPDANVLDTELSNRRSRSISNLTDSWKEVSEEGRLAFQALFSREVLPQSFSPTHHLINKDNQIDSIKDNELNTDYKDEDLESKKCSSICDGVQKNLLFVKDNNEEEGLLTIGLGPGKLKTRRTGFKPYKRCSVEANENRIGTACIQGEEKGPKRLRLNGEAST

SEQ ID NO: 2050 - protein, 221 aa, Glycine max
  unsure (1)..(221): unsure at all Xaa locations
REGQXXKRQRIDXXXXMQCATILKSLMSHTYSWVFSKPVDPIALSIPDYFTIISHPMDLGTIKSKLEKNIYSGTEEFAADVRLTFSNAMKYNPPSNDVHLMAKELSKIFDRKWKDLGRKWKCEDEHDKSESETIKETGRKSLDMLSRHRDSLPKKTQVSEHKGMPKIRSLATKDARVSVVVCEGEKSYCNTKEYNMLTAIDEIKLVSTYLLPFFSEKKNIK

SEQ ID NO: 2051 - protein, 133 aa, Glycine max
PTVAAIEAGKDIALANKETMIAGAPFVLPLAHKHNIKILPADSEHSAIFQSIQGLPKGALRKILLTGSGGAFREWPAEKMKDIKLADALKHPIWSLGRKITIDSATLFNKGLEVIKCLLKKRLVIWIYSRLWN

SEQ ID NO: 2052 - protein, 267 aa, Glycine max
MDPKLKEVSQLFDRFKASFLRNDFDNCSNLLSQLKVLLTGFRSLPPLFADTPNAVHELTIARDIYEHAVVLSVKIEDQDAFERDFFQLKPYYTDACNRLPPSPQEYPILGLNLSGLLVQNRIAEFHTELELLSSAALENPCIKHAVELEQSFMEGAYNRVLSARQTVPHDTYVYFMDLLAKTVRDEIAGCSEKAYDYLSIKDAKQMLLFSSDQELLEYIKEEHPEWEIKNDSVFFQKAKESAPCKEIPSLQLINQTLSYARELERIV

SEQ ID NO: 2053 - protein, 231 aa, Glycine max
  unsure (1)..(231): unsure at all Xaa locations
FVWSTISVEGDDLYQKIIVALTSTWRLSICFHSSGDDIEXELQQQDAEIDRFLKVQGGRLRQAVLEKVQATQLQSVSLIEDKILQKLREKEAMVESINKRNIELEDQMEQLTVEAGSWQQRARYNENMIAALKFNLQQAYVQSRDSKEGCGDSEVDDTASCCNGRSLDFHLLSRENTDMKEMMTCKACRVNEVTMVLLPCKHLCLCKDCESKLSFCPLCQSSKFIGMEVYM

SEQ ID NO: 2054 - protein, 117 aa, Glycine max
  unsure (1)..(117): unsure at all Xaa locations
LGTGTTEAVXKIXDVKTXSNVXKXEGHXXPXTAMSFSENGYFLATAALDGVKLWDLRKLRNFRTFSXYDSDTPTNSVEFDFSXTYLAXAXSXIRVYQVANXKTEWNLXKTLPDXSGX

SEQ ID NO: 2055 - protein, 442 aa, Glycine max
MEEETSDAMNLDLNLGPGPEPETGPMSNEAVNLDDWIGEPLQRISEAVRRARQRWRWRHLPLPHPEFHAHFPTEATRHFQIPPEARNISVELNHFLVNSGNGSALQAGEGSVAAEERMEEVPKACDNVNGVAEDETSQKKEDVEKGSGNDGDFFDCNICLDLARDPVVTCCGHLFCWPCLYRWLHLHSDAKECPVCKGEVTLKSVTPVYGRGNNVRGPEEDSALKIPPRPQAKRVESLRQTIQRNAFALPVEEMIRRLGSRIDLTRDLVQPPEPDAARETAERTTSLLSRFLTARGMRREHQNLVAPPEDVMGLAQNNVNTSEAGDPRSRVQSHLLRRTQSHRATLSTLSSALTSAERLVEAYFRSNPLGRNQEQPPPPVDDRDSFSSIGAVINSESQLDTAVEIDSMVSLSTSSSRRRNDASRVSDVDSGDSRAPRRRRLN

SEQ ID NO: 2056 - protein, 111 aa, Glycine max
MLHPFLLLSGGRTNIQFMAAAKLQALWNHPAGPKTIHFWAPTFKWGINIANIADFSKPPEKLSYPQQIAVTATGIIWSRYSTVITPKNWNLFSVNIAMAGTGLYQLSRKLR

SEQ ID NO: 2057 - protein, 312 aa, Glycine max
MKRLGSSDTLGALMTICPPTDEHSPRNNHAYGREFQSMLEGLDEEGCVEEAGHHSEKKRRLSVDQVKALEKNFEVENKLEPDRKLKLAQELGLQPRQVAVWFQNRRARWKTKQLERDYGVLKANYESLKLNYDTLQQDHEALLKEIKELKSRLVQEENNNNTESDVSVKEEMLTTTLCETAIPGSDTKELSYECFNKSDEVGGGSSVFHVDFKDGSSDSDSSAILNEENNNHSPNNNAAISSCGVLQSHGLLSSPSSSSMNNCFQFQKQYQTTTTQYVKMEEHNFLSADEACNFFSDEQAPTLQWYCSEEWS

SEQ ID NO: 2058 - protein, 272 aa, Glycine max
EVEGRDLVGESRSHRDCNIEMETPKRFEGKVAIVTASTQGIGLAIAERLGLEGASVVISSRKQQNVDAAAEQLRAKGIQVLGVVCHVSSAQQRKNLIDKTVQKYGKIDVVVSNAAANPSVDAILQTKDSVLDKLWEINVKATILLLKDAVPHLQKGSSVVIISSIAGFNPPPSLAMYGVTKTALLGLTKALAAEMAPNTRVNCVAPGFVPTNFASFITSNDAVKKELEEKTLLGRLGTTEDMGAAAAFLASDDAAYITGETIVVAGGTPSRL

SEQ ID NO: 2059 - protein, 211 aa, Glycine max
MVRGKTQLRRIENATSRQVTFSKRRNGLLKKAFELSVLCDAEVALIIFSPRGKLYEFASSSMQDTIERYRRHNRSAQTVNRSDEQNMQHLKQETANLMKKIELLEASKRKLLGEGLGSCSLEELQQIEQQLERSVSSVRARKNQVYKEQIDQLKEKERALYAENARLCEQYGGIQPQPATKDPKEIQPYAESSPSSEVETELFIGLLRSSY

SEQ ID NO: 2060 - protein, 77 aa, Glycine max
DPVVVAEDGKVKKYPVIPLPKEKLVDTNGAGDAFVGGFLSQLVHGKAIEECVRAGCYASNVVIQRSGCTYPEKPDFN

SEQ ID NO: 2061 - protein, 319 aa, Glycine max
  unsure (1)..(319): unsure at all Xaa locations
MAVENQREDGGCDRFPVGMRVLAVDDDPICLKVLENLLRKCQYHVTTTNQAVEALTMLRENRNKFDLVISDVNMPDIDGFKLLELVGLEMDLPVIMLSAHGDTKLVMKGVTHGACDYLLKPVRIEELKNIWQHVVRRKNFDSMGSEQGLPMRRRVPNFAGGGSQGLRSENSADQNKRLGKKRKDQSDEEEXGGEENEDDEDPSAQKKARVVWSVELHRKFVAAVNQLGLDKAVPKKILDLMNVEGLTRENVASHLQKYRLYLKKAAQQANMVAALGGSDSYLRMGSIDGYGDFCTSSGSGRITNTTLPSYASTGEGDQL

SEQ ID NO: 2062 - protein, 134 aa, Glycine max
  unsure (1)..(134): unsure at all Xaa locations
NISCVGIIVYRGLSFGLYDSLXPVLLTGNAANNPXASFLLGWSLALGAGXLASYPHATIRRRMLMTSGEAAQYKSSCPCFQEIIAKEGDKSLFKGAGANVLRAIAGAGVLAGYDRLQMMVFGKTYGSGGGSIPL

SEQ ID NO: 2063 - protein, 119 aa, Glycine max
MSGKGAKGLIMGKPSGSEKDKDKKKQPITRSARAGLQFPVGRVHRLLKTRSTAHGRVGATAAVYTAAILEYLTAEVLELAGNASKDLKVKRISPRHLQLAIRGDEELDTLIKGTIAGGG

SEQ ID NO: 2064 - protein, 362 aa, Glycine max
  unsure (1)..(362): unsure at all Xaa locations
MLGVIRHKSIRPAFSAIRHLSSAAKEITVREALNSALDEEMSADPKVFLMGEEVGEYQGAYKISKGLLDKYGPERVLDTPITEAGFTGIGVGAAYYGLRPVVEFMTFNFSMQAIDHIINSAAKSNYMSAGQISVPIVFRGPNGAAAGVGAQHSQCYASWYGSCPGLKVLSPYSSEDARGLLKAAIRDPDPVVFLENELLYGXESFPVXSAEVLDSSFCLPIGKAKIERGGKDVTITAYSKMVGFALKAAETLAKEGISAEVINLRSIRPLDRSTINTSVRKTNRLVTVEEGFPQHGVGAEICTSVIEESFGYLDAPVERIAGADVPMPYAANLERMAVPQVEDIVRAAKRACYRSVPLAASA

SEQ ID NO: 2065 - protein, 360 aa, Glycine max
MLGVIRHKSIRHAFSAIRHLSSAAKEITVREALNSALDEEMSADPKVFLMGEEVGEYQGAYKISKGLLEKFGPERVLDTPITEAGFAGIGVGAAYYGLRPVVEFMTFNFSMQAIDHIINSAAKSNYMSAGQISVPIVFRGPNGAAAGVGAQHSQCYASWYGSCPGLKVLSPYSSEDARGLLKAAIRDPDPVVFLENELLYGESFPVSAEVLDSSFCLPIGKAKIEREGKDVTITAYSKMVGYALKAAETLAKEGISAEVINLRSIRPLDRSTINTSVRKTNRLVTVEEGFPQHGVGAEICTSVIEESFGYLDAPVERIAGADVPMPYAANLERMAVPQVEDIVRAAKRTCYRSVPLAASA

SEQ ID NO: 2066 - protein, 251 aa, Glycine max
MTSSLVKIQGEQVLTNDFQDLSIKDLSEKGTEAEIHKVGSYGSHGGICAICLDKIVLQETALVKGCEHAYCVTCILHWATYREKVTCPQCKHPFEFLNVHRSLDGSIQDYMFEESVCLLLRASWFTPLSVEEHVVHEDAYEDLEDYYQYEDDDDDDDMDEVYYGGSSSLRVIGNRRWGDNGYVRAGRQEARPVHRPNFQDSGASSSSHEPKKKEAGKIITGRRAKRAQKREAADKAAEAKHQQHLVRLGRK

SEQ ID NO: 2067 - protein, 155 aa, Glycine max
MAHLSHKTLVYLPEMRPEHEAEEGQPRKSLGSFSSWPHRLENVFPVYAMGTSNPAVLDSSLHTSDCLDPIWDAVREEAKLEAEKEPILSSFFYATILSHDCLEQALAFALANRLQNPTLLATQLMDILSYVMKHDKSIQQCIRLYIQACKDQDAA

SEQ ID NO: 2068 - protein, 64 aa, Glycine max
  unsure (1)..(64): unsure at all Xaa locations
KKHEGKILQWHAVASWTWDAQDETCGICRMAFDGCCPDCKFPGDECPIIWGACXNHAFHLHCIL

SEQ ID NO: 2069 - protein, 148 aa, Glycine max
  unsure (1)..(148): unsure at all Xaa locations
TRFGALKGALDGGLDIPHNDKRFAGFDKEKKELDVEVHRKYVFGGHVAAYMKILAEDEPEKYQSHFSEYIKRGIEXGIEALYKKVHAAIRADPTLKKSDKQPPKEHKRRMFLRVSASFCKYNLKKLTYEDRKAKFISRVAALNSRCCR

SEQ ID NO: 2070 - protein, 259 aa, Glycine max; identical to SEQ ID NO: 2021

SEQ ID NO: 2071 - protein, 111 aa, Glycine max
  unsure (1)..(111): unsure at all Xaa locations
GCATVHXNXVMXXXFXNQVIAHXELWKNHSPAKYXXKVFVLPKXLDENLAALHLGELGSXXIQISKSQADYISVXPVEGPYNPARCRYLVIELITLKVSEGTTKIGSINRL

SEQ ID NO: 2072 - protein, 245 aa, Glycine max
  unsure (1)..(245): unsure at all Xaa locations
SNKDIVAQIISASIAGDIVLAAAYAHELPRYGLEVGLTNYAAAYCTGLLLARRVLKTLEMDEEYEGNVEATGEDYSVEPAESRRXPFRALLDVGLIRTTTGNPCVWCSLKGALDGGLDIPHSDKRFAGFDKEKKELDAEVHRKYVFGGHVAAYMKILAEDEPEKYQSHFSEYIKRGIEADGIEALYKKVHAAIRADPTLKKSDKQLPKEHKRYNLKKLTYEERKAKLIARVASLNSAADNDEDDE

SEQ ID NO: 2073 - protein, 445 aa, Glycine max
MATIKAVKARQIFDSRGNPTVEVDVILSDGTFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENKEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPY

SEQ ID NO: 2074 - protein, 263 aa, Glycine max
  unsure (1)..(263): unsure at all Xaa locations
KTDNSILYRRLVLLSAXRNQIRKLALSLGLAQQMPDMIEELISKGQQLDAVHFTYEVGLVEKFPPVPLLKSFLKDAKKVAASILEDPNNAGRAAYLAARKEQSALRAVIKCIEEYKLEDEFPPENLKKRLDQLEKVKMVKTEKRKPVAVPANKRTRASNGNGGPMPPAKAGRLIKGYVSSFPAAPPFVRSPSHGQYPVVXHPYPSPPHMYGSRSPPANPYAAYSPEPAPAIAGSYPAAPMNYPHAYGGYGNVLAPPYQQAFYR

SEQ ID NO: 2075 - protein, 218 aa, Glycine max
  unsure (1)..(218): unsure at all Xaa locations
RVSYVGPPPPHELSVLCDAEVALIIFSNRGKLYEFSSTQSMPKTLEKYQKCSFAGPETALQNRENEQLKSSRNEYLKLKARVDNLQRTQRNLLGEDLESLGIKELEHLEKQLDSSLKHIRSTRTQHMVDQLTELQKKEQMFCEANKCLRRRLEESNQVIWQHAWEQSERHSEVQPQQLNGNNFFHPLDGAGEPTLQIGYPSEALTXSCMTTFLPPWLP

SEQ ID NO: 2076 - protein, 259 aa, Glycine max; identical to SEQ ID NO: 958

SEQ ID NO: 2077 - protein, 189 aa, Glycine max
  unsure (1)..(189): unsure at all Xaa locations
EFGTRESRGNEDHVSVIRDYRSKIESELSNICDGILKLLDSRLIPSASSGDSKVFYLKXMKGDYHRYLAEFKTGAERKEAAESTLSAYKAAQDIANAELPPTHPIRLGLALNFSVFYYEILNSPDRACNLAKQAFDEAIAELDTLGEESYKDSTPIMQLLRDNLTLWTSDMQDDGADEIKEAAPKQDDQ

SEQ ID NO: 2078 - protein, 302 aa, Glycine max
  unsure (1)..(302): unsure at all Xaa locations
MVFVKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKCRDLDQEYEGNDVEATGXEDFSVEPADEEEAFXRPLLELGLIRTHHWKRCVWLALRGAWDGGLDIXPHSDKRFXAGSKREEKPLDAEIHRKYIFGGXHVADYMRSLADEEPEKFQTHFSEYIKRGISADDMEAVFKKVHAAIRADPXHGQINQGASQDSQEVQPQEADLXAEEGQPRRKAQRPQQLCRCRR

SEQ ID NO: 2079 - protein, 234 aa, Glycine max
MVECMKKVAKLDLDLTVEERNLLSVGYKNVIGARRASWRIMSSIEQKEESKGNEHNVKLIKSYCQKVEEELSKICGDILTIIDQHLIPSSASAEASVFYYKMKGDYFRYLAEFKTDQERKEAAEQSLKGYEAASATANTDLPSTHPIRLGLALNFSVFYYEIMNSPERACHLAKQAFDEAIAELDTLSEESYKDSTLIMQLLRDNLTLWTSDLPEDGGEDSIKAEETKPSEPEH

SEQ ID NO: 2080 - protein, 268 aa, Glycine max
MKQANRIPSFDLGFNIHHQITGPPFIEILDLLLTQGFGGEEEDDKNNTFFPTPHGQISTSEFVNSQNPPQATNQGIDDIRKKHYRGVRQRPWGKWAAEIRDPKKAARVWLGTFDTAEAAAMAYDAAALRFKGNKAKLNFPERVVMPIPPQTNNNNSTSSSAPTTQSSSSLPPPQSLHNNSSLSAEGFPNLEEYARLLSCSDDDDFQRVALGLYQHHNNEDFICGSSQPPPVPFFVSSSSSSSAMTSSYSDFLGQGGSTGFDEGNKRGS

SEQ ID NO: 2081 - protein, 241 aa, Glycine max
MAHPSAVVSVRRPITHVVFDMDGLLLDTERFYTQVQEIILARYNKTFDWSLKAKMMGKKAIESARIFVEETGISDSLSAEQFLVEREDMLEKLFPTSEPMPGASRLVNHLHAKGVPVCVATGSHKRHFELKTQRHHEIFSLMHHVVLGDDPEVKQGKPSPDGFLAAAKRFEGGPVDPSNILVFEDAPAGVLAAKNAGMSVVMVPDPRLDKSFLDTADQVLNSLLDFNPSEWGLPPFDDNRD

SEQ ID NO: 2082 - protein, 136 aa, Glycine max
  unsure (1)..(136): unsure at all Xaa locations
MAGKGGKGLLAAKTTAANKDKDKDKKRPISRSSRAGIQFPVGRIHRQLKQRVQANGRVGATAAVYLASILEYLTAEVLELAGNASKDLKVKRITPRHLQLAVRGDEELDTLIKGTIAGGGVIPHIHKXLINKAAKE

SEQ ID NO: 2083 - protein, 103 aa, Glycine max
MDPKLVEVTQLFDRFKAAFKASNFDVCSTLLSQLKVLLTKFPSLPPLFQQTPNAVEELKLAREIYEQAVILSVKMEDQDAFERDFCQLKPYYMDTCGIIPPSS

SEQ ID NO: 2084 - protein, 385 aa, Glycine max
MELSSIKDAFDRVAKKQKLSSSKSQEVVDQVGCEIEQALATIQSSHDPSAPVDQKSVLTELKFKLNAIGPLQQLEGSNKELNISLTKYQKLLEKLLNPDISKAYRNVDFDTHIVDQIIANHFYRQGLFDLGDSIINEAGEPDAAALRSQFLEMHQIIGAMRERNLQPALTWVSANREKLVQIGSNLELKIHTLQFVEVLQNGTRADALKYARTYLAPFASLNKGEFPKLMGCLLYAGRLESSPYSELLSPIHWEMTTEELARQFCTLLGQSYENPLSVAVAAGVEGLPILLKLANVMAAKKQEWQEMKQLPVPVELGKEFQFHSIFVCPVSRDQGSEENPPMLLPCLHVLCKQSIMKLSKNSTRTFKCPYCPAEATVANCKQLYF

SEQ ID NO: 2085 - protein, 125 aa, Glycine max
  unsure (1)..(125): unsure at all Xaa locations
MATSEPVQESLVVHYSQPSRPRVLLAASGSVAAIKFESLCRSFSEWAXVRAVATTSSLHFVDRSSLPSGIVLYTDDDEWSTWKKIGDEVLHIELRKWADVMVIAPLSANTLAKIAGGLCDNLLTC

SEQ ID NO: 2086 - protein, 223 aa, Glycine max
  unsure (1)..(223): unsure at all Xaa locations
MAPAVKVYGWAVSPFVARPLLCLEEAGVEYELVSMSRAAGDHRQPDFLARNPFGQVPVLEDGDLTLFESRAIARHVLRKHKPELLGCGSPEAEAMVDVWLEVEAHQYNPAASAIVVQCIILPLLGGARDQAVVDENVAKLKKVLEVYEARLSASRYLAGDDISLADLSHFPFTRYFMETEYAPLVAELPHVNAWWEGLKARPAARXKVTELMPPDLGLGKKAE

SEQ ID NO: 2087 - protein, 153 aa, Glycine max
  unsure (1)..(153): unsure at all Xaa locations
MADSDNDSGGAHNGGKGSEMSPREQDRFLPIANVSRIMKKALPANAKISKDAKETVQEVRVKVSSAFITGEXASDKCQREKRKTINGDDLLWAMTTLGFEDYVEPLKGYLQRFREMEGEKTVAARDKDAPPLTNATNSAYESANYAAAALVES

SEQ ID NO: 2088 - protein, 294 aa, Glycine max
MSEALEEVVPSMKGGCEEEGLNLEATELRLGLPGCESPEREGVFKSVVVSGAKRGFSDAIDGNWNGGGSEKDAAALFSPTSRGAVSVSVSAAKSLTLTATDCTNQPTALGASVLKETVPHSPKPLHENKPQISAPAAKAQVVGWPPIRSFRKNSMASQPQKNDAAADAEAKSGCLYVKVSMEGAPYLRKVDLNSFTTYKDLSLALEKMFSCFTLSQCGSYGVSSRENLSESRLMDLLHGSEYVLTYEDKDGDWMLVGDVPWEMFTESCKRLRIMKSSEAIGLAPRAMEKCKSRY

SEQ ID NO: 2089 - protein, 239 aa, Glycine max
  unsure (1)..(239): unsure at all Xaa locations
LIQVNIAAPGADQSVYFPYTDKVKRLTQFFPAIEDLLYSKVDTNEHIGYLENRRKPIIFSMARFDVFINLTGLVEWYGNNQRLRKMVNLVIVGGFFDPLKSKDREEMTEIRKMHDLVAKYQLKGQFRWIAAQTDRYRNGELYRFIADTKGAFVQPALYEAFGLTVIEAMNCGLPTFATNQGGPAEIIGDGISGFHIDPHNGEEIKHXIADFFXKCLQDSAHWKXISAAGXGTHNECYTW

SEQ ID NO: 2090 - protein, 92 aa, Glycine max
PSFFQIIDLYVIYAVFTALIQVVYMALVGSFPFNSFLSGVLSCVGTAVLAVCLRIQVNKDNKEFKDLAPERAFADFVLCNLVLHLVIMNFLG

SEQ ID NO: 2091 - protein, 150 aa, Glycine max
GSSSSSSSSSKDAQDLFRALRPPSFSPPSFFQIIDLYVIYAVFTALIQVVYMALVGSFPFNSFLSGVLSCVGTAVLAAQHGTYKPATYIGINLVLVFLIIVILLHFGPVCLRIQVNKDNKEFKDLAPERAFAEFVLCNLGLHLGIMNFLG

SEQ ID NO: 2092 - protein, 530 aa, Glycine max
  unsure (1)..(530): unsure at all Xaa locations
MAEIEGSPGSSMHGVTGREQTFVASVASPIVPTDTTAKFALPVDSEHKAKVFKLFSLANPHMRTFHLSWISFFTCFVSTFAAAPLVPIIRDNLNLTKSDIGNAGVASVSGSIFSRLAMGAVCDMLGPRYGCAFLIMLSAPTVGCMSFVKDAAGYIAVRFLIGFSMATFVSGLSFMSTMFNCCTIPVTLVPAPQWGNMFLPPSKDVNKSTEEYYYTAEWNEEEKQKGLHLNSLKFAENSGXLVLTLGQDLPDGNLGALRKKGDVAKDKFSKVLWYAITNYRTWIFALLYGYSMGVELTTDNVIAEYFYDRFNLKLHTAGIIAASFGMANLVARPFGGYASDVAARLFGMRGRLWTLWILQTLGGVFCIWLDRANSLPIAVLAMILFSIGAQAACGAAFGIIPFISRSSLGIISGLTGAGGNFGSGLTQLVFFSTSKFSTSTGLSLMGVMIVACTLPVSVVHFPQWGSMFLPPSKDVSKSTEEFYYTSEWNEEEKQKGLHQQSLKFAENSRSERGKRVASAPTPPNTTPTHV

SEQ ID NO: 2093 - protein, 273 aa, Glycine max
  unsure (1)..(273): unsure at all Xaa locations
STSPTAAPHLREGGGVFGEEMAKRLREAAPWGEAPGSPVNGLDDGCLMHIFSFLSPIPDRYNTALVCHRWRFLACHPRLWLRVERPLRDVKEPGVYPDLEAAISAARPGDTILIAAGGTYLACNIQIKKPLCIIGGGELPDDTVLTCSRGSDNALEFLSTCKIANLTIKAELGCCLLHRSGKLTIQECLLQCEPNPLDYLSFPIVSTAIEYNPLSSSLKEQQGHGVTVVRPRIEGGARAIRTNGTLALQRVRAIYXRRSVFFWFEVGEKLEPL

SEQ ID NO: 2094 - protein, 394 aa, Glycine max
  unsure (1)..(394): unsure at all Xaa locations
MDLSSLSSYRTVGVTPSDPRKSLPQWGLHFLSYTHRLNQIKKRSSGVYASLSERERGEYYSQRPPTPLLDTVNYPIHMKNLSTXIADELRSDVIFSVSRTGGHLGSSLGVVELTVALHYVFNAPQDKILWDVGHQSYPHKILTGRRDQMHTMRQTNGLSGFTKRSESEFDCFGTGHSSTTISAGLGMAVGRDLKGDKNNVVAVIGDGAMTAGQAYEAMNNAGYLDSDMIVILNDNKQVSLPTANLDGPIPPVGALSSALSKLQSNRPLRELREVAKGVTKQIGGPMHELAAKVDEYARGMISGSGSTLFEELGLYYIGPVDGHNIDDLVSILNEVKSTKTTGPVLLHVVTEKGHGYPYAERAADKYHGKCGITNFLTFIDMTHQINSSHFAHSN

SEQ ID NO: 2095 - protein, 389 aa, Glycine max
MVDQVQHPTIMDKVAGQLHLRSGLSSGIRSYDGAYRHPAMYQRPSFGNYSNAALQFPVMPTCKATMDLSATATSASPVFVAAPAEKGHFLLDFLMGGVSAAVSKTAAAPIERVKLLIQNQDEMIKTGRLSEPYKGIGDCFKRTMADEGAISLWRGNTANVIRYFPTQALNFAFKDYFKRLFNFKKDRDGYWKWFAGNLASGGAAGASSLLFVYSLDYARTRLANDAKAAKKGGERQFNGLVDVYRKTLASDGVAGLYRGFNISCVGIIVYRGLYFGLYDSVKPVVLTGSLQDSFFASFALGWLITNGAGLASYPIDTVRRRMMMTSGEAVKYKSSLDAFTQILKNEGAKSLFKGAGANILRAVAGAGVLAGYDKLQVLVFGKKYGSGGA

SEQ ID NO: 2096 - protein, 367 aa, Glycine max
MEKELVELYEAAKKAADAAISGDGKHEESRCIDALEQLKKFPVNYKILVNTQVGKHLKVLTKHPRLKIKAFAIDLIEIWKGIIIKETSKNKNGGSDSKVESANGEKSKAGKMQKSPSVKVEKGETVKVEKIDRNGTTKSSFENMKKVQNDVKNERTDRAASVKMEKIAEEKPISGAKKMSSSSTAPPKLKTMIKSNDATRDKIREILHEALSKVTREADEDLVAVVNDSDPIRVAVTVESVLFEKWGPSNGAQKVKYRSLMFNLKDSNNPDFRRKVLLGVVEPEQLINMSTAEMASEQRKQEYQKITEKALFECERGGQPKATTDQFKCGRCGQRKTTYYQMQTRSADEPMTTYVTCCVCNNRWKFC

SEQ ID NO: 2097 - protein, 381 aa, Glycine max
  unsure (1)..(381): unsure at all Xaa locations
MDRDNKSPPPSSLYVKSSSSSFSHDDISAMPENPPKNRGHRRAHSEIITLPDDLSFDADLLPDDDNDLLSLYLQFDQLDSSSLPPPPPPPPPHNNINERSTRVRHQHSHSMDGSIHLEMLLSAASAADDVSGGIDTKKAMSADKLAELALVDPKRAKRIWANRQSAARSKERKMRYISELERKVQTLQTEXTSLSAQLTLLQRDTHGNDCXLKRVDCPIASMEQHVEIHMDXTDAFSELKLRLQTMEQQVHLQDALNDALKEEIQHLKALTGQVMPNGGPVNFASFGGGQQFYPNNQAMHTLLAAQKFQQLQIHSQKQQQHQLQQQQQFQHQLQQQQQFHQQQQQLQLQQQLQQQQQQQQQQQQQQTAATGTVTSTNGGHE

SEQ ID NO: 2098 - protein, 279 aa, Glycine max
MESSPSSSSSSMSSSSGSDTSGGGGGGAVTWFGMSFPFRSPLSLVMDYCAREDSAEPVIIIPRTRPRFQAHAESASASSSDSDENACNGAAEEVAIRIIGAGEQESGSSPSSSSRGRGGEPGCEEAVVGRSGMLSSEARRRMAEERVPLVSLDDGIGGVRESSSSSSSSSSSSSSSSTYQRYDIQQVAKWIEQILPFSLLLLIVFIRQHLQGFFVTICISAVMFKSNEIVKKQTALKGDRKVSVLLGISFAFVLHVISITSALCYYSVRFMVRSTFLKI

SEQ ID NO: 2099 - protein, 332 aa, Glycine max
  unsure (1)..(332): unsure at all Xaa locations
MLSSRRRMAEERVPLVSLDDGIVGARDSSSSSSSSTYQRYDIQQVAKWIEQILPFSLLLLIVFIRQHLQGXFFVTICISAVMFKSNEIVKKQTALKRDRKVSVLLGISFAFMLHVISIYWWYRNDDLLYPLAMLPPKTPPPFWHTIFIILVNDTLVRQAAMAFKCLLLIYYKNGRGHNFRRQGQMLTLVEYTLLLYRALLPTPVWYRFFLNKDYGSLFSSLTTGLYLTFKLTSVVEKVQCFVSALKALSKKEVHYGVHATTEQVNAAGDMCAICQEKMQAPILLSCKHMFCEECVSEWFERERTCPLCRALVKPADLRTFGDGSTSLFFQLF

SEQ ID NO: 2100 - protein, 278 aa, Glycine max
  unsure (1)..(278): unsure at all Xaa locations
RAKSLTSLTFALPSLXFEVKMVEQTQQPTIFQKASGQILRSGVSQDIHGYTSGFQRRATYGNYSNAAFQYPLAATSRIVTTTSPVFVQAPGEKGFSSFAIDFLMGGVSAAVSKTAAAPIERVKLLIQNQDEMLKAGRLSEPYKGIGDCFGRTIKDEGFGSLWRGNTANVIRYFPTQALNFAFKDYFKRLFNFKKDKNGYWKWFAGNLGSGGAAGASSLLFVXSLDYARTRLGHDSXAARREVKAVPWFNVYRDPQPEESLTLPGITSPVWDHGHGAPT

SEQ ID NO: 2101 - protein, 518 aa, Glycine max
  unsure (1)..(518): unsure at all Xaa locations
MAESLKDYEEDFENPEKKPRRNKYAFACAILASMTSILLGYDIGVMSGAALYIQRDLKVSDVQIEILNGIINLYSPVGSFIAGRTSDWIGRRYTIVLAGAILFFGDMNTGFFPKXAFPIFPSNITCVTFSKDCLIRHVWNSEPXPTTHRMFLLISLVVFLNGGILIGYVSNYGXSMLALRLGWLVMLVVIDIPSILIGVAVLAMPESPRWLVAKGRLGEAKRVLYKISESEEEARLRLADIKDTAGIPQDCDDDVVLVSKQTHGHGVWRELFLHPTPAVRHIFIASLGIHFFAQATGIDAVVLYSPRIFEKAGIKSDNYRLLATVAVGFVKTVSILVATFFLDRAGRRVLLLCSVSGLILSLLTLGLSLTVVDHSQTTLNWAVGLSIAAVLSYVATFSIGSGPITWVYSSEIFPLRLRAQGVAIGAAVNRVTSGVIAMTFLSLQKAITIGGAFFLFAGVAAVAWIFHYTLLPETRGKTLEEIEKSFGNFCRKPKAEEGLDDNVEIQLKTRDQTLTSVD

SEQ ID NO: 2102 - protein, 302 aa, Glycine max
  unsure (1)..(302): unsure at all Xaa locations
GMGSSKNCAICLPQRVSPATLSLILDYCHFHQVPGRSNKERKSYDEKFIRMDTKRLCELTSAADSLQLKPLVDLTSRALARIIEGKSPEEIREIFHLPDDLTEVSGXEEKLEPLKNTTDDPRIRLLNRLYAKKRKELKERERLKNVEVEEEHVDERSVDDLLSFMNGNDGDPKEVKTSKNKKKNRRKKEQQQKNSSLKEASEVNKEVNGQSIRHQSAEADRIAETSNSHTEDVFAHREFDDGDIDDGIDPALKEKIDREVEDFARRLNSDWPERMQELLSSGQERKMMLFTPNGNSFLRRNA

SEQ ID NO: 2103 - protein, 305 aa, Glycine max
MVMKSKLDKYEKLEKLGEGTYGVVYKAQDKTTKDLFALKKIRLESEDEGIPSTAIREIALLKELQHPNVVRIHDVIHTNKKLILVFEYVDTDLKKFMNQFDKGLDAKVIKSLLYQLVRGVAHCHQMKVLHRDLKPQNLLVSQEGVLKLGDFGLARAFGIPVKNYTNEVVTLWYRAPDILLGSKNYSTSVDIWSIGCIFVEMLNQKPLFPGSSEQDQLKKIFKIMGTPDATKWPGITDLPDWKAENFEKYPGESLSKICPKLDADGLDLLDKMLRCNPTERISAKTALSHPFFKDIPENLKKLYNN

SEQ ID NO: 2104 - protein, 319 aa, Glycine max
MMEHNIIVNNNVIAPFVIKTYNMVNDPTTDKLITWGPANNSFIVLDPLDFSHSLLPTFFKHNNFSSFVRQLNTYGFRKVDPDRWEFANEWFLRGQKHLLRNIVRKKHGGAGRTNSNSHYSHPLKLEELDDEAMVMEIARLKEEQKALEEELHEMNKRLETTEKRPQQMMAFLCKVVEDPQILSRILREREKKHLGEKKRRLIPPPPPTAATSSSSSSGIKTEFEEDEGNYNIKSSSPETGLEIDNNSNNICSPPPLGCWGEQGCYGYNCASVPAPLTVVAPAFPTMGGGYLRRGGFWGEMAAEGNAVPPYPFSLLEGGF

SEQ ID NO: 2105 - protein, 200 aa, Glycine max
  unsure (1)..(200): unsure at all Xaa locations
NQSGFVESFGGLSFSLSHLLCFLTNHYKIKSSLSILPQADTIQYHLSNSLINSRLFSLTITSSCRRAHVGQVIKCKAXRVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMIHDSQTRNL

SEQ ID NO: 2106 - protein, 319 aa, Glycine max
  unsure (1)..(319): unsure at all Xaa locations
MANFTSSSSSSCSPLPLSLTMSHISPPSSSAAFDDSSEDACSICLEPFSTHDPATITSCKHEYHLHCILEWLQRSKECPICWQLLILKDPASQELLNAVEAEKRLSSRTVYSHAFMDSRSPLQRLNNDQDDSWSDDSDFDEQLMQHLVSAASRARYICRSKRQRSPGSRSFRGSLVFNSFXMASGMQPTLTTSPTSGVPSAAHIQSPTSTFSCVGMVTTNTSSESDMPSKPRVIYSQPSPESARRLNTSEMFSFSESFKSKLSAASARCKESISKNTRGLKEKLIARNAXVKELSKGVQCEMNAXIACVARMIERLDLT

SEQ ID NO: 2107 - protein, 95 aa, Glycine max
FGAECPHPQECFLADISTLARYNVFSLSLLFTLLVLRWNYLACHPRLWLRVDRSVKELSEPGVFPNIETAVSASRPGDTILIAAGGTHRVANIQI

SEQ ID NO: 2108 - protein, 397 aa, Glycine max
  unsure (1)..(397): unsure at all Xaa locations
APTRPYGCEKTTEGGLNKEVPNIVSEFVGGTSLEIHERYKTITEKNIRRLDQPSQNSGEYESTIGICLEKSLSAALDSFDNLFCRRCLIFDCRLHGCSQPLIYHSEKQTVWSDPEGDRKPCSDQCYLQLKVVKNVTEDSTSGSDQNKRTTITEEADVILAPSIIEEPSNQSIAPFPTEGDCLGISQFKMVLSQARGKNGKSQISQTQHSLLANSDSSKNINFGACDESIHTITSGLLDKSVKDNSNKLIDSSSTCCSDEQDKSIGDGPKDPTNETEFKKLSNSMEGIVDGMLRRXSDWKPLEKELYLRGVELFGRNSCLIARNLLPGLKTCMEISSYMHSGGVSMPHGSIVAPSSIMEDKGKFDADCTVRITTPSVSIFFILHSCVLTFFLLFSFWR

SEQ ID NO: 2109 - protein, 242 aa, Glycine max
MATMLTKEHGLNLKETELCLGLPGGGGGGGGGGEVETPRATGKRGFSETVDLKLNLHSKEDLNENLKNVSKEKTLLKDPAKPPAKAQVVGWPPVRSYRKNMMAVQKVSTEDVAEKTTSSTANSGAFVKVSMDGAPYLRKVDLTMYKSYKELSDALAKMFSSFTMGNYGAQGMIDFMNESKLMDLLNSSEYVPSYEDKDGDWMLVGDVPWEMFVESCKRLRIMKGSEAIGLAPRAMEKCKSRS

SEQ ID NO: 2110 - protein, 818 aa, Glycine max
  unsure (1)..(818): unsure at all Xaa locations
LLKSFPSQWATDRLTRVHSLRERLDETLTANRNEILALLSRIEAKGKGXILQHHQVIAEFEEIPEENRQKLTDGAFGEVLRSTQEAIVLPPWVALAVRPRPGVWEYLRVNVHALVVEELQPAEYLHFKEELVDGSSNGNFVLELDFEPXNAAFPRPTLNKSIGNGVQFLNRHLSAKLFHDKESLHPLLEFLRLHSVKGKTLMLNDRIQNPDALQHVLRKAEEYLGTVPPETPYSEFEHKFQEIGLERGWGDNAERVXLESIQLLLDLLEAPDPCTLETFLGRIPMVFNVVILSPHGYFAQDNVLGYPDTGGQVVYILDQVRALENEMLHRIKQQGLDIVPRILIITRLLPDAVGTTCGQRLEKVFGTEHSHILRVPFRTEKGIVRKWISRFEVWPYLETYTEDVAHELAKELQGKPDLIVGNYSDGNIVASLLAHKLGVTQCTIAHALEKTKYPESDIYWKKLEERYHFSCQFTADLFAMNHTDFIITSTFQEIAGSKDTVGQYESHTAFTLPGXLYRVVHGIDVFDPKFNIVSPGADQTIYFPHTETSRRLTSFHPEIEELLYSSVENEEHICVLKDRSKPIIFTMARLDRVKNITGLVEWYGKNAKLRELVNLVVVAGDRXRKESKDLEEKAEMKKMYGLIETYKLNGQFRWISSQMNRVRNGELYRVICDTXRGAFVQPAVYEAFGLTVVEAMTCGLPTFATCNGGPAEIIVHGKSGFHIDPYHGDRAADLLVDFFEKCKLDPTHWDKISKAGLQRIEEKYTWQIYSQRLLTLTGVYGFWKHVSNLDRRESRRYLEMFYALKYRKLAESVPLAAE

SEQ ID NO: 2111 - protein, 488 aa, Glycine max
  unsure (1)..(488): unsure at all Xaa locations
PSSSLESSTAMTTATEKLSALKSAVAGLNEISESEKNGFISLVSRYLSGEAQHVEWSKIQTPTDEVVVPYDTLAPTPDGSSDVKNLLDKLVVLKLNGGLGTTMGCTGPKSVIEVRDGLTFLDLIVIQIENLNSKYGSNVPLLLMNSFNTHDDTQKIVEKYQNSNIEIHTFNQSQYPRLVAEDFLPLPSKGHTDKDGWYPPGHGDVFPSLLNSGKLDALLSQGKEYVFVANSDNLGAIVDLMYLTHXVEILNHLIQNKNEYCMEVTPKXTLADVKGGTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARANPENPSIELGPEFKKVSNFLGRFKSIPSIVELDSLKVAGNVWFGAGVILKGKISIVANPGVKLEVPDGAVISDKEINGPEDLL

SEQ ID NO: 2112 - protein, 170 aa, Glycine max
  unsure (1)..(170): unsure at all Xaa locations
MASADVEFRCFVGGLAWVTGNDALEKAFSIYGDIVESKVINDRETGRSRGFGFVTFASEQSMKDAIAGMNGQDLDGRNITVNEAQTRASRGGGXXGGFGSGGGYNRGSGGYGGGGGGGGYGGRREGGYNRNGGGGGGGYGGGRDRGYGGDGGSRYSRGGEGGGSDGNWRN

SEQ ID NO: 2113 - protein, 186 aa, Glycine max
MGGCCCSARKPHLHGTPVYYYCPPTLEEHESLTSNDGTATSLTTGLLVGLNLETSTPDTYHPPPAPLPYDMVLGGPASTDSESGRETVSGSSFETLITCKDPEESDCKIKANSAPISPSKAGLSKSKEFHALVTEEEDGCPICLEEYDVENPKTLTKCEHHFHLSCILEWMERSDSCPICDQEMIF

SEQ ID NO: 2114 - protein, 156 aa, Glycine max
MWKSLASRDATIMGSRNGHAPIFLWYTLHAPIFLWYTLNRKGYRGFQKEVQKCLRNAHYFKGRLVEAGIGAMLNELSSTVVFERPHDEEFIRKWQLACKGNIAHVVVMPNITIEKLDDFLNELLDKRATWFQDGKDHPYCISSDVGEKNCLCALHK

SEQ ID NO: 2115 - protein, 133 aa, Glycine max
  unsure (1)..(133): unsure at all Xaa locations
MMRLRWSLVVTVTFAVLLFWIGSLQVQASNSVSAFVQNAIYSNRIAVFSKSYCPYCLRAKRLLAELNEKPXVVELDLRDDGYQIQSVLLDLIGRRTVPRVFGNGKHIGGSDDLGAAGQSGEWRKLVGARWSGC

SEQ ID NO: 2116 - protein, 500 aa, Glycine max
  unsure (1)..(500): unsure at all Xaa locations
RRLQKPQIAVGMRNVDYKRARHFEVDLSAFRNVLEIDKERMIARVEPLVNMGQISRVTVPMNLALAVVAELDDLTVGGLISXYGIEGSSHKYGFRXTVVASKVVCLINMXLFADTVGALEYILAXGTLRKPLAFNEYSDLYYAIPWSQGTLGLLVAAEIKLIPVKEYMKLTYKPVVGTLQDLAQAYCDSFAPRDGDQDNEEKVPDFVEGMIYTPTEGVMMTGRYASKEEAKKKGNKINSVGWWFKPWFYQHAQTALKKGEFVEYIPTREYYHRHTRCLYWEGKLILPFADQFWFRYLFGWLMPPKVSLLKATQGDAIRNYYHEMHVIQDMLVPLYKVGDALEWVHREMEVYPIWLCPHKLFKLPVKTMIYPEPGFELHRRQGDTQTAQMYTDVGVYYAPGPVLRGEVFDGAEAVRKMENWLIENHGFQPQYAVSELSEKNFWRMFDAGLYEHTRRKYGAVGTFMSVYYKSKKGRKTEKEVQEAEQAHLETAYAEVDQPVD

SEQ ID NO: 2117 - protein, 463 aa, Glycine max
MVLTSTATHPDEQDQSLNYTFASRYVREPIPKFKMPEKSIPKDAAYQIINDELMLDGAPRLNLASFVTTWMEPECDKLIMASLNKNYVDMDEYPVTTELQNRCVNIIANLFHAPISDDETAVGVGTVGSSEAIMLAGLAFKRKWQTKRKAEGKPYDKPNIVTGANVQVCWEKFARYFEVELKEVKLKEGYYVMDPAKAVEMVDENTICVAAILGSTMTGEFEDVKLLDELLTKKNNETGWDTPIHVDAASGGFIAPFLYPDLEWDFRLPLVKSINVSGHKYGLVYPGVGWVVWRSKDDLPDELVFHINYLGSDQPTFTLNFSKGSSQIIAQYYQLIRLGFEGYKNIMENCWENARVLKEGIERTGRFNIISKDIGVPLVAFSLKDSSQHTVFEIADHLRKFGWIVPAYTMPPDAQHIAVLRVVIREDFSRGLAERLAADIEKVAKLLDTLPSPLTTKAVHITA

SEQ ID NO: 2118 - protein, 272 aa, Glycine max
MAEAGSSINRGARWSLNGTTALVTGGTRGIGHAIVSDLAAFGAAVHTCSRTQTELNKCLQEWQSLGFQVTGSVCDVSSPSQREKLIEEVTSILNGKLNIYVNNVGTNFRKPTIEYTAEEYSQLMTVNLDSSFHLCQLAYPLLKASENGSIVFISSVAGVVSLGTGAVYAASKAAINQLTKNLACEWAKDNIRSNCVVPATTNTPLVEHLLSDKKYVEEMMSRTPIGRIAEPEEVSALVAYLCLPAASYITGQVVLVDGGLSVNGFQTSMRIT

SEQ ID NO: 2119 - protein, 163 aa, Glycine max
GILRTKNNIENSKVLSFSSTCSNSNSTMVARLAVTALVLIALATISLQSSASASSVGKFVDETITSHKIVIFSKTYCPYCRRAKAVFKELNQVPHVVELDEREDGSKIQDIMVNIVGRRTVPQVFINGKHLGGSDDTVEAYESGHLHKLLGIEKKDHDDHDDL

SEQ ID NO: 2120 - protein, 246 aa, Glycine max
MGRGKVELKRIENKINRQVTFAKRRNGLLKKAYELSVLCDAEVALIIFSNRGKLYEFCSGHSTAKTLERYHRCSYGALEVQHQPEIETQRRYQEYLKLKSRVEALQQTQRNLLGEELEHLDVNDLEQLERQLDSSLKQIRSNKTQQMLDQLSDLHRKEEMLLETNNILRNKLEEINVALQPTWEAREQNAPYNCHPPQTEGYYETATAHCSSTLRIGYDSSGLNEAGGAAGASAQNASEFMHGWMN

SEQ ID NO: 2121 - protein, 168 aa, Glycine max
VIEYRCFVGGLAWATDSDALEKAFSHYGEIVESKVIIDRETGRSRGFGFVTFASEQAMKDAIEGMNGQNLDGRSITVNEAQSRGRGGGGGGYGGGGGYGGGGYSRGGGGYGGGGRREGGGGGYNRNGGGGGYGGGGGYGGGFICCTGGVTGAPVPTTNLRISPPPPSF

SEQ ID NO: 2122 - protein, 409 aa, Glycine max
MCKCKYYRYTRIKYAQEAPPALLLRFLLVCTIVALRAPVAQPPILRIPNHLIETTNTFTIVHQRYRTQISGSNRRAMSKARVYTDVNVLRPKEYWDYESLTVQWGDQDDYEVVRKVGRGKYSEVFEGINVNSNERCVIKILKPVKKKKIKREIKILQNLCGGPNIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDELNAYLNKYHLELDPQLDALVGRHSRKPWSKFINADNQHLVSPEAIDFLDKLLRYDHQDRLTAREAMAHPYFSQVRAAESSRMRTQ

SEQ ID NO: 2123 - protein, 305 aa, Glycine max
MMAVARKEMDRIKGPWSPEEDEALQKLVERHGPRNWSLISRSIPGRSGKSCRLRWCNQLSPQVEHRAFTPEEDETIIRAHARFGNKWATIARLLSGRTDNAIKNHWNSTLKRKCASFMTADEAAGGGFSPRPLKRSFSAGTAVPPPGSPSGSDVSESSAAPGVVSVSVSVSPSQVFRPVPVRPVVETASSQDDADAEDAGPTTSLSLSLPGVESSEISNRTSTVPVMPVNTVAVAAPVPLPAPEVGLGALNLNAEFMAVMHEMIRKEVRSYMEQQNGMMCFQGMEMMEGFRNVSVKRIGISRVDS

SEQ ID NO: 2124 - protein, 211 aa, Glycine max; identical to SEQ ID NO: 2059

SEQ ID NO: 2125 - protein, 134 aa, Glycine max
MSGKGAKGLITGKTSAANKDKDKKKPISRSSRAGLQFPVGRIHRLLKSRTTANGRVGATAAVYSAAILEYLTAEVLELAGNASKDLKVKRITPRHLQLAIRGDEELDTLIKGTIAGGGVIPHIHKSLINKSSKE

SEQ ID NO: 2126 - protein, 72 aa, Glycine max
  unsure (1)..(72): unsure at all Xaa locations
MAAPLPRXSRREPCTMAKLAEQAXERYEEMVEFMEKVSAAADNEELTVEERNLLSVAYKNVIGARRASWRII

SEQ ID NO: 2127 - protein, 327 aa, Glycine max
MVLLSKATTEQYSYIKNYMPTAFSSTIPIVDLSKPDAKTLIVKACEEFGFFKVINHGVPMETISQLESEAFKFFSMPLNEKEKVGPPKPFGYGSKKIGHNGDVGWVEYLLLNTNQEHNFSVYGKNPEKFRCLLNSYMSSVRKMACEILELMAEGLKIQQKDVFSKLLMDKQSDSIFRVNHYPACPEMTLNDQNLIGFGEHTDPQIISLLRSNNTSGLQIYLRDGNWISVPPDHKSFFINVGDSLQVMTNGRFRSVRHRVLANGFKSRLSMIYFGGPPLSEKIAPLSSLMKGKESLYKEFTWFEYKKSIYGSRLSKNRLEHFERIAAS

SEQ ID NO: 2128 - protein, 342 aa, Glycine max
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGKYCVCFDPLDGSSNIDCGVSIGTIFGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 2129 - protein, 342 aa, Glycine max; identical to SEQ ID NO: 2128

SEQ ID NO: 2130 - protein, 216 aa, Glycine max
WNRQEDSLSRARNGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 2131 - protein, 154 aa, Glycine max
  unsure (1)..(154): unsure at all Xaa locations
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGKYCVCFDPLDGSSNIDXGVSIGTIFGVYALKDVHEPTIED

SEQ ID NO: 2132 - protein, 98 aa, Glycine max
MTSVYMNSMVADVHRTLLYGGIFLYPADKKSPNGKLRVLYEVFPMSFLMEQAGGQSFTGKERALDLVPTKLHERSPIFLGSYDDVGENQALYPAGGKN

SEQ ID NO: 2133 - protein, 617 aa, Glycine max
MEWDSNSDLSGDEEEEGFVFNDGDDAGPLPFPFPVVENLLQTAPCGFVVTDAHEPDNPIIYVNTVFEIVTGYRAEDVLGRNCRFLQCRGPFAKRRHPLVDSTVVSEIRRCLEEGIEFQGELLNFRKDGSPLMNRLRLTPIYGDDETITHVIGIQFFTEANIDLGPVPGSTIKESAKSSDRFRSVLSSLQTLPVGGRNVSRGVCGIFQLSDEVLSLKILAQLTPRDIASVSSVCRRLYELTKNEDLWRMVCQNAWGSETTHVLETVPGARRLGWGRLARELTTLEAAAWRKLTVGGAVEPSRCNFSACAVGNRVVLFGGEGVNMQPMNDTFVLDLNSSNPEWQHVQVSSPPPGRWGHTLSCVNGSHLVVFGGCGRQGLLNDVFVLDLDAKPPTWREISGLAPPLPRSWHSSCTLDGTKLIVSGGCADSGVLLSDTFLLDLSMEKPVWREIPVAWTPPSRLGHTLSVYGGRKILMFGGLAKSGPLRFRSSDVFTMDLSEEEPCWRCVTGSGMPGAGNPGGIAPPPRLDHVAVSLPGGRILIFGGSVAGLHSASQLYILDPTDEKPTWRILNVPGCPPRFAWGHSTCVVGGTRAIVLGGQTGEEWMLSELHELSLASSAI

SEQ ID NO: 2134 - protein, 471 aa, Glycine max
MKQRQIFARVVILLLMFLVGARFAKAKEGGEEAADRILKLPGQPKVSFKQFSGYVTVNKVAGRALFYWLAEAAQNPLTKPLVIWLNGGPGCSSVAYGASEEIGPFRINKTASGLYKNKFSWNSVANLLFLEAPAGVGFSYTNRSSDLLDTGDRRTAQDSLEFVIQWLERFPRYKTRELYITGESYAGHYVPQLAKEIMTYNAKTKHPINLKGIMVGNAVTDNYYDNLGTVTYWWSHAMISDQTFRQLMSRCDFHRQKESDECESVYSYAMDQEFGNIDQYNIYDPPCNNSDGSSSGSGSATRRTMRLPHRPHVAFRHWSGYDPCTEKYAEIYYNRPDVQKALHANKTGIPYRWTACSEVLNRNWNDTDVSVLPIYRELIAHGIRVWVFSGDVDSVVPVTATRYALAQLKLSTKIPWYPWYVKNQVGGWTEVYEGVTFATVRGAGHEVPLFKPRAALQLFTSFLTGKPLPKS

SEQ ID NO: 2135 - protein, 740 aa, Glycine max
  unsure (1)..(740): unsure at all Xaa locations
MESCNCIDPQVPADDLLMKYQYISDFFIALAYFSIPLELIYFVKKSAVFPYRWVLVQFGAFIVLCGATHLINLWTFRIHSRTVAVVMTTAKVLTAVVSCATALMLVHIIPDLLSVKTRELFLKNKAAELDREMGLIRTQEETGRHVRMLTHEIRSTLDRHTILKTTLVEMGXRTLALEECALWMPTRTGLELQLSYTLRQQNPVGYTVPIHLPVINQVFSSNRAVKISPNCPVARLRPYAGKYMPGAVVAVRVPLLHLSNFQIYDWPEVSTRSYALMVLMLPSDSARQWHVHELELVEVVADQVAVALSHAAILEESMRARDQLIEQNVALDLARREAETAIRARNDFLAVMNHEMRTPMHAVIALSSLLQETDLTAEQRLMVETILKSSNLLATLINDVLDLSRLEDGSLQLEAATFNLHSLFREVLNLIKPVASVKKLSLTSHVASDLPMYAIGDEKRLMQTILNVVGNAVKFSKEGCISITAFVAKPESFRDARIPDFLPVPSDNHFYLRVQVKDSGSGINPQDIPKLFTKFAQNQSLTRNPAGSGLGLAICRRFVNLMEGHIWVESEGIGKGCTVTFIVKLGIPDRSNEFKLPFVPKVPGNHGSTNFAGLKVLVMDDNGVSRTVTKGLLMHLGCDVTTASSSEECLRVVSLEHEVVFMDVCTGLDGYELAVRIHEKFTKHQDRPLIVALTGNTKKVTKENCMRVGMDGLILKPVSVDKMRGVLSELLERRVLFESV

SEQ ID NO: 2136 - protein, 168 aa, Glycine max
CPRVRPRVRGPIRSKNELQNLPPVPPVDAILEPHHQTVPVGIVMSTLGAQVIVEGVEKHDPLNEGSILWLTESQKPLGLIDEIFGPVKNPYYVVRYNSESEVPTGINEGTLISFVPEFADHVLNNKDLYRKGYDASGADDEELSDEMEFSDDEKEAEYKRMQKPPKRG

SEQ ID NO: 2137 - protein, 260 aa, Glycine max
FGSSLAYEYLSNGSLDKWIFKKNKGEFLLDWDTRFNIALGTAKGLAYLHEDCDSKIVHCDIKPENVLLDDHFMAKVSDFGLAKLMNREQSHVFTTLRGTRGYLAPEWITNYAISEKSDVYSYGMVLLEIIGGRKNYDPRESSEKSHFPTYAFKMMEEGKLRDIFDSELEIDENDDRFQCAIKVALWCIQEDMSMRPSMTRVVQMLEGICIVPKPPTSSSLGSRLYATMFKSSSEEGATSSAPSDCNSDAYLSAVRLSGPR

SEQ ID NO: 2138 - protein, 475 aa, Glycine max
  unsure (1)..(475): unsure at all Xaa locations
MMALNISSPAEVKSIFFADYFKSNCITAKFTGGFAFKRKERGAASGGRVCCSVLAPPPPPAWPGRAVPEQGSKTWDGPKPISIVGCTGSIGTQTLDIVAENPDKFKVVALAAGSNVTVLADQVKRFKPQLVAVRNESLIAELKEALHDVEEKPEIIPGEQGXIEVARHPDAVSVVTGIVGCAGLKPTVAAIEAGKYIALANKETLIAGGPFVLPLAQKHNVKILPADSEHSAIFQCIQGLPEGALRRVILTASGGAFRDWPVDKLKDVKVADALKHPNWNMGKKITVDSATLFNKGLEVIEAHYLFGADYDHIEIVIHPQSIIHSMIETQDSSVLAQLGWPDMRLPILYTLSWPDRIYCSEDTWPCLDLCKIGSLTFKTPDNVKYPSMNLAYAAGRAGGTMTGVLSAANEKAVEMFIDEKISYLDIFKVVELTCEKHQNELLSSPSLEEIIHYDLWAREFAASLQDSSSFTPILA

SEQ ID NO: 2139 - protein, 152 aa, Glycine max
FSFCSFQDSSVIAQLGIPDMRLPLLYTLSWPERIYCSEVTWPRIDLSKYGSLTFKTPDNVKYPSMNLAYAAGRAGGTMTGVLSAANEKAVEMFIDEKISYLDIFKVVELTCEKHQNELLSSPSLEEIIHYDLWAREFAASLQDSSSFTPILA

SEQ ID NO: 2140 - protein, 197 aa, Glycine max
  unsure (1)..(197): unsure at all Xaa locations
MMALNISSPAEVKSIXFADYFKSNCITAKFTGGFAFKRKERGAASGGRVCCSVLAPPPPAWPGRAVPEQGRKTWDGPKPISIVGCTGSIGTQTLDIVAENPDKFKVVALAAGSNVTLLADQVKRFKPQLVAVRNESLIAELEEALHDVEEKPEIIPGEQGIVEVARHPDAVSVVTGIICCARLKPTIAAIEARKDIS

SEQ ID NO: 2141 - protein, 705 aa, Glycine max
  unsure (1)..(705): unsure at all Xaa locations
IWMPAALRMPEPELIDQCLDWNSVVYLEDFLDRXLKIFVPIAFLAWAVLVPVNATSTRSRKALXRDHITSSDIDKLSISNVHSRSERFWAHILVAYAFTFWTCYILLKEYEKVASMRLQFLAAEKRRPDQFTVLVRNIPPDPDESVSELVEHFFLVNHPDNYLTHQVVYNANKLAKLVKKKKKLQNWLVYYQNKVERTSYGCEKTTEGLGLCGNKVDAIDHHNTEIDKLSKEIALERDNVSNDPKSIMPAAFVSFKTRWGAAVCAQTQQTRNPTMWLTEWAPEPRDIYWSNLAIPYVSLTVRRLIMAVAFFFLTFFFMIPIAIVQGLASIEGIRKRAPWLNPLIDIPFIKSFIQGFLPGIALKLFLIFLPTILMIMSKFEGFGSISSLERRAASRYYLFNFVNIFLGNILTGTAFQQLGSFIHQPANEYPVTIGTAIPLKASFFITYIMVDGWASIAAEVLMLKPLIVYHLKNFFLVKTEKDREEAMDPGSIGFNTGEPRIQLYFLLGLVYAAVTPAVLPFITVFFGLAYLVFRHQIINVYNQEYESGAAFWPDVHFRIVMALLVSQIVLMGLLTTKKAASSTPFLVVLPILTIWFHRYCKGRFESAFVKFPLQEAMMKDTLERTTEPXNLNLKGYLQNAYVHPVFKDSMDDDDDEEDRLSIDLETESVTVRTKRQSRRNTPLPSKNNDASSPSLSDGIGNHPEP

SEQ ID NO: 2142 - protein, 150 aa, Glycine max
FVLLVSCVISFVLIRIEATTLTSWHLLVTFWALHVALKMRFFEHKPFEQKAVIGFGILNGISIGLLNLSLGFNSVGFYQMTKLAIIPCTVLLETIFLGKRCSKRIQFALSILLLGVGIATVTDLQLNALGSFLSFLAVITTCVAQIVSLK

SEQ ID NO: 2143 - protein, 245 aa, Glycine max
  unsure (1)..(245): unsure at all Xaa locations
DAWGAAGAAAGVVVLLIVFVFVMLRRRRRHVGTGTSVEGSLMAFSYRDLQNATKNFSDKLGGGGFGSVFKGTLADSSIIAVKKLESISQGEKQFRTEVSTIGTVQHVNLVRLRGFCSEGTKKLLVYDYMPNGSLESKMFYEDSSKVLDWKVRYQIALGTARGLNYLHEKCRDCIIHCDVKPENILLDADFVPKVAEFGLAKLVGRDFSRVLTTMRGTRGYLAPEWXSGVAITCQADVYSYGMMLF

SEQ ID NO: 2144 - protein, 256 aa, Glycine max
LAYEYLSNGSLDKWIFKKNKGEFLLDWDTRFNIALGTAKGLAYLHEDCDSKIVHCDIKPENVLLDDHFMAKVSDFGLAKLMNREQSHVFTTLRGTRGYLAPEWITNYAISEKSDVYSYGMVLLEIIGGRKNYDPRESSEKSHFPTYAFKMMEEGKLRDIFDSELEIDENDDRFQCAIKVALWCIQEDMSMRPSMTRVVQMLEGICIVPKPPTSSSLGSRLYATMFKSSSEEGATSSAPSDCNSDAYLSAVRLSGPR

SEQ ID NO: 2145 - protein, 348 aa, Glycine max
  unsure (1)..(348): unsure at all Xaa locations
MGEMSNFQLGVIGALFLSVASSVSIVICNKALMSNLGFPFATTLXSWHLMVTFCTLHAAQRLNLFVSKSVLFGILRKHXLDGISFGFLNLSLGFNSIGFYQMTKLAIIPFTVLLETIFLKKQFSSKIKFALFLLLVGVGIASITDLQLNFVGTILSLLAIITTCVGQILTNTIQKKLNVSSTQLLYQSAPFQAAILFVSGPVVDQMLTKQNVFAYKYSPVVLAFIILSCLIAVSVNFSTFLVIGKTSPVTYQVLGHLKTCLVLGFGYTLLHDPFTGRNILGILIAVFGMGLYSYFCTEDNKKKQLAGDLPLASQVKDKDSLPLLAGKNVGNQNEENHETNKLSKDSVI

SEQ ID NO: 2146 - protein, 103 aa, Glycine max; identical to SEQ ID NO: 683

SEQ ID NO: 2147 - protein, 384 aa, Glycine max
  unsure (1)..(384): unsure at all Xaa locations
MAHSPFLLLPNLQGFWPSLLAMITCFIIMIKALRNNFIENYSNKQKPKLPPGPKPWPIVGNLPEMLANKPAHKWIHNLMKEMNTEIACIRLGNAYVIPVTCPTIAREFLRKQDATFASRSQSVSTDLISNGYSTTIFGPFGAQWKKMKKILTNDLLSPHKHLWLHGQRTEEADNLMLQVXNKYKNVNDGLTGLVNIRSVARRYCGNLTRKIIFNTRYFGKGREDGGPGFEEVEHVDSIFDLLEYVYAFSVSDYMPCLRGLDLDGHEKNVKEALKIIKKYHDPIVQERIKLWNDGLKVDEEDWLDVLVSLKDSNNNPLLTLEEINAQIIELMLATIDNPSNAFEWALAEMINQPKLRYRAVDPNHNVVLKARFGSHSIFAESLHC

SEQ ID NO: 2148 - protein, 225 aa, Glycine max
PTRPPTRPYGCEKTTEGYGCEKTTEGYGCEKTTEGYGCEKTTEGEICGVAEAMEVQSLSFENNILWVGSFVEALVLDTFLATAKSLACFVILTGSLLTDVNNLVSPMVDGRFPLDQLCKGKHTFEENKDASDTEDDDDDDDVNDGEDGDDDDEDDEDFSGDDGGEEADSDDDPEANGGGESDDDDEDDDDDDDDNDEDDGDEDDDDEGDDDEDEESPQPPSKKRK

SEQ ID NO: 2149 - protein, 166 aa, Glycine max
  unsure (1)..(166): unsure at all Xaa locations
GMSSVTSNSRMAXLFSRDGAMPLSSLWHQVNXXEVSIYAVWLSVFISFCMALTSLGSIVAFEAMVSIATIGLYIAYALPIFFRVTLAQKDFVHGPFNLGRYGVIVGWVAVFWVVFISILFSLPVSYPITIETLNYTPVAVGCLLILVVSYWLISGRRWFRGPITNI

SEQ ID NO: 2150 - protein, 371 aa, Glycine max
MATPVEPPNGIRTEGKHYYSMWQTLFEFDSKYVPIKPIGRGAYGIVCSSVNRETNEKVAIKKIQNAFENRVDALRTLRELKLLRHLHHENVIALKDIMMPVHRNSFKDVYLVYELMDTDLHQIIKSSQALSNDHCQYFLFQLLRGLKYLHSANILHRDLKPGNLLINANCDLKICDFGLARTNCSKNQFMTEYVVTRWYRAPELLLCCDNYGTSIDVWSVGCIFAELLGRKPIFPGSECLNQLKLIINILGSQREEDIEFIDNPKAKKYIKSLPYSPGTPLSQLYPNAHPLAIDLLAKMLVFDPTKRISVTQALQHPYMAPLYDPNCDPPAVIPIDLDIDEDLGEEMIRDMMWKEMLHYHPESAMESAGLC

SEQ ID NO: 2151 - protein, 286 aa, Glycine max; identical to SEQ ID NO: 1274
  unsure (1)..(286): unsure at all Xaa locations

SEQ ID NO: 2152 - protein, 286 aa, Glycine max
  unsure (1)..(286): unsure at all Xaa locations
MPTGLPKANSSVAPDDQGWLWTQIKAEARRDAELEPALASYLYSTILSHSSLVRSLSFHLGNKLCSSTLLSTLLYDLFLNAFSFDPSLCSAAVADLRAARERDPACVSYSHCLLNYKGFLACQAHRVAHLLWRQSRQPLALALHSRIADVFAVDIHPAARIGKGILFDHATGVVVGEXGSDREQCVDPAPXTLGGTGKVGGDRHPKIGDGVLIGAGATILGNIKIGEGAKVGAGSVVLIDVPPQTTAVGNPARLVGGKEKPSKHEDVPGESMDHTSFISEWSDYII

SEQ ID NO: 2153 - protein, 236 aa, Glycine max
  unsure (1)..(236): unsure at all Xaa locations
AECSDDEVCSNASRDEGLECPICWESFNIVENVPYVLWCGHTLCXNCVLGLQWAVVKFPTQQIKIPFFISCPWCHLLSFRIICKGNLKYPCKNFFLLWMVESLNGDRNKLVSTCTDNQPIWSPKCNLLGSQVTNCNLRRASVSPCSRLLGSNHDVGVNDGETHHFSLHKSLDFFLHFTSKFPLVVIFLLIALFLIPCCAVILVLYFLVTILFAIPSFLVLYFAYPTIQRLVREITS

SEQ ID NO: 2154 - protein, 233 aa, Glycine max
  unsure (1)..(233): unsure at all Xaa locations
VAKVGGFPIFKNSKSFSKGVRFKSKTKTLLWCAIAQVFYQAFKKRYGHGTXGIICLVIVAVAIFFCGMSSVTSNSRMAYAFSRDGAMPLSSLWHKVNKQEVPIYAVWLSVFISFCMALTXSLGSIVAFEAMVSIATIGLYIAYAFPIFLRVTLARKHFVSGPFNLGRYGVVVGWVAVLWVLTISVLFSLPVSYPITIKTLNYTPVAVGCLLILVVSYWLISGRRWFKGPITNI

SEQ ID NO: 2155 - protein, 292 aa, Glycine max
  unsure (1)..(292): unsure at all Xaa locations
QSEGTKEVELEQFSVGMTKFSEEKEAISDLEKPMKRVAAEYKRKAEEHSVMCENXNTLRNHLMECMRKNSEKEVSTTSKKRKSESSNNNINLMGTNNGNSESSSTDEESCKKPREEIIKAKISRVYVRTEASDTSLIVKDGYQWRKYGQKVTRDNPCPRAYFKXCSFAPSCPVKKKVQRSVDDQSVLVATYEGEHNHPQFSSQMEATSGSGRSVTLGSVPCTASLSTSTPTLVTLDLTKSQGSNDSKSTKPKGDSPKVPQVLVEQMATSLTTDPNFRAALVAAISGRLLHNN

SEQ ID NO: 2156 - protein, 628 aa, Glycine max
  unsure (1)..(628): unsure at all Xaa locations
EIVPTLLHALEDDETSDTALDGLKQILSVRTSAVLPHILPKLVHPPLSAFNAHALGALAVVAGPGLDFHLCTVLPPLLXAMGDDDKEVQTLAKEASETVVLVIDEEGIEPLMSELVKGVNDSQAAVRRSSSYLIGYFFKNSKLYLVDEAPNMISTLIILLSDSDSSTVTVAWEALSRVIISVPKEVLPSYIKLVRDAVSTSRDKERRKKKGGPILIPGFCLPKALQPILPIFLQGLISGSAELREQAALGLGELIEVTSEQSLKEFVIPITGPLIRIIGDRFPWQVKSAILSTLTTMIKKGGISLKPFLPQLQTTFVKCLQDSTRTVRSSAALALGKLSGLSTRVDPLVSDLLSSLQGSDGGVRDAILTALKGVLKHAGKNLSSAVRTRFYSILKXDLIHDDDDRVRTYASSILGILTQYLEDVQLTELIQELSSLANSSSWPPRHGSILTISSLLHYNPATICSSSLFPTIVDCLRDTLKDEKFPLRETSTKALGRLLLYRSQVDPSDTLLYKDVLSLLVSSTHDDSSEVRRRALSAIKAVAKANPSAIMSLGTIVGPALAECMKDGNTPVRLAAERCALHAFQLTKGSENVQAAQKYITGLDARRLSKFPEYSDDSDDSDEDTSSS

SEQ ID NO: 2157 - protein, 102 aa, Glycine max
MASNQNQASYAAGETKARTEEKTGQMMDKAGQATEATKQKAGEAKDKTAQTAQAAKDRAAESKDQTGSFLGEKTEAAKQKTAEATDAAKQKASETAQYAQER

SEQ ID NO: 2158 - protein, 345 aa, Glycine max
  unsure (1)..(345): unsure at all Xaa locations
MSSSEAIQNFRVFAATWNVGGQCPTGNLDLNDFLQVRNEPDMYVLGFQEIVPLNAGNVLVLEDNEPAAKWLALINQSLNGSSDLASXRDLEXASFGGPLFSQKPSLKKIKKTFKKLNGKRLRSCNCVLEMERKAGKDFCFRCQESNFNSDDSSTEEEDENFPIPVALATSQMKYSLVTCKQMVGIFVSVWMRRELVQYVGHLRICCISRGIMGCLGNKGCISVSMSFYQTSFCFICSHLASGEKEGDELRRNLDVIEILKNTQFPRICKTPHSRMPDKILDHDRIIWFGDLNYRISLSHDDAKRLVEKRDWPALFNKDQLKMEREPGRVFKGWKEGKIYFAPTYK

SEQ ID NO: 2159 - protein, 624 aa, Glycine max
  unsure (1)..(624): unsure at all Xaa locations
SALGSSAFFSSSSSSHNSSNNGRQHYRPPGKKKEGNAAKFVIRSQALKQLQISLPLFRKLCILKGVTPREPKKKFKGTHQTYYHVKDVSFLHHEPLVEIHRAIRVHERKIKKAEAKKNLERANRLREKTPKPKIARIIRQRYPRFVDALGELDDCLTVVHLFAALPASESKKIDVEXVHKCRRLAHEWQAFVSRTHKLRKTFVSVKGIYYQAEVEGQTITWLTPHSLQQVVSDDVDITTMLNFLQLYEPLLSFVKGRLGHSINLKYPPILDPQLEALAADLYALSRYASANTRPSVLISEASQAESEQVETKQKEAETGDKTSELRLAQLQHQLPSNEPGALMHLVEEVTGEDEEDQDTKECKKLFKNMKFFISREVPRESMFFVIPAFGGIVSWEGEGAPFGESDQSISHQIVDREAQGHRFLSREYVQPXQWVYDCVNARIILPTENYLVGRTPPPHLSPFINYDEEGAYIPDYAKTIKHLQAAARKEILPLPGVGKEDLEDPQNLLVEGIIDRAEANDAAQRKQKMMILEQQYRDDLKKELQGVTYTSAGSKETSTGVVQTGESTASVQENVDDDMSKVMMSRKKRKLAEAMKISKKLKEAQTDRIKQRKKKIDEAQRQRS

SEQ ID NO: 2160 - protein, 161 aa, Glycine max
  unsure (1)..(161): unsure at all Xaa locations
LEPDFWYQPRHNTMISTSWGAPSAFTKGFNLQHLSDGLYGRHLHVYSWPGGELRQTMDLGDSGLIPLEIRFLHDPAKDTGFVGSALTSNMIRFFKTQDESWSHEVAISVKPLKVQNWILPEMPGLITDFLISLDDRFLYFVNWLHGDIXQYNIEDVKNPKL

SEQ ID NO: 2161 - protein, 265 aa, Glycine max
MVYVKAQKSKAYFKRYQVKFKRRREGKTDYRARIRLINQDKNKYNTPKYRFVVRFSNKDIVAQIISASIAGDIVLAAAYAHELPRYGLEVGLTNYAAAYCTGLLLARRVLKTLEMDEEYEGNVEATGEDYSVEPAESRRPFRALLDVGLIRTTTGNRVFGALKGALDGGLDIPHSDKRFAGFDKEKKELDAEVHRKYVFGGHVAAYMKILAEDEPEKYQSHFSEYIKRGIEADGIEALYKNVHAAIRADPTLKKSDKQTPKEHKR

SEQ ID NO: 2162 - protein, 238 aa, Glycine max
MSDAAMAVVKPEMKSYIWLQTVDGSIQQVEEEVAMFCPMICQEVLQTGMGSSKNYAISLPQRVNPAILGLILDYCRFHQVPGHSNKERKTFDEKFIRMDTKKLCELTSAADSLQLKPLVDLTSRALARIIEGKTPEEIRETFHLPDDLTEEEKLEPLRNITDDPRIRLLNRLYARKRKELKERKKLKDVEVEEEPKDERSVEDLLSFINGADGDMKGTRANKNKKKNRRRKAHAKDLS

SEQ ID NO: 2163 - protein, 241 aa, Glycine max
MPFSIFFFFFFFFFKMKSYIWLQTVDGSIQQVEEEVAMFCPMICQEVLQTGMGSSKNYAISLPQRVNPAILGLILDYCRFHQVPGHSNKERKTFDEKFIRMDTKKLCELTSAADSLQLKPLVDLTSRALARIIEGKTPEEIRETFHLPDDLTEEEKLEPLRNITDDPRIRLLNRLYARKRKELKERKKLKDVEVEEEPKDERSVEDLLSFINGADGDMKGTRTNKNKKKNRRRKAHAKDLS

SEQ ID NO: 2164 - protein, 320 aa, Glycine max
MASIAGSNCVALRTANFGASGNRKIGQIRQWSPILTNLRPVSGLRHRSNTPFSSSGVRAQVATLEEAGTGATQKVEAPVAVVTGASRGIGKAIALSLGKAGCKVLVNYARSSKEAEEVSKEIEEFGGQALTFGGDVSNEADVESMIKTAVDAWGTVDVLINNAGITRDGLLMRMKKSQWQDVIDLNLTGVFLCTQAAAKIMMKKKKGRIVNIASVVGLVGNVGQANYSAAKAGVIGLTKTVAKEYASRNITVNAVAPGFIASDMTAKLGQDIEKKILETIPLGRYGQPEEVAGLVEFLALNQAASYITGQVFTIDGGMVM

SEQ ID NO: 2165 - protein, 262 aa, Glycine max
  unsure (1)..(262): unsure at all Xaa locations
MAASKDRENFVYIAKLAEQAERYEEMVESMKNVANLDVELTVEERNLLSVGYKNVIGARRASWRILSSIEQKEETKGNELNAKRIKEYRQKVELELSNICNDVMTVIDEHLIPSAAAGESTVFYYKMKGDYYRYLAEFKAGNEKKEAADQSMKAYESATTAAEADLPPTHPIRLXGLALNFSVFYYEILNSPERACHLAKQAFDEAISELDTLNEESYKDSTLIMQLLRDNLTLWTSDIPEDGEDAQKVNGTAKLGGGEEAE

SEQ ID NO: 2166 - protein, 548 aa, Glycine max
  unsure (1)..(548): unsure at all Xaa locations
METTRRWFSKFKSNDKMNSAKDKETTGMTKEGSKPPTSEEAPSNVTKQRVEAAKQYIENHYKKQMQSLQERKERRNMLEKKLADAEVSEEEQHNLLQHLEKKEREIMRLQRHKMGADDFEPLTMIGKGAFGEVRICREKATGHVYAMKKLKKSEMLRRGQVEHVKAERNLLAEVDSNCIVKLYCSFQDEXEYLYLIMEYLPGGDMMTLLMRKDILTEDEARFYVGETVLAIESIHKHNYIHRDIKPDNLLLDRNGHMKLSDFGLCKPLDCSNLQEKDFSVGINRSGALQSDGRPVAPKRTQQEQLQHWQKNRRMLAYSTVGTPDYIAPEVLLKKGYGVECDWWSLGAIMYEMLVGYPPFYSDEPMLTCRKIVNWRTSLKFPEEAKLSAEAKDLISRLLCNVDQRLGTKGADEIKAHPWFKGIEWDKLYQMKAAFIPEVNDELDTQNFEKFEEVDNQTQPSSKSGPWRKMLSSKDVNFVGYTYKNYEIVNDDQLPEIAELKKKSTKPKRPSIKTLFDDESATAANQPTQGSFLKLLPTQPEVPEKSESQ

SEQ ID NO: 2167 - protein, 698 aa, Glycine max
MAVENQREDGGCDRFPVGMRVLAVDDDPICLKVLENLLRKCQYHVTTTNQAVEALTMLRENRNKFDLVISDVNMPDIDGFKLLELVGLEMDLPVIMLSAHGDTKLVMKGVTHGACDYLLKPVRIEELKNIWQHVVRRKNFDSRDQNKASNEEKAPNFAGGGSQGLRSENSADQNKRLGKKRKDQSDEEEEGGEENEDDEDPSAQKKARVVWSVELHRKFVAAVNQLGLDKAVPKKILDLMNVEGLTRENVASHLQKYRLYLKKAAQQANMVAALGGSDSYLRIGSIDGYGDFCTSSGSGRITNATLPSYASTGIFSRLNSPAALNMRGISSSALIRPVQSQNINSSLNTLGNIQPSIFPANQSSSLLQGIPTSIELNQSKQRNCTTGISQLSQVDSSGFTVASGFPDHRATVNGPNNSLPCVSNNHIMLQGNPQTHGPGAFSNQSSVRAASLCAESFDVGLCGSSNLLDHNRCNDNWQNAAQLSKFPANSLPLCEAFSNDQLPPTSINDSNSSTHIGNNSPVDFSSRMGISVPLEDTRNELRCQEGLIGNIVQPSSYTPRQRWEEHKLDYNQNMSCPFNSVNSHASSSGVTSSMGHVLNQNNTICSNRVDASSLVGQLNGASPSISRCTEVEKFSSDIRLKPNEAYILEQMKSQDGFMQNTFGTLDDIMGVMVKREQNESTLLDGEMGFDAYPVGSCN

SEQ ID NO: 2168 - protein, 506 aa, Glycine max
  unsure (1)..(506): unsure at all Xaa locations
KQEVAATKQYIENHYKEQMKNLQERKERRTILEKKLADADVSEEDQNNLLKFLEKKETEYMRLQRHKMGVDDFELLTMIGKGAFGEVRVCREKTSDHVYAMKKLKKSEMLRRGQVEHVKAERNLLAEVDSNCIVKLYCSFQDDEHLYLIMEYLPGGDMMTLLMRKDILTEDEARFYVGETVLAIESIHKHNYIHRDIKPDNLLLDRXARVKLSDFGLCKPLDCSTLEENDFSVGQNVNGSTQSSTPKRSQQEQLQHWQINRRTLAYSTVGTPDYIAPEVLLKKGYGMECDWWSLGAIMYEMLVGYPPFYSDDPMLTCRKIVNWKTYLKFPEEARLSPEAKDLISKLLCNVNQRLGSKGADEIKAHPFFKGVEWNKLYQMEAAFIPEVNDELDTQNFEKFDESDSQTQSSSRSGPWRKMLSSKKDLNFVGYTYKNFEIVNDYQVPGMAELKKKQSKPKRPTIKSLFETPEASDTSANDQPAQGSFLKLLPPQLEVSPHRDKNLPPRS

SEQ ID NO: 2169 - protein, 386 aa, Glycine max
MELSAIKDAFDRVTKKQKLSCSKTQEAIDLIRQEIESVLDTLQSVNNTDHELDYKTVLNELKASLLKIAPLSQMEGTQKELNLALTKYGKLHEKHFNPDISKAYRNVDIDIHTLNQIIANHFYRQGLFEIGDHFMSVVGELESAAIMKSPFLEMYQILEAMQNLNLEPALNWAATNGDKLAQSGSDIVLKLNSMQFVKILQNGSREEALHYARTHLSPFATSHMTDIQKLMGCLLWTGKLDRSPYHALLSASNWDKLAEELKRQFCNLLGQSYNSPLSVTVAAGVQVLPPLLKFMNVMAGKKHEWQSMNQLPVLVELDREFQFHSIFVCPVSKEQATEDNPPMLMSCGHVLCKQSILKMSKNSTKMFKCPYCPFDIDAAQCKQLYF

SEQ ID NO: 2170 - protein, 381 aa, Glycine max
  unsure (1)..(381): unsure at all Xaa locations
MEVPEMEGKTESHMTSAAAFVEGGVQEACDDACSICLEDFCKSDPATVTNCKHEFHLQCILEWCQRSSQCPMCWQPISLRDATSQELLEAVELERSLRDTPSRNAAIFHHPTLGDFELQHLPXGVNEADIEERIIQHLTAAAAMRRSHHLSRREGHRTRPSAHGRPHFLVYSSXQPSAPPSAAGGGSEPAAIPVGSPSTPLTFDGNEQSSLQQIPHVQTQSSSLTSASTVSTTNLQGVHSDDRSFASHSFPASQDRAQPSEQSFSDSLRSRFNAVSMRYKDSISKGTRGWKERLFSPNSSMSELGSEVRRELNAKIASVSRLMERLETRENNSAAGTSLSNHLVNRSIAETSNQSNVEARGENSLHGNNTPTTFSASSDSK

SEQ ID NO: 2171 - protein, 380 aa, Glycine max
MEVPEMEGKTESHMTSAAAFVEGGVQEACDDACSICLEDFCKSDPATVTNCKHEFHLQCILEWCQRSSQCPMCWQPISLRDATSQELLEAVELERSLRDTPSRNAAIFHHPTLGDFELQHLPMGVNEADIEERIIQHLTAAAAMRRSHHLSRREGHRTRPSAHGRPHFLVYSTQPSAPPSAAGGGSEPAAIPVGSPSTPLTFDGNEQSSLQQIPHVQTQSSSLTSASTVSTTNLQGVHSDDRSFASHSFPASQDRAQPSEQSFSDSLRSRFNAVSMRYKDSISKGTRGWKERLFSPNSSMSELGSEVRRELNAKIASVSRLMERLETRENNSAAGTSLSNHLVNRSIAETSNQSNVEARGENSLHGNNTPTTFSASSDSK

SEQ ID NO: 2172 - protein, 203 aa, Glycine max
RRVSKGSSAPSSASPGVSLFAGDRLQILNESRHVALNAYLSAIQLFRLGPIESVCMVEESEADKQTSYSSGVAIQFRNEEKSEAFHCVFQQWKKGFDVQGGNLPNGTDVITSKSKFDEKIEPSSAKMYFHYYGQLLHQQNMLQDYVRTGTYYAAVLENRADFVSRVVIDVGAGSGILSLFAAQAGAKHVYAVEASEMAEYARK

SEQ ID NO: 2173 - protein, 387 aa, Glycine max
MQKRREESDKIPVKRDSASSLPQPQSLVLFTAPGSRFPFLLPLSFAKWVIISFSHNTIFFTFSFFFASLRWGFKFHHRNRMFSRLIHPHEGQEDMQGGSNHAHLGDPCLVLTSDPKPRLRWTADLHERFVDAVTQLGGASKATPKAIMRTMNVKGLTLYHLKSHLQKYRLGKQSGKDSDEGLKDGMSASYLQESPGTDNSSPKLPASDANEGHEVKEALRAQMEVQSKLHLLVEAEKHLQIRQDAERRYMGMLERACKMLADQFIGDVIIDRDGQKFQGLENKTSRSPLVDHGGFFPAACTEVGGMHVSEVPPILQPQGAECSSESCLKSLESLGGLTLEGSPGGSKKRMLNLDSMVAPLIWSEANTRTQGIHLAQVNPPGMTRYGM

SEQ ID NO: 2174 - protein, 598 aa, Glycine max
  unsure (1)..(598): unsure at all Xaa locations
MGVCTSKPQKPNPYALREAEAEADPSQIPKTTLSPAGADTPRRKDDAITGKRSPFYPFYSPSPARFLKKSPAPAGGSRSASSTPRRFFRRPFPPSSPAKHIRAVLARRQGKKASATAAIPEEGEEGAADLDKRFGFSKEFTSRLEVGEEVGRGHFGYTCSAKFKKGELKGQQVAVKVIPKAKMTTAIAIEDVRREVKILRALNGHSNLIQFYDAFEDQDNVYIVMELCEGGELLDMILSRGGKYSXDDAKAVMVQILNVVAFCHLQGVVHRDLKPGXFLYAKKDESSELKAIDFGLSIRLEYGCEKTTEGGSAYYVAPEVLHRSYSTEADVWSIGVIAYILLCGSRPFWARTESGIFRAVLKADPSFDETPWPSLSLEAKDFVKRLLNKDPRKRISAAQALSHPWIRNYNNVKVPLDILIFKLMKTYMRSSSLRKAALRALSKTLTADELYYLREQFALLEPSKNGSISLENVNKALMKYATDAMKESRILDFLSSLNSLQYRRMDFEEFCAAALSVHQLEALDRWEQHARCAYELFDKDGNRAIVIEELVSELGLGPSIPVHVVLHDWIRHTDGKLSFLGFVKLLHGVSSRSLAKVQ

SEQ ID NO: 2175 - protein, 270 aa, Glycine max
  unsure (1)..(270): unsure at all Xaa locations
FRMWNFASSLIAGSVGLKNDSAKPTHPASECSDDETSMVTREERLECPICWESFNIVENVPYVLWCGHTLCKNCILGLQWAVVKFPTLPIQLPLFISCPWCNLLSLRLVYRGNLKFPRKNYFLLWMVESMNGDRVKSHSTVCGDHQPVWPIIKDSLTNGSQEGHGIPWRGQVCHPESSSSNQYHGDTSNYLSIETLHTSLRKSLVLFVHLTXAKFPLIIIFLLIVLYAIPVIAAILALYILVTILFALPSFLILYFAYPSLDWLVREIIT

SEQ ID NO: 2176 - protein, 363 aa, Glycine max
MFSSPLTCPDDFPFTSVSQHDRQYQDPPFVSQTIGDSVSSEIHSMTFISHPQENEDLSWGPDPCQDILGFPENVSVQHDQVENNGCYINDDNVKRSDFGEWVDQLMSIDDSLHPSWSQLLADDNVAEPKPKASQVPPQQHIPSGEVVGNSASTASQTKARMRWTPELHEAFVEAVNHLGGSEKATPKGVLNQMKVEGLTIYHVKSHLQKYRTARYKPEPSEGTSEKKVTPMEEMKSLDLKTSKGITEALRLQMELQKRLHEQLEIQRKLQIQIEDQGKRLQMMFEKQREMGDSKVNVSLDEPSAAAPSETVETTNEERHKFESIPKAIPEEKESSTTKQIAGEAEEMIKEDEVAPPTKRVKSS

SEQ ID NO: 2177 - protein, 127 aa, Glycine max
AIDDRPSCFRYPRGNGIGVELPLGNKGIPLEIGKGRILIEGERVALLGYGSAVQSCLAAASLLEHHGLRATVADARFCKPLDRSLIRSLAQSHEVLITVEEGSIGGFGSHVVQFMALDGLLDGKLKV

SEQ ID NO: 2178 - protein, 164 aa, Glycine max
  unsure (1)..(164): unsure at all Xaa locations
MGSSHVTANGHAPLDSGHARLKELGYKQELKRDLSVISNFAFSFSIISVLTGVTTLYNTGLNYGGPVSLVYGWFVASGFTMLVALSMAEICSSYPTSGGLYYWSAKLAGPRWAPFASWITGWFNIVGQWAVTTSVDYSLAQLIQVIILLSTGGKNGXGYEASKY

SEQ ID NO: 2179 - protein, 338 aa, Glycine max
VDDNFLPTPRLYGCEKTTEGHEERGRVLQAMDGCGYKAAAGGSLSNTLVALARLGSRSEKVPAINVAMTGSVGSDLLGGFYREKLRRANVQFLSAPIKDGTTGTVIVLTTPDAQRTMLAYQGTSSTVNYDASLANAVSKTNILVVEGYLFELPDTIKTITKACEKARSNGALVAITASDVSCIERHFDDFWEIIGNCVDLVFANGNEARALCNFEAKESAASAARYLSHFVPLVSVTDGPTGSYIGVKGEAVYIPPSPCVPVDTCGAGDAYASGILYGLLRGISDLRSIGSLAAKVAATVVGQQGTRLRISDAVKLAESFEFQLDSSSVGTDHNISSV

SEQ ID NO: 2180 - protein, 389 aa, Glycine max
  unsure (1)..(389): unsure at all Xaa locations
RAGSFFNWFYFSINIGALVSSTFIVWIQENAGWGLGFGIPALFMALAIGSFFLGTPLYRFQKPGGSPITRMCQVVVASVWKRNLVVPEDSNLLYETPDKSSAILAMCXIFFCFNXRCLDRAAVVSDAESKSGDYSNQWRLCTVTQVEELKILIRMFPVWATGIVFAAVYAQMSTLFVEQGTMMNTNVGSFRIPPASLSSFDVISVIVWVPVYDRIIVPIARKFTGKERGFSELQRMGIGLFISVLCMSAAAIVEIVRLKVAKEHGLVDEPVPVPLNIFWQIPQYFLLGAAEVFTFVGQLEFFYDQSPDAMRSLCSALSLLTTSLGNYLSSFILTVVTYFTTQGGNPGWIPDNLNKGHLDYFFWLLAGLSFLNTFVYIVAAKRYKQKKSA

SEQ ID NO: 2181 - protein, 255 aa, Glycine max
MANQNQRECAECLTWLCFLLITLSLSFFLFCFKVASVVCIYKEPKVAAFLFSLDQFHSLEDMGTLEQIDAPQTRSSSSSSSSIDSNNHPSRTRTPPPSSPSSSLCRNRTDLSTDLRLGLSISPSSQSELPFNSTRREESFDWPPIKSILRSTLVGKQSYLNQRPSLFVKVYMEGIPIGRKLNLMAHYGYDGLVKTLGHMFRTNILCPNSQPLNSRNFHVLTYEDQEGDWMMVGDVPWEMFLNSVKRLKITRADRC

SEQ ID NO: 2182 - protein, 255 aa, Glycine max
MANQNQRECAECLTWLCFLLITLSLSFFLFCFKVASVVCIYKEPKVAAFLFSLDQFHSLEDMGTLEQIDAPQTQSSSSSSSSIDSNNNPSRTRTPPSSSPSSSLCRNRTDLSTDLRLGLSISPSSQSESPFNSTRREESFDWPPIKSILRSTLVGKQSYLNQRPSLFVKVYMEGIPIGRKLNLMAHYGYDGLVKTLGHMFRTNILCPNSQPLNSGNFHVLTYEDQEGDWMMVGDVPWEMFLNSVRRLKITRADRC

SEQ ID NO: 2183 - protein, 194 aa, Glycine max
MGTLEQIDAPQTRSSSSSSSSIDSNNHPSRTRTPPPSSPSSSPCRNRTDLSTDLRLGLSISPSSQSESPFNSTPREESFDWPPIKSILRSTLVGKQSHLNQRPSLFVKVYMEGIPIGRKLNLMAHYGYDGLVKTLGHMFRTNILCPNSQPLNSGNFHVLTYEDQEGDWMMVGDVPWEMFLNSVRRLKITRADRC

SEQ ID NO: 2184 - protein, 70 aa, Glycine max
MAAAKLQALWNHPAGPKTIHFWAPTFKWGISIANIADFSKPPEKLSYPQQIAVTATGIIWSRYSTVMLLV

SEQ ID NO: 2185 - protein, 381 aa, Glycine max
MSSSTVGQVIKCKAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 2186 - protein, 590 aa, Glycine max
  unsure (1)..(590): unsure at all Xaa locations
MGGGGTLVQGIRRLFKRRASSPASDDHNHNNVNANNSRVLVRDLRAQLASIPNTLDPVSDFDFSTLKPIKVPTPIPFRPSSMDHHKKGAQETEFFTEYGEASQYQIQEVVGKGSYGVVGSAIDTHTGEKVAIKKINDVFEHVSDATRILREIKLLRLLRHPDIVEIKHIMLPPSRREFRDIYVVXFELMESDLHQVIKANDDLTPEHHQFFLYQLLRGLKYIHTANVFHRDLKPKNILANADCKLKICDFGLARVSFNDAPSAIFWTDYVATRWYRAPELCGSFFSRSSRAIDIWSIGCIFAEMLTGKPLFPGKNVVHQLDLMTDLLGTPPPESIARIRNEKAKRYLNSMRKKQPIPFSQKFPNADPLALRLLERLLAFDPKDRPSAEEALSDPYFTGLANMDREPSTQPISKLEFEFERRKLTKDDVRELIYREILEYHPQMLQEYLRGGDQTSFMYPSGVDRFKRQFAHLEEHYGKGERSTPPLQRQHASLPRERVCAPKDESKQNNDSEKPSGSNLQQSPPGSDETGAQNGTSKPNYSARSLLKSASISASKCVVLKQNKDPEQEPITEVNDEAVDGVTGEIAALHA

SEQ ID NO: 2187 - protein, 594 aa, Glycine max
RLEGGTLVEGIRRLFQRRASSSSSSDHHDHNNVNANNSLVLVRDLRAQLASIPNTLHPDSDSDFDFDFSTLKPIKVPSQIPFRPSSMDHHKKGAPETEFFTEYGEASQYQIQEVVGKGSYGVVGSAIDTHTGEKVAIKKINDVFEHVSDATRILREIKLLRLLRHPDIVEIKHIMLPPSRREFRDIYVVFELMESDLHQVIKANDDLTPEHHQFFLYQLLRGLKYIHTANVFHRDLKPKNILANADCKLKICDFGLARVSFNDAPSAIFWTDYVATRWYRAPELCGSFFSKYTPAIDIWSIGCIFAEMLTGKPLFPGKNVVHQLDLMTDLLGTPPPESIARIRNEKAKRYLNSMRKKQPIPFSQKFPNADPLALRLLERLLAFDPKDRPSAEEALSDPYFTGLANMDREPSTQPISKLEFEFERRKLTKDDVRELIYREILEYHPQMLQEYLRGGDQTSFMYPSGVDRFKRQFAHLEEHYGKGERSTPPLQRQHASLPRERVCAPKDESKQNNDSEKPSGSNLQQSPPGSDETGAQNGTSKQNYSARSLLKSASISASKCVVLKQNKDPEQEPITEVNDEAVDGVTGEIAALHA

SEQ ID NO: 2188 - protein, 258 aa, Glycine max
MASTKERENFVYVAKLAEQAERYEEMVEAMKNVANLNVELTVEERNLLSVGYKNVVGARRASWRILSSIEQKEEAKGNDVSVKRIKEYRLKVESELSNICSDIMTVIDEYLIPSSSSGEPSVFFYKMKGDYYRYLAEFKSGDERKEAADHSMKAYQLASTTAEAELASTHPIRLGLALNFSVFYYEILNSPERACHLAKQAFDEAISELDTLSEESYKDSTLIMQLLRDNLTLWTSDIPEDGEEQKVDSARADGGDDA

SEQ ID NO: 2189 - protein, 240 aa, Glycine max
MKIQCDVCERAPATVICCADEAALCAKCDVEVHAANKLASKHQRLLLQCLSSKLPTCDICQDKPAFIFCVEDRALFCQDCDEPIHSAGSLSANHQRFLATGIRVASSSNCTKDNEKSHSEPPNRSAQQVSAKIPPQQVPSFTSSWAVDDLLELTGFESPEKKESLQFGELEWLTDVGIFGEQFAQEALAAAEVPQLPETHNSSSVASYKTSKSYMSHKKPRIEVLNDDDDDEYFTVPDLG

SEQ ID NO: 2190 - protein, 250 aa, Glycine max
LEAAEGLNREQYVYLAKLSEQAERYEEMVEFMQKVVVGSTPASELTVEERNLLSVAYKNVIGSLRAAWRIVSSIEQKEEGRKNDDHVSLVKHYRSKVENELTQVCASILSLLDSNLVPSASASESKVFYLKMKGDYHRYLAEFKVGDERKTATEDTMLSYKAAQDIASADLPPTHPIRLGLALNFSVFYYEILNQSDKACAMAKQAFEEAIAELDTLGEESYKDSTLIMQLLRDNLTLWTSDVQDQLDEP

SEQ ID NO: 2191 - protein, 532 aa, Glycine max
  unsure (1)..(532): unsure at all Xaa locations
AFPPFFPAQWPKDAGFCRWPWLPGNTSCPLSWIISMTXVIRESKESNSVDDVGISDDEAETEQLLDFLILFKEEKKKREAKLKEELNLLKEDMKEVERSYSFVTDSVFPLVQINNPELRGDSLHFQDSSGSDISRSIRRLFGYEERYMSNINQLENSYFSSRFRVLPKEASSVSINDKNXEGSVGGVASFFEGLCKFARYSKFEECGRLRNRDLLSSANVMCALSFDRDEDHIAAGGVSKKIKIFDLNAIASDSVDIQYPVIEMSNKSKLSCVCWNTYIKNHLASTDYDGAVQMWDADTGQPLSQYMEHQKRAWSVHFSLSDPKMFASGSDDCSVKLWSISERNSLGTIWKPANICCVQFSAYSTNLLFFGSADYKVYGYDLRHTRIPWCTLAGHGKAVSYVKFIDSEAVVSASTDNSLKLWDLNKTSSSGLSSDACAMTFKGHSNEKNFVGLSVLDGYIACGSESNEVYCYHKSLPVPIATHKFESIDHISGHLNSGDNNGQFVSSVCWRKKSNMLVAANSVGIVKLLQMV

SEQ ID NO: 2192 - protein, 409 aa, Glycine max
MATEKLRGCAKFFASSKPYLAMISLQFGYAGMNIITKVSLNQGMSHYVLVVYRHAFATAVIAPFAFIFERKGQPKITFPVFMQIFILALLGPVIDQNFYYAGLKLTSPTFSCAMSNMLPAMTFVMAVFCRMEKIDIKKVRCIAKIVGTLVTVAGAMLMTLYRGPIVEMVWAKHPHNKTNATTTTGSLDKDWFLGCTFLIIATLAWASLFVLQAKAIQTYKNHQLSLTSLVCFIGTLQAIAVTFVVEHNPSVWRIGWDVSLLAAAYAGIVTSSISYYVQGLVIKMKGPVFATAFSPLMMIIVAIMGSFILAEQIYLGGVIGAILIVIGLYSVLWGKHKEQIESKVADEIPLPVKDSQIAVIAGPIIDATDNFTEEKYGQKGEANNNKLSSLIITIPIPEPPTKANQERKA

SEQ ID NO: 2193 - protein, 333 aa, Glycine max
  unsure (1)..(333): unsure at all Xaa locations
MKLFSFSLACVFALLASSLASAAILEHIFKVQNTTIKRFCKEQVIVTVNGLFPGPTINVREGGTVIVHVLNEGPYDITLHWHGVLQLFSPWADGPEYVTQCTIRPRSKYTYKFNVTQQEGTVWWHAHASYLRATVHGAFIIQPRSGQFPFPKPYKQIPLILGDLYNSNVEDITTEAQASGGGPNISCAFTINGFTSGLLINNCTENGMLAPLIIKXNLFRLIEKXIVIWFSLINTDFVSQKKKKKNTDHYVTDLIVIAPGQSADVLFTANQPIGSYYMVASPYVVGLDHFDVNVGRGTVIYENAPPSPKPVMPILPPFNDTDTAYNKFYNVIT

SEQ ID NO: 2194 - protein, 111 aa, Glycine max
  unsure (1)..(111): unsure at all Xaa locations
MEEACEFRSWAELIPDALGVIFTNLSLQERVTVIPRVCKSWANAVTGPYCWQEIDIKDWSNRCQPDQLDRLLEMLITRSCGTLRXLSVSGLQTESIFTFIAEKTLYISLGW

SEQ ID NO: 2195 - protein, 341 aa, Glycine max
  unsure (1)..(341): unsure at all Xaa locations
MELDGVLLGMCNPLLDISAVVDDAFLQKYGIKLNDAILAEDKHKPMYEELANNPNVEYIAGGATQNSIRVAQWMLQAPGATSYIGCIGKDKFGEEMKKKCTLDGVKVNYYEIDNTPTGTCAVCVVGGERSLVANLSAANCYKSEHLTRPENWALVEKAKYFYISGFFLTVSPDSIQLVAEHAAANNKFFMMNLSAPFICEFFKDALNKVLPYMDYVFGNETEARTFSKXQGWETDNVEEIALKISQLPKASETHKRITVITQGADPVCVAEDGKVKIYPVIPLPKEKLVDTNGAGDAFVGGFLSQLVKHKPIEECIRAGCYAANVIIQRPGCTYPPTPDFH

SEQ ID NO: 2196 - protein, 341 aa, Glycine max
  unsure (1)..(341): unsure at all Xaa locations
MELDGVLLGMCNPLLDXSAVVDDAFLQKYGIKLNDAILAEDKHKPMYEELANNPNVEYIAGGATQNSIRVAQWMLQAPGATSYIGCIGKDKFGEEMKKKCTLDGVKVNYYEIDNTPTGTCAVCVVGGERSLVANLSAANCYKSEHLTRPENWALVEKAKYYYISGFFLTVSPDSIQLVAEHAAANNKIFMMNLSAPFICEFFKGALDKVLPYMDYVFGNETEARTFSKAQGWETDNVEEIALKISQLPKASEKHKRITVITQGADPVCVAEDGKVKLYPVILLPKEKLIDTNGAGDAFVGGFLSQLVKQKPIEECVRAGCYAANVIIQRPGCTYPEKPDFH

SEQ ID NO: 2197 - protein, 222 aa, Glycine max
  unsure (1)..(222): unsure at all Xaa locations
YRSLVANLSAANCYKSEHLTRPENWALVEKAKYFYISGFFLTVSPDSIQLVAEHAAANNKFFMMNLSAPFICEFFKDALNKVLPYMDYVFGNETEARTFSKAQGWETDNVEEIALKISQLPKASEKHKRITVITQGADPVCVTEDGKVKLYPVILLPKEKLIDTNGAXDAFVGGFLSQLVKQKPIEECVRAGCYAANVIIQRPSCITPSSNALFNGLMLNQL

SEQ ID NO: 2198 - protein, 112 aa, Glycine max
  unsure (1)..(112): unsure at all Xaa locations
MELDGVLLGMCNPLLDISAVVDDAFLQKYGIKLNDAILAEDKHKPMYEELANNPNVEYIAGGATQNSIRVAXGATSYIGCIGKDKFGEEMKKKCTLDGVKVNYYEIDNTPTG

SEQ ID NO: 2199 - protein, 119 aa, Glycine max
  unsure (1)..(119): unsure at all Xaa locations
RADSARDVFQYINCEDGKMSGPPGDVANSLMDGYSKGNNEVRRRSRFLRRRGRVRRLKYTWKSAAYHSIRKRITERKDQPCRQYNPCGCQTACGKQCPCLQNGTXCCEKYCGCPMHPTS

SEQ ID NO: 2200 - protein, 116 aa, Glycine max
  unsure (1)..(116): unsure at all Xaa locations
MGYICDFCGDQRSMVYCRSDAACLCLSCDRNVHSANALSKRHSRTLLCERCNSQPAFVRXLKEKISLCQNCDXLGHGTSTSFFTHKRQAINCYSGCPSAAELSSIWSFCVRNRCHK

SEQ ID NO: 2201 - protein, 352 aa, Glycine max
  unsure (1)..(352): unsure at all Xaa locations
ARAVNSLDHHCLIVFSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIESARLVSLALFGAFVSRAGVKVVDVLSPKVFIGLIVGAMLPYWFSAMTMKSVGSAALKMVEEVRRQFNTIPGLMEGHAKPDYATCVKISTDASIKEMIPPGALVMLTPLIVGIFFGVETLSGVLAGALVSGVQIAISASNTGGAWDNAKKXYIEAGASEHARTLGPKGSEPHKAAVIGDTIGDPLKDTSGPSLNILIKLMAVESLVFAPFFATHGGLLFKIF

SEQ ID NO: 2202 - protein, 171 aa, Glycine max
MADGPASPGGGSHESGDHSPRSNVREQDRYLPIANISRIMKKALPANGKIAKDAKETVQECVSEFISFITSEASDKCQREKRKTINGDDLLWAMATLGFEDYMDPLKIYLTRYREMEGDTKGSAKGGDSSAKRDVQPSPNAQLAHQGSFSQNVTYPNSQGRHMMVPMQGPE

SEQ ID NO: 2203 - protein, 275 aa, Glycine max
FLVLSLPFWWRTEIFSLSQHNLSLAIQNETTFVPPPSTARSVSMRDMGTEMTPIASQEPSRTGTPVRATTPMRSPNSSRPSTPPRASPASTLTDLHSDNLNLNMNELSEKELQMKTRREIMVLGTQLGKMNIAAWASKEEEDKDASTSLKTKAELPKSVVEARAAAWEEAEKAKYMARFRREEMKIQAWENHQKAKTEAKMRKIEVEVERIQGKAQDKLTNKLAAARHKAEEKRAAAEANRNHQAAKTEEQAEYIRRTGHVPSSYLSFSCCNWCS

SEQ ID NO: 2204 - protein, 750 aa, Glycine max
  unsure (1)..(750): unsure at all Xaa locations
MDADSSGEEVVIKTRKPYTITKQRERWTEEEHNRFLEALKLYGRAWQRIEEHIGTKTAVQIRSHAQKFFTKLEKEAFVKGVPIGQALDIDIPPPRPKRKPNNPYPRKTNVGGAPTLHSGARHGKPLISIVSSLGKQALGLEKEPLPEKHDVDLRPSTVKENKDQSCSKVFTILQEAPCSSVSSANKNSTSILVPLRNSCALRKFIPSVKDVITQDETNDSFVTDDLENQKLEIDDGKHTQKSNGTCKVSKSENSGASELVQTEKTDGLNCALTIEGVQGNQNYPRHVPVHVVDGNLGTSTQNPSPDMVFQDSIFQPKGGVNGQPNLVTISATSNISESQNNTARSSIHQSFPPCPTFTQDDYHSFLQVSSTFSSLIVSTLLQNPAAHAAASFAATFWPYANAETSADSPMCTPDFPSRQIGSPPSVTAIAAATVAAATAWWAAHGLLPLCAPLHTAFACPPASAIAVPLMNIDESPQKTEQEEIKPQNSSLQDQILDPEHSEAQHSAPKSPAVFSSKSEERGDANLNTSPKATNHETNQVISENPDSNKMKGRKPVDRSSCGSNTTSSSEETELLLKDEKEKEEPKTPDANILDTELSNRRSRSINNLTDSWKEVSEEGRXLAFQALFSREVLPQSFSPTHHLINEDNQIDSIKDNELNTDYKDEDLESKKCSSICDGVQKNLLFVKDNNEEEGLLTIGLGPGKLKTRRTGFKPYKRCSVEANENRIGTACIQGEEKGPKRIRLNGEAST

SEQ ID NO: 2205 - protein, 179 aa, Glycine max
MTMGNKRAVICGVTYGKRKFKLEGTINDVNNMKNLLLDNFKFPIGCIRVLTEEQKDPNLIPTKKNILDSLNWLVKDCQSEDSLVFYFSGHGLQQPEDRKGDEIDGLDETICPVDFLREGMITDNEINSIIVQPLKQGVTLHAIIDACHSGTTLDLLYLCKKEKGSWKWKDNKPPHSKKL

SEQ ID NO: 2206 - protein, 168 aa, Glycine max
  unsure (1)..(168): unsure at all Xaa locations
MENADIPENANEHCPGPQSESAGKSDACEGCPNQQICATAPKGPDPDLVAIAERMATVKHKILVLSGKGGVGKSTFSAQLAFALAARDFQVGLLDVDICGPSIPKMLGLEGQEIHQSNLXXWSPVYVESNLGVMSVGFMLPNPDEAVIWRGPRKNGLIKQFLKDVYWG

SEQ ID NO: 2207 - protein, 228 aa, Glycine max
SGDSNLISFISMATQGQVITCKAAVAWEPNKPLTVQDVQVAPPQAGEVRVQILFTALCHTDAYTWGGKDPEGLFPCILGHEAAGIVESVGEGVTNVQPGDHVIPCYQAECGECKTCKSGKTNLCGKVRSATGVGVMLNDGKSRFSINGKPIYHFMGTSTFSQYTVVHDVSVAKIDPKAPLEKVCLLGCGVSTETLLSMLSNEFMKMCLHNDVTFAYAAVYYWCLAILH

SEQ ID NO: 2208 - protein, 469 aa, Glycine max
MDKVNRVCAKDEERPLRITRARARALRGITPYSRPSLKNEQKNVLRANSKRAASSGNKTFAVVPAVVQQKGRAVLSDISNMCAKPHDKCTKASKFQAKGVCTKKNTKLAASSVSTDVSSSHDDVRAKLAEELSTIKMVESNDTLREGVTADTSLSMQNSVKSDELRNSPNKDIDIICEKLGASDSLTIVDIDSELKDPQLWSFYAPDIYSNIRVTELQRKPLTNYMDKLQKDINPSMRGILVDWLVEVSEEYKLVPDTLYLTVNLIDRYLSTRLIQKQKLQLLGVTCMLIASKYEEMCAPRVEEFCFITDNTYTKEEVLKMEREVLNLVHFQLSVPTIKTFLRRFIQAAQSSYKAPYVELEFLANYLAELALVECSFFQFLPSLIAASAVFLAKWTLNESEHPWNPTLEHYTKYKASDLKTVVLALQDLQLNTKGCFLNAVREKYKQQKFNCVANLSPKSVQSLFQNQV

SEQ ID NO: 2209 - protein, 433 aa, Glycine max
  unsure (1)..(433): unsure at all Xaa locations
HNSRETSLLALPLLQSPPPAWPGXAIPEPSDFKTWDGQKPISVLGSTGSIGTQTLSIVAEFPERFKVVSLAAGXSNITLLADQIKTFKPEVVGLRNESLIDELKEALADVDXNPEIIPGEQGVIEAARHPDATTVVTGIVGCAGLKPTVAAIEAGKDIALAXKETMIAGXPFVLPLAHKHNIKILPADSEHSAIFQSIQGLPKGALRKILLTGSGGAFREWPAEKMKDIKLADALKHPIWSLGRKITIDSATLFNKGXLEVIEAHYLFGASYDDIEIVIHPQSIIHSLVETQDSSVIAQLGIPDMRLPXLYTLSWPERIYCSEVTWPRLDLSKYGSLTFYAPDDKKFPSVNLCYAAGRXAGGTMTGVLSAANEKAVEMFVEEKISYLDIFKVVELTCQEHQKELVASPSLEEIIHYDQWARQYAASLQKASSV

SEQ ID NO: 2210 - protein, 392 aa, Glycine max
  unsure (1)..(392): unsure at all Xaa locations
MGRRKNPSYNNPRASSMVGHEKNNNNINQCTSSKEDADMNNTHLRFEWAVDESSNLNQSMCDIEESDDKTNSDYYFECYSHFRIHEEMLLDTVRTKTYQKYFYMXNFLFKNKVVFDVGAGXGILSLFCAQAGAEDVDAVECYRLADIAKXFLREAYGYSNVLKGKXIEEIELPVGKFDIIISEWMGYFLLFENMLNSVLYARDKWLVDGGVVLPDKASLHLTAIEDADYKEDKIEFWNNVYGFDMSCIKKQAIMEPLVDTVDQNQIATNCQLLKTMDISKMAPGDASFTVPFKLVAERDDYIHALVAYFDVSFTKCHKLMGFSTGPRSRATHWKQTVLYLEDVLTICEGEAIVGSMAVAPNKKNPRDVDIMLKYSLNGRRCNVSRVQYYKMR

SEQ ID NO: 2211 - protein, 343 aa, Glycine max
MKMVSEGILLGIGNPLLDISAVVDQDFFKKYDITSNNAILAEDKHTPMFEELVEKYNVEYIAGGATQNSIKVAQWMLQVPGATSYMGGIGKDKFGEEMKKNSRLAGVNVHYYEDETTPTGTCAVCIVGDDRSLVANLAAANCYKSDHLKRPENWALVEKAKYIYIAGFFLTVSPDSIQLVAEHAAANNKIFSMNLSAPFICEFFRDVQEKALPYTDFVFGYETEARTFSKVHGWETDNVEEIALKISQWPKASGTHKRITVITQGVDPVCVAEDGKVKKFPVQLLPKEKLVDANGTGDAFVGGFLSQLVQEKPIEECVRAGCYAANVIIQRSGCTYPEKPDFH

SEQ ID NO: 2212 - protein, 131 aa, Glycine max
SPDSIQLVAEHAAANNKIFSMNLSAPFICEFFRDVQEKALPYTDFVFGYETEARTFSKVHGWETDNVEEIALKISQWPKASGTHKRITVITQGVDPVCVAEDGKVKKFPVQLLPKEKLVDANGTGTVLYCF

SEQ ID NO: 2213 - protein, 302 aa, Glycine max
MAALMDFYSSSPEFQLHSDPFRGELMEVLEPFMKSPSPNYFPSSPSLPNLYSNGLSSNTQSLIGFGQAQPTSLVGLNHLTPSQISQIQAQIQIQAQQHQNRSNTLSFLGPKPIPMKHAGMPPKPTKLYRGVRQRHWGKWVAEIRLPKNRTRLWLGTFDTAEEAALAYDKAAYKLRGDFARLNFPNLRHQGSSVGGDFGEYKPLHSAVDAKLQAICEGLAELQKQGKTEKPPRKSRSKLAEKVVSDKENNNSCKVEAASWSSEGSSPLSDLTFADVSEAQWEGDSDNYNLQKYPSYEIDWDSL

SEQ ID NO: 2214 - protein, 224 aa, Glycine max
MVRGKTQMKRIENATSRQVTFSKRRNGLLKKAFELSVLCDAEVALIIFSPRGKLYEFASSSMQESIERYRRHTKHVNPTTFRSVEQNMQHLKQEAENMMKKIDLLEAAKRKFLGEGLGACSIEELQRIEQQLERSLSNVRARKVFKEQIEQLKEKEKALLDENAKLTENARLSEKHDIHLQPATKNQNVNQPQCNAESSSSSDVETELFIGLPDTRARHISHHV

SEQ ID NO: 2215 - protein, 212 aa, Glycine max
MRTLCDVCESAAAILFCAADEAALCSACDHKIHMCNKLASRHVRVGLADPTDVPRCDICENAPAFFYCEIDGSSLCLQCDMIVHVGGKRTHGRYLLLRQRAQFPGDKPAQMEELELQPMDQNESRRDESQSLKLKIRDSQQNHSVSPVPRQENNIDGHGKMDKKLIDLNTRPLRLNGAAPNNQERGMDILRGNNHKSASVPPVESFKQESEK

SEQ ID NO: 2216 - protein, 720 aa, Glycine max
MQGQRRTVGSFPAIVSMMQGPSSSGTDMNHQSSLNHVQNAVDFCLSDYRGSSGETACLRGTGHNVQSFSGWNTGESSSRLNLINQVNDEGLKSEHGLSSSYNAATEDDLRSEEGQFKANNVIFPVSSNTNLHGNQSRVHPSFLQGSSSTHINQNISLDMGHVANAADRGKGKEAGSSVNANNTSGIDREKTLFGSASCNHTGASSESSGYMAWGDSANSSSSLVNWGPSCKRKALEGSSRQLCSGGSSSTLVQSGNGCWPTDPVDLNASSDLTDSTPIEDIPVTSPPLFQNATNEERQEAPNGFPLISIAENVERPLRNFDRRMSHLQHQESVPLNLPSTGSARHHNHSSLHQAPGSHSINDSLELRLTAGGTSSANSGASLNQSPALRIHSFPWNRTANPRGARSSTSYNSGERAVREDFNLRMFPRDSTEHPMNVPASSGHEPIGWHTPSGNVNNSGGAPPPSWIGSSSNVHSPANRSWIFNHEVPAENMQSVSEFSPWSLFPSISSASGVHNAHSAPSSSGPPSFTQGSSSNQSYARTALVMERRGGDVLSGGPHSLRALTFDNEGRRRLISEIRQVLMAMRRGENLRAEDYMVFDHPFLYHGMAEMHDRHREMRLDVDNMSYEELLALEEHIGDVSTGLNEDVIIKLMKQRIYVRAIIMTDSYTDLEPCCICQEEFSDGENVGSLDCGHEFHSGCIKQWLMQKNLCPICKTTALAT

SEQ ID NO: 2217 - protein, 149 aa, Glycine max
MGYVEVRYRGIRRRPWGKFAAEIRDPTRKGTRIWLGTFDTAEQAARAYDAAAFHFRGHRAILNFPNEYQSHNPNSSLPMPLAVSAPPSYSSSSSTSNYSGDDNNNHLVRPAFSGEIMQGGDHDDDTFELEYFDNKLLEELLQMQDNRHF

SEQ ID NO: 2218 - protein, 425 aa, Glycine max
NSSLIAFRIFLSCYPATGLAARLFTRVSQFVHVFVFFVFWITRILDLLNAPFLAVIEDRDARRMTARRLSDVVLDCVMPYIHDSKDRDAVSQVCRRWYELDSLTRKHVTIALCYTTTPDRLRRRFPHLESLKLKGKPRAAMFNLIPEDWGGFVTPWVRVISQYFDCLKSLHFRRMIVRDSDLQVLARSRGHVLQALKLDKCSGFSTDGLYYIGRYCRNLRVLFLEESSLVENDGDWLHELALNNTVLETLNFYLTDIANVRIQDLELIARNCPNLNSVKITDCEVLDLVNFFRYASALEEFCGGSYNEESEKYSAISLPAKLSRLGLTYITKNEMPMVFPYAALLKKLDLLYAMLDTEDHCTLIQRCPNLEVLESRNVIGDRGLEVLARCCRRLKRIRIERGDDDQGMEDEEGVVSQRGLIALSH

SEQ ID NO: 2219 - protein, 251 aa, Glycine max
MYGRSDSYESDLALLDSIRRHLLGESELIFGAPNFGSGRSSSFSSLDSCLSDDWGELPFKEDDSEDMVLYGVLRDAVNVGWVPSLDAGSPESVSSGFPAVKLEPDVMPALINPCPPPAPAVEEKKVVPPKGKHYRGVRQRPWGKFAAEIRDPAKNGARVWLGTFETAEDAALAYDRAAYRMRGSRALLNFPLRVNSGEPDPVRVKSKRSSSPESTAALPAKRKKVVVVGTVQEQVGSQVAECTRGEQLLVS

SEQ ID NO: 2220 - protein, 235 aa, Glycine max
MYGQSSSSSSSYESDLALLDSIRHHLLGESESIFGAPNFGSGRSSSFSSLDSCLSDNWGELPFKEDDTEDMVLYGVLRDAVNVGWVPSLDAGSPESVSSGFPAVKLEPDLMPALISTCPPPAVQGPAPAVVPAKGKHYRGVRQRPWGKFAAEIRDPAKNGARVWLGTFETAEDAALAYDRAAYRMRGSRALLNFPLRINSGEPEPVRVTAKRASAEPCSSSESGSWVKKRKKVVG

SEQ ID NO: 2221 - protein, 346 aa, Glycine max
MNERSRDEASPQLLDLISNEREWQMNKRNEGKSSEERKLELRLGPPGEDWSLGGKMKNNNTEREDQSLLSLGCFSPNINSNAFQSKASHPWPNYHHHGQGNNKKASSSSFLQFPSSTQPVMMGKDASCPKVVVELQQNGGDGKVFSPSSANTAVSQPNTSQKRTAPAPVVGWPPIRSFRKNLSSSSSASKPPPPPESQAEQQHNKVAGKKPVDNYANNKGLFVKINMDGVPIGRKVDLNAYDSYENLSSAVDELFRGLLAAQRDSSAGGVHNKQEEEKAITGLLDGSGEFTLVYEDNEGDRMLVGDVPWHMFVSTVKRLRVLKSSELSAFTLGSKQDKIPLDSAMK

SEQ ID NO: 2222 - protein, 89 aa, Glycine max
NRKLAAHAAQQKQEKEEEEEKLMLQKAKELDAFDQQNHGAVPQYSDKTYSRDKNGFHGANSVKVTSYEEEALRTMKAFWLPSATPEASV

SEQ ID NO: 2223 - protein, 424 aa, Glycine max
IDSSRDRTSIDDFEIIKPISRGAFGRVFLAKNRTTGDLFAIKVLKKADMIRKNAVESILAERDILITVRNPFVVRFFYSFTCRENLYLVMEYLNGGDLYSLLRNLGCLDEEVARVYIAEVVLALEYLHSLRVVHRDLKPDNLLIAHDGHIKLTDFGLSKVGLINSTDDLSGPAVNGTSLLEEDETDVFTSADQRERREKRSAVGTPDYLAPEILLGTGHGFTADWWSVGVILFELLVGIPPFNAEHPQIIFDNILNRKIPWPAVPEEMSPEALDLIDRLLTEDPNQRLGSKGASEVKQHVFFKDINWDTLARQKAAFVPASESALDTSYFTSRYSWNTSDGFVYPASDVEDSSDADSLSGSSSCLSNRQDEVGDECGGLTEFDSGTSVNYSFSNFSFKNLSQLASINYDLTKGWKDDPATNSSA

SEQ ID NO: 2224 - protein, 469 aa, Glycine max
MATAAEKLSALKSAVAGLNEISENEKNGFISLVGRYLSGEAQHVEWSKIQTPTDEVVVPYDTLAPTPEGSSEVKNLLDKLVVLKLNGGLGTTMGCTGPKSVIEVRDGLTFLDLIVIQIENLNSKYGSNVPLLLMNSFNTHDDTQKIVEKYQNSNIEIHTFNQSQYPRLVVEDFLPLPSKGHTDKDGWYPPGHGDVFPSLLNSGKLDALLSQGKEYVFVANSDNLGAIVDLKILNHLIQNKNEYCMEVTPKTLADVKGGTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARENPENPSIELGPEFKKVSNFLGRFKSIPSIVELDSLKVAGDVWFGAGVILKGKVSIVSKPGVKLEVPDGVAIVDKEINGPEDL

SEQ ID NO: 2225 - protein, 172 aa, Glycine max
MASAPTPREEFVYMAKLAEQAERYEEMVEFMEKVSASAESEELTVEERNLLSVAYKNVIGARRASWRIISSIEQKEESRGNEDHVAVIRDYRSKIEAELSNICDGILKLLDTRLVPSAASGDSKVFYLKMKGDYHRYLAEFKTGADRKEAAESTLSAYKAAQVYFFFFLSIL

SEQ ID NO: 2226 - protein, 239 aa, Glycine max
  unsure (1)..(239): unsure at all Xaa locations
MKIQCDVCEKAPATVICCADEAALCAKCDVEVHAANKLASKHQRLLLQSLSNKLPRCDICQDKPAFIFCVEDRALFCKDXCDEPIHLASSLSANHQRFLATGIRVALGSNCTKGNEKXHVEPSKPKAQEVPAKIPSQQVPSFTSSWAVDDLLELTDFESPDKVQKQSLEFGELEWLADVGLFGEQFPHEALAAAEVPQLPMTSSVGSHKAPKSLLSYKKPRIEVLDEDDDEHFTVPDLG

SEQ ID NO: 2227 - protein, 83 aa, Glycine max
HNSLLVFSTGRSPTIYGELRKQKPLLTPDITIMSVGTEITYGESMVPDDGWKQYLDHKWNRDIVMEETAKFPELTLQVCIYLI

SEQ ID NO: 2228 - protein, 189 aa, Glycine max
  unsure (1)..(189): unsure at all Xaa locations
MVYVKAQKSKAYFKRYQVKFKRRREGKTDYRARIWLINQDKNKYNTPKYRFVVRFYNKDIGAQIISGSIGGDIVLGAAYAHELPRYGLEVRVTNYAAAYCTGLLVCRRVLKTLXMDEEDEGNGEATGEEYFVEPAERRRAFRALLDGGVIRXTTRNRVCWGLXGALDGGVDISHRDTKGCLGVVRRRKS

SEQ ID NO: 2229 - protein, 338 aa, Glycine max
ERKSDVQRRLRLEKKLKEGYDPNDPLRLFLSGPESRQLLTREEESQLITQLQDLSRLEEVKIRLQTQLRREPTLAEWADAVGHSCYALQTQLHCANRSKEKLFHANLRMVVHIAKHYQGRGLSLQDLFQEGSTGLMKSIQKFKPEAGCRFGTYAYWWIRHAIRKAIFLHSRTIRLPENLYTLLGKLIEAKKSYIQEGNLHPTKEELARRVGITVEKLDNLLFASRNPISMQQTLWVDQDTTFQEITADSAIEIPGVTVSKQLMRMHVHNLLNILSPKERGIIRLRFGIEDGEEKTLSDIGKVFGLTKERVRQLESRALLKLRQCLESQGLDAYTDLLV

SEQ ID NO: 2230 - protein, 224 aa, Glycine max
MDSHLPDHFKCPISLEIMSDPVILSSGHTFDRSSIQRWLDAGHRTCPITKLPLPDHPALIPNHALRSLISNYAFLSPLHHTVSQPEALISTLASNSSSSDSKIEALKHLTRLSKRDSAFRRRLAESGAVPAVIAAVDDPSLQERALPLLLNLTLDDDSKVGLVAEGVVARVVEVLLHAPTPDCRAVAATIVTSLAVVEVNKATIGAFPAAIAALVAILRDGKGP

SEQ ID NO: 2231 - protein, 387 aa, Glycine max
HLQCQGVGGDALPSYMRGAVYWEPNKPLTIEEFNMPRPKAGEVLIKTKACGVCHSDLHVMKGEIPFSSPCVVGHEITGEVVEHGALTDSKTIERLPVGSRVVGAFIMPCGNCSYCSKGHDDLCEAFFAYNRAKGTLYDGETRLFFRNSGKPAFMYSMGGLAEYCVVPANGVSVLPDSLPYTESAILGCAVFTAYGAMAHAAQVRPGDSVAVIGTGGVGSSCLQIARAFGASDIIAVDVRDEKLQKAKTFGATHTVNSAKEDPIEKILEITGGKGVDVAVEALGKPQTFAQCTQSVKDGGKAVMIGLAQAGSLGEVDINRLVRRKIQVIGSYGGRARQDLPKLIRLAETGIFNLGHAVSRTYTFDEAGKAFQDLNEGKIVGRAVIEII

SEQ ID NO: 2232 - protein, 305 aa, Glycine max
  unsure (1)..(305): unsure at all Xaa locations
MEDNDSYIRRWEDLDIDILVKIFQLLDIFELTSGISRVCSAWRMACCDPLLWKTLDLSMLRSNFIKIPLEPFVYVDGRSDRTLTRILKXSLSLSQQSIMTLIFHFNLYVSDEQLTYTAERCPQLRRLVLPAWNRIKKPGMCKAIRGWKELESLTMPSIANPPYILEEISTHCKNFSELKIMGPCDIFFASSLAAFLPKLRVLSLRCSMLYKDVLILILDSLQHLEVLNISHCVLMEALPAPQQKRIIKEIDVTIRQKASRLREFLTCMEDSCVMCQRTRTDEGLIRWYKYEEGLWKTDEVRSLSL

SEQ ID NO: 2233 - protein, 116 aa, Glycine max
MEDNDYIRRWEDLDIDILVKIFQLLDIFELTSGISRVCSAWRLACCDPLLWKTLDLSMLRSNFIKIPLEPFVYVDGRSDRTLTRILKISLSLSQQSIMTVIFHFNLDGSDEQLTYT

SEQ ID NO: 2234 - protein, 246 aa, Glycine max
  unsure (1)..(246): unsure at all Xaa locations
GKSSEERKLELRLGPPGDDWSLGGKMKNTEREESLLSLGCFSPNNGXFSPSSANTAVSQPNTSQKRTAPAPVVGWPPIRSFRKNLASSSSASKPPPESQAEQHNKVAGKKPVDNYANNKGLFVKINMDGVPIGRKVDLNAYDSYENLSSAVDELFRGLLAAQRDSSAGGVHNKQEEEKAITGLLDGSGEYTLVYEDNEGDRMLVGDVPWHMFVSTVKRLRVLKSSELSAFTLGSKQDKIPLDSAMK

SEQ ID NO: 2235 - protein, 362 aa, Glycine max
  unsure (1)..(362): unsure at all Xaa locations
MEHADKGKESSNSINEVEVTNSPIICGLPDDISLMCLARIPRKYHSVMKCVSKRWRNLICSEEWFCYRRKHKLDETWIYALCRDKSNEIFCYVLDPTLSRRYWKLIDGLPPHISKRKGMGFEALGNKLSSXSGCSGFLGSTDEAYSYDASSNCWAQAASLSNARCYFACEVLDEKLYAIGGLVSNSSDNSWDTFDPLTKCWTFHIDPNIASDIEDSVVLDGKIYTRCARHTDVASHAFAVVYEPSSGTWQYADADMVSGWTGPAVVVYGTLYVLDQSLGTRLMMWHKERREWIPVGKLSPLLTRPPCQLVAVGKSIFIVGKTLSTVVVDVGDLGNEGQVMMGSSIPGLLSDFNVISCKCLSI

SEQ ID NO: 2236 - protein, 503 aa, Glycine max
  unsure (1)..(503): unsure at all Xaa locations
RHLATHTHPPLSAMDERHIQKSYWLQHSADLSVEAMMLDSKAAHLDKEERPEVLSLLPPFEGKSVIELGAGIGRFTGELALKAGQLLAVDFIDTAIKKNETINGHHNHVKFLCADVTSPNMSNNVSEGSVDVVFSNWLLMYLSDIEVEKLAERMVRWLKDGGYIFFRESXCHQSGDSKRKYNPTHYREPRFYTKVFKECHMSDNTGKFLWSFLLWGCKCIGAXMVRNKKNQNQICWSSRKVRSQDDRGFQRFLDRVEYSHKSILRYERMYGPGFVSTGGLETTKEFVAKLGLKPGQKVLDVGCGVGGGDFYMAENFDVEVIGIDLSINMISLAIERAIGLNYAVEFDCADCYRKTYPENTFDVIYTRDTMLHVKDKPTLFRSFYKWLKPGGKILITDYCKSAGSPSLEFAEYIKKGGYYLHDIKAYRQMLEDAGFDDVIAEDRTDQFVNTLQQELNALENKKDDFIGDFSEEDYNEIVERWKAKQTWGASREQMWGLFIAKKN

SEQ ID NO: 2237 - protein, 248 aa, Glycine max
MGPQRYHDTAGSRSGHRFPHPPLVNPHYHSFHHQTQPVQEMRGHSINFHPPPPVTAPSYRVPTNPSRSSSIFIQDSIEMGARHVGAAPFAGSHIYRPHRGSTHETTLRHRNLPPVTFLQVDDVTLLVDHHNDMRLDIEDMSYEELLALGERIGKVNTGLSEEMITSQMKTKTYLLLPTNAINLEEAASEEQENDSCIICQDEYKSQEKIGILQCGHEYHADCLKKWLLVKNVCPVCKSEALTPGEKCV

SEQ ID NO: 2238 - protein, 240 aa, Glycine max
  unsure (1)..(240): unsure at all Xaa locations
MYGQSCYESDLALLDSIRRHLLGDSEEHRFGAPNVNXGSTPLYSRSSSFGRLYPCLSNDWGELPLMEDDSEDMLLYGVLRDAVNVGWVPSLDASSPESFSSAFMPPVTVKSETDLFPAPEPICNPPVVQGPAPAVVPAKGKHYRGVRQRPWGKFAAEIRDPAKNGARVWLGTFETAEDAALAYDRAAYRMRGSRALLNFPLRINSGEPEPVRVTAKRASAEPCSSSESGSWVKKRKKVVG

SEQ ID NO: 2239 - protein, 506 aa, Glycine max
  unsure (1)..(506): unsure at all Xaa locations
KQKVAATKQYIENHYKEQMKNLQERKERRTILEKKLADADVSEEDQNNLLKFLEKKETEYMRLQRHKMGVDDFELLTMIGKGAFGEVRVCREKTSGHVYAMKKLKKSEMLRRGQVEHVKAERNLLAEVDSNCIVKLYLSFXDDEHLYLIMEYLPGGDMMTLLMRKDILTEDEARFYVGETVLAIESIHKHNYIHRDIKPDNLLLDRYGHLKLSDFGLCKPLDCSTLEENDFSVGQNVNGSTQSSTPKRSQQEQLQHWQINRRTLAYSTVGTPDYIAPEVLLKKGYGMECDWWSLGAIMYEMLVGYPPFYSDDPMLTCRKIVNWKTYLKFPEEARLSPEAKDLISKLLCNVNQRLGSKGADEIKAHPFFKGVEWNKLYQMEAAFIPEVNDELDTQNFEKFDESDSQTQSSSRSGPWRKMLSSKKDLNFVGYTYKNFEIVNDYQVPGIAELKKKQSKPKRPTIKSLFEXPEASDTSANDQPAQGSFLKLLPPQLEVSPHRDKNLPPRS

SEQ ID NO: 2240 - protein, 159 aa, Glycine max
  unsure (1)..(159): unsure at all Xaa locations
MGFPVGYSELLFPKLLLHILSLLGLLRKLICSLLRFMGLHDFLEPDIAAWPETRMPEEFESVSATLIREIPAXVVKFRELVDPPETCAVCLSEFEGNDEIRQLANLSHISHPRCLXRXMGYDQRTCPLCRWPLYRRNAGAFIENSGLPLVSLNIACGSF

SEQ ID NO: 2241 - protein, 979 aa, Glycine max
MGGGGGGGSKMWHKKWWEKISGQGCKIHQQYYQYIGSKKVKRALWRKLLLTWVVGWFIVSLRIFCYMSSQGTEKRKETLASMCDERARMLQDQFNVSMNHIQAMSILISTFHHAKSPSAIDQKTFAKYTERTAFERPLTSGVAYAVRVLHSEREQFEKQQGWTIKRMDTLEQNPVHKDDYAPEALEPSPVQEEYAPVIFAQDTIAHVISVNVLSGKEDRENVLRARESGKGVLTAPFRLLKTNRLGVILTFAVYKRDLPSNTTPNERIQATDGYLGGVFDVESLVEKLLQQLASKQTVIVHVYDTTNRTHPIAMYGSNESGDFFYHVSTLNFGDPFRKHEMHCRFKQKPPWPWVAITTSIGILVIALLVGYIFHATVNRIAKVEDDYREMMELKKRAEAADVAKSQFLATVSHEIRTPMNGVLGMLHMLMDTDLDVTQQEYVRTAQESGKALVSLINEVLDQAKIEFGKLELEAVLFDIRAILDDVLSLFSEKSQGKRVELAVYVSDHVPELLIGDPGRFRQIITNLMGNSIKFTDKGHIFVTIHLVEEVVRSIEVDKESNSENTLSGSPVADSRRSWEGFKAFSQEGPLGSFSSPSNDLVNLIVSVEDTGEGIPLESQPLIFTPFMQVGSSISRKHGGTGIGLSISKCLVGLMNGEIGFVSIPKIGSTFTFTAVFTNGHRSSSECKIQQINNQPQSASSEFEGMTALIIDPRSVRAEVSGYHIQRLGIHVEMVSDLKQGLSTISNGNVVVNMVLIEQEVWDRDLGLSSHFVNNTRRIDHGVPPKLFILVNSSSSFKASVNLGVHNPTVITKPLRASMLAASLQRAMGVQNKGAPHRELQSLSLRHLLRGRKILIVDDNGVNRAVAAGALKKYGADVVCVSSGKDAISSLKPPHQFDACFMDIQMPEMDGEMEDSVNREVSMDDFENITNWHVPILAMTADVIQATHEECLRCGMDGYVSKPFEAEQLYREVSRFFQSS

SEQ ID NO: 2242 - protein, 221 aa, Glycine max
MKLFSFSLACAFALLTSSLASATIQEHTFKVQNTTIKRFCKEQVIVTVNGTFPGPTINVREGDTVIVHVLNEGPYDITLHWHGVLQLFSPWADGPEYVTQCTIRPRSKYTYKFNVTQQEGTVWWHAHASYLRATVHGAFIIQPRSGQFPFPKPYKQIPLILGDLYNSNVEDITTEAQASGGGPNISCAFTINGFTSGLLINNCTENGMLAPLIIKTICSDS

SEQ ID NO: 2243 - protein, 250 aa, Glycine max
  unsure (1)..(250): unsure at all Xaa locations
MGRGRXVELKRIENKINRQVTFAKRRNGLLKKAYELSVLCDAEVALIIFSTRGKLYEFCSTNSMLKTLERYQKCSYGAVEVSKPXKELEQSSYREYLKLKARFESLQRTQRNLLGEDLGPLNTKDLEQLERQLDSSLKQVRSTKTQFMLDQLADLQNKEHMLVEANRSLTMKLEEINSRNQYRQTWEAGEQSMSYGTQNAHSQGFFQPLECNPTLQIGSDYRYNPEASEQQLAATTQAQQVNGFIPGWML

SEQ ID NO: 2244 - protein, 204 aa, Glycine max
  unsure (1)..(204): unsure at all Xaa locations
MAGSEPVSAEGESMAVDAAPRKPRILLAASGSVAAVKFANLCHCFSEWADVRAVSSSGSLHFIDRASMPKDVILYTDEDEWSSWKKLGDSVLHIELRKWADIMVIAPLSANTLGKVNTXCIVRAWDYSKPFFVAPAMNTLMWNNPFTERHFISIDELGISLIPPVTKRLACGDYGNGAMAEPSTIYSTVRLFYESKAQQGNGDI

SEQ ID NO: 2245 - protein, 214 aa, Glycine max
  unsure (1)..(214): unsure at all Xaa locations
MAGSEPVSAEGESMAVDAAPRKPRILLAASGSVAAVKFANLCHCFSEWADVRAVSTSASLHFIDRAAMPKDVILYTDDNEWSSWKKLGDSVLHIELRKWADIMVIAPLSANTLGKIAGGLCDNLLTCIVRAWDYSKPFFVAPAMNTFMWNNLFTERHLISXXELGISLIPPVTKRLAXGDYGNGAMAEPXTIYSTVRLFYESKAQQGRAVVTLR

SEQ ID NO: 2246 - protein, 161 aa, Glycine max
  unsure (1)..(161): unsure at all Xaa locations
MGFPVGYSELLFPKLLLHILSLLGLLRKLICSLLRFMGLHDFLEPDIAAWPEXRMPEEFESVSATLIREILXPVVKFRELVDPPETCAVCLSEFEENDEIRQLANCRHIFXRGCLDRWMGYDQRTCPLCRMPFIPDEMQGAFIERLWAASGIAEYPHVAPF

SEQ ID NO: 2247 - protein, 228 aa, Glycine max
MEDNDYIRRWEDLDIDILVKIFQLLDIFELTSGISRVCSAWRLACCDPLLWKTLDLSMLRSNFIKIPLEPFVYVDGRSDRTLTRILKISLSLSQQKILTVIFHFNLYVSDVASSYTAYLPKLRVLSLRCSMLYKDVLILILDSLQHLEVLNISHCVLMEALPAPQQKRIIKEIDVTIRQKASRLREFLTCMEDSCVMCQRTRTDEGLIRWYKYEEGLWKTDEVRSLSL

SEQ ID NO: 2248 - protein, 58 aa, Glycine max
FSFCSFQDSSVIAQLGIPDMRLPLLYTLSWPERIYCSEVTWPRIDLSKYGSLTFYAPD

SEQ ID NO: 2249 - protein, 114 aa, Glycine max
  unsure (1)..(114): unsure at all Xaa locations
MFPPGLIHHRTDGPGPGEVPRSGGAPSLVLTADPKPRLRWTADLHERFVDAVAQLGGPEKATPKTILRTMGVKGLTLFHLKSHLQKYRMGKXTGKETPEQSKDXSYLLDAQGGM

SEQ ID NO: 2250 - protein, 200 aa, Glycine max
  unsure (1)..(200): unsure at all Xaa locations
MEAKLWEARFSPTLPLLPPTPRLPSLNLHFPSSSTSTLHLARNSVSDTXPIQNEEKEQTLSSVKPTEFPTRPTRPXRYHFDGLHSYALFVDGTTRKFFEGWYFKVSIPERRQSFCFMYSVESPSFRKPLTPLELAQYGPRFTGVGAQILGADDKYICQYSPQSQFFWGSRHELMLGNTFGSNQNSKPPNKEVPPQGYTPS

SEQ ID NO: 2251 - protein, 192 aa, Glycine max
  unsure (1)..(192): unsure at all Xaa locations
MADSDNDSGGAHNGGKGSEMSPREQDRFLPIANVSRIMKKALPANAKISKDAKETVQEVRVKVSSAFITGEXADKCQREKRKTINGDDLLWAMTTLGFEDYVEPLKGYLQRFREMEGEKTVAARDKDAPPLTNATNSAYESANYAAAAAVPGGIMMHQGHVYGSAGFHQVAGGAIKGGPVYPGPGSNAGRPR

SEQ ID NO: 2252 - protein, 355 aa, Glycine max
MENADIPENANEHCPGPQSESAGKSDACEGCPNQQICATAPKGPDPDLVAIAERMATVKHKILVLSGKGGVGKSTFSAQLAFALAARDFQVGLLDVDICGPSIPKMLGLEGQEIHQSNLGWSPVYVESNLGVMSIGFMLPNPDEAVIWRGPRKNALIKQFLKDVYWGELDFLIVDAPPGTSDEHISIVQFLDATGVDGAIIVTTPQQVSLIDVRKEVNFCKKVGVKVLGVVENMSGLCQPITDFKFMKLTDNGEQKDVTQWVWEYMREKAPEMLNLLACTEVFDSSGGGAVKMSNDMGVPFLGNVPLDPQLCKAAEEGSSCFAKKDCVVSAPALNKIIEQLIETNGWSMLVSNGV

SEQ ID NO: 2253 - protein, 318 aa, Glycine max
  unsure (1)..(318): unsure at all Xaa locations
MHIARTTMTITQFVLNXQFEHPESSGDVNILLSHIVLGCKFVCSAVNKDXLAKLIGLAGDTNVQGEXENKLDVLSNEVLIKALISSXRTCILDSXEDGSSTIDCGVSIGKIFGVYALKDVHEPTIEDVLLPVKNMVAAGYSGHTTYGSSCTPVLNTGAGVNGFSLDPSLGEFILGTPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 2254 - protein, 339 aa, Glycine max
MDHSADAHRTDLMTITRFVLNEQSKHPESRGDFTILLSHIVLGCKFLCSAVNKAGLAKLIGLAGETNVQASEQKKLDVLSNDVFIKALVSSGRTCILVSEEDEEATFVEASKRGKLYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 2255 - protein, 264 aa, Glycine max
MAEASIGSKSSRWSLQGMTALVTGGSKGIGYAIVEELAQLGATVHTCARNEAELNESLNEWNTKGYRVTGSVCDVASRAERQDLIARVSNEFNGKLNILVNNVGTNVPKHTLDVTEEDFSFLINTNLESAYHLSQLAHPLLKASEAANIIFISSIAGVLSIGIGSTYGATKGAMNQLTKNLACEWAKDNIRTNCVAPGPIKTPLHFKEEKLNNSLIARTPLGRIGEAEEVSSLVAFLCLPAASYITGQTICVDGGFTVNGLYIS

SEQ ID NO: 2256 - protein, 140 aa, Glycine max
MMALNISSPAEVKSIFFADYFKSNCITAKFTGGFAFKRKERGAASGGRVYCSVLAPPPPPAWPGRAVPEQGSKTWDGPKPISIVGCTGSIGTQTLDIVAENPDKFKVVALAAGSNVTLLADQVKRFKPQLVAVRNESLIA

SEQ ID NO: 2257 - protein, 156 aa, Glycine max
  unsure (1)..(156): unsure at all Xaa locations
MATATYPPPPPYYRLYKDYLQDPNSAPDPPPPIEGTYLCFGANYTTSDVLPTLEEQGVRQLYSKGPNVDFKKELRSLNGELQLHVLELADILIERPSQYARRVEEISTVXKNLHHLLNSLRPHQARATLIHILEPLIQHRKQAVEDIKTLEKKRDS

SEQ ID NO: 2258 - protein, 157 aa, Glycine max
  unsure (1)..(157): unsure at all Xaa locations
KGSFNGLVDVYKEDPPSLMVFAGLYRXGFDISCVGIIVYRGLYLGLYDSLKPLLPADLQDSFFASFALGWLITNGAGLASYPIDTVRRRMMMTSGEAVKYKSSMDAFQQILKKEGPKSLFKGAGANILRAIAGAGVLSGYDKLQLLLLGKKYGSGSG

SEQ ID NO: 2259 - protein, 59 aa, Glycine max
  unsure (1)..(59): unsure at all Xaa locations
TELTEKNHWRMSDAGLYEHTRRKYGDGGTLMSEYYKSXKGRKTEKEVQDAPQAHREKAY

SEQ ID NO: 2260 - protein, 465 aa, Glycine max
MFFNQKIVLFKSFALMGTSNLLLFFSLMSLCAMAASKVVLIGNNITLSFDDIEANFAPAVKGSGKYGVLYLAEPLDACAELTNKVEQLPNASSPFALVVRGGCSFEEKVRIAQKAGFKAVIVYDNEEGGILVAMAGNSAGIRIHAVFVSKASGEILKKYAGLTNVEIWLIPTFENSAWSIMAISFISLLAMSAVLATCFFVRKHRIRRERPRASLVREFHGMSSRLVKAMPSLVFTSVLEDNCTSRTCAICLEDYCVGEKLRILPCCHKFHAACVDSWLTSWRTFCPVCKRDARTGLTDPPPSESTPLLSSTPASMASSAASMASSALHSARSSLASSSAIQISRAASQTPSVSRNHSIASTPYVQPSLRSSYHQSPSLSISRSSVDLRNASQRSLASHLNSPCSMGYPSLSSLNSRYMSPHIPSPSNASVSYMGSSSHQQHPLRYSESAASFSPFASTHSLPEC

SEQ ID NO: 2261 - protein, 302 aa, Glycine max
  unsure (1)..(302): unsure at all Xaa locations
MESPSVDNDGDCFSPLQLNATSINIEVYYNKAVNYTLMVTFISFLQVLLLIRQMEHSNTQSGAAKVSILMIGQQAIVDAYLCLIHLTAGILVESLFNAFATAAFFKFVVFSIFEMRYLLAIWKASRPLSSGEGWETMRRELSVLYSRFCXVLIYLKFLWQSXSCLHPHYILGITVTRLAIPLYIFGCPNNFMRIKPDKSWCVCLAVFIGLQAAILLLQHYLGSRWFIPREILPEKYSYYRRADQDTRHATDCVICMTAIDLSQRSNDCMVTPCDHFFHSGCLQRWMDIKMECPTCRRPLPPA

SEQ ID NO: 2262 - protein, 395 aa, Glycine max
ENKSKRIGIKPLVHQEKGKRVSKGIKHYPIHGMEKHCNVEIAAHVSRLSSSKHEGEHDSFQLEGLMESLSVNDDGYSVCNLIIYSTLTKIDHEHNTALNYVLMFGFISFLQVRNSTTSAVSCNTQSGAAKVSILMIGQQAIVDAYLCLTHLTAGILVESLFNAFATAAFFKFVVFSIFEMRYLLAIWKASRPLSNGEGWETMRRELSVLYSRFYGILLGGILLMYEFHNHLRPILLLVYSFWIPQIITNVIRDSRKPLHPHYILGITVTRLAIPLYIFGCPNNFLHIEPDQSWCVCLAIFVGLQAAILLLQHYFGSLWFIPRQFLPEKYCYYRRFAQDTNHATDCVICMTAIDLSPRSNDCMVTPCDHFFHSGCLQRWMDIKMECPTCRGPLPPA

SEQ ID NO: 2263 - protein, 471 aa, Glycine max
  unsure (1)..(471): unsure at all Xaa locations
MKKQVQGPIPNACLSESSRGARWSLNGMTALVTGGTRGIGHAIVNDLAAFGAAVHTCSRNQTELKKCLQEWQTQGFQATGSVNNVGTNFRKPTVEYSAEEYSELMTVNLDSGYHLCQLVYPLLKASVKGSIVFISSVAGVLSKNLACEWANDNIRSNCVVPWATRTPLVEHVICXQNQKFVEDILSRTPLKSIAEAEEVSSLXRSSINRGARWSLNGTTALVTGGTRGIGHAIVSDLAAFGAAVHTCSRTQTELNKCLQEWQSLGFQVTGSVCDVSSPSQREKLIEEVTSILNGKLNIYVNNVGTNFRKPTIEYTAEEYSQLMTVNLDSSFHLCQLAYPLLKASENGSIVFISSVAGVVSLGTGAVYAASKAAINQLTKNLACEWAKDNIRSNCVVPWATRTPLVEHLLRDQKFVDDIMSRTPIKRIAEPEEVSSLVTFLCLPAASYITGQVICVDGGLTVNGFQPSMRIT

SEQ ID NO: 2264 - protein, 172 aa, Glycine max
IRALASSSSAIAAGHTTFVTNPIREGSDSPSWGRRRREFPRRCGVITAIANSTTRRSWCSIRKPSTSSAMSATRSSSPSAAWPSTFFRFTRNVYLVWDDEAMSMEERRMSLPKYQVHDESSQVSHTTSLIDGVAFTSNQMSIGFMLPVFRFSCLHIVSYLKRYILYKFLILF

SEQ ID NO: 2265 - protein, 222 aa, Glycine max
  unsure (1)..(222): unsure at all Xaa locations
MGKKKKRVSSKVWCYYCDREFDDEKILVQHQKAKHFKCHVCHKKLSTAGGMVXIHVLHVHKASVTKVPNAKXGRESTDIEIYGMQGIPPDILAAHYGXENEEDVPSKAAKVDIPPTQLVGGMIPLPLGTGYPPRPTLPTMPPMYNPAVPVPPNAWMVPPRPQPWFSQPPAVSVPPAAPYTQQLLFPVQNVGPSLPSNFPGPQTQTTPSGFNTSGQLPITPLL

SEQ ID NO: 2266 - protein, 130 aa, Glycine max
MSGKGAKGLITGKTSAANKDKDKKKPISRSSRAGLQFPVGRIHRLLKSRTTANGRVGATAAVYSAAILEYLTAEVLELAGNASKDLKVKRITPRHLQLAIRGDEELDTLIKGTIAGGGVIPHIHKSLINK

SEQ ID NO: 2267 - protein, 694 aa, Glycine max
  unsure (1)..(694): unsure at all Xaa locations
HLLILSLPQWGLHFLSYTHRLNQMKKRPCGVYASLSESGEYYSHRPPTPLLDTVNYPIHMKNLSTNELKQLADELRSDVIFSLPLPMKLXLGAIWASLGLTVALHYVFNAPQDILWXVGHQSYPHKILTGRRDKMHTMRQTNGLSGLRSESEFDCFGTGHSSTNISDLEWLSYFGSQIGRYLKXEVIKTHLSSVTMVGQAYEAMNNAGILRDYGIVILNDNKQVSLPTATLDGPIPPVGALSSALSRLQSNRPLRELREVAKGVTKRIGGPMHELAAKVDEYARGMISGSGSSLFEELGLYYIGPVDGHNINDLVAILNEVKSTNTTGPVLIHVITEKGRGYPYAEKAADKYHGVTKFDPPTGKQFKSKATTRSYTTYFAEALIAEAEADKDVVAIHAAMGGGTGMNLFHRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAINDRPSCFRYPRGNGIGVQLPTGNKGTPLEIGKGRILIEGERVALLGYGSAVQNCLAAASLVEYHGLRVTVADARFCKPLDRSLIRSLAKSHEVLITVEEGSIGGFGSHVAQFMALDGLIDGKLKWRPIVLPDRYIDHGSPADQLSLAGLTPSHIAATVFNILGQTREALEVMS

SEQ ID NO: 2268 - protein, 134 aa, Glycine max
MSGKGAKGLIMGKSSGNDKDKDKKKPTTRSSRAGLQFPVGRVHRLLKGRSTAHGRVGATAAVYTAAILEYLTAEVLELAGNASKDLKVKRITPRHLQLAIRGDEELDTLIKGTIAGGGVIPHIHKSLINKSGQE

SEQ ID NO: 2269 - protein, 317 aa, Glycine max
  unsure (1)..(317): unsure at all Xaa locations
MKRLGSSDTLGALMTICPPTDEHSPRNNHVYGREFQSMLEGLDEEGCVEEPGHHSEKKRRLNVDQVKALEKNFEVENKLEPDRKVKLAQELGLQPRQVAVWFQNRRARWKTKQLERDYGVLKANXGSLKLNYDTLQQDNEALLKQIKELKSRLVQEENNNNTESDVSVKEEMMTTXRDSNPLCETAIPGSDSKELSYECFNKSDECGRGFFVFHVDFKDGSSDSDSSAILNEENNNHSPNNNAAISSXGVLQSHGLXVSPSSSSMNNCFQXQPQYQTTTTQYVKMEEHNFLSADEACNFFSDEQAPTLQWYCSEEWS

SEQ ID NO: 2270 - protein, 385 aa, Glycine max
  unsure (1)..(385): unsure at all Xaa locations
MGLVCSRSRRFREADAEENAQDAEIERRIELETKAEKHIQKLLLLGAGESGKSTIFKQIKLLFQTGFNETQLKCYIPVLHALVNXKYKLTAEXGNSLINFKFIEXRDGLANVNXKKLLKISSISGXFVKXCFRKCLAELKLTMYEVDNNEXKDSSANVIYVSYXGCYFLDNXAKITYAYYVPSQEEFKNAKVRTTGVVEIQFSPVGENKRSGEVYRLFDVGGQRNERRKWIHLFEGVTAVIFCSAISEYDQTLYEDENKNRMMETKELFEWVLRQPCFEKTSFMLFLNKFDIFEKKVLNVPLNVCEWFKHDYQPVSTEKQEIEHAYEFVKKKFEELYFQSTAPDCVDRVFKIYQATALDQKLVKKTFKLVDETLRRRNLFEAGLL

SEQ ID NO: 2271 - protein, 469 aa, Glycine max; identical to SEQ ID NO: 2208

SEQ ID NO: 2272 - protein, 336 aa, Glycine max
MLLSLHKLNLNLSSCSSSGIYLAVMDYSSWINTSLDLNINLHRVHEELPKKQVENNFFSLDLEVKKSSVKQESAGALAEELKRVSAENKKLTEMLTEMCENYNTLRSNLMEYMRKNPDKELSSSRKRKSASSNNNSTIPMGVNGTSESSSTDEESCKNPKEDMKTKISRVYMRTEASDTSLIVKDGYQWRKYGQKVTRDNPCPRAYFKCSFAPSCPVKKKVQRSVDDQSVLVATYEGEHNHPQFSSQMEATSGSGRSVTLGSVPCTASLSTSTPTLVTLDLTKSQGSNDSKSTKPKGDSPKVPQVLVEQMATSLTTDPNFRAALVAAISGRLLHNN

SEQ ID NO: 2273 - protein, 333 aa, Glycine max
  unsure (1)..(333): unsure at all Xaa locations
MDTCNVFEGSWVRDDSYPLYDASHCPFVERGFNCLANGRKDRDYTKWRWKPKNCEIPRFDARGILEQLRGKRVVFVGDSLSRTQWESMICLLMTGVEDKKSIYEIKGNKITKQIRFLGVRFSTFDVRIDFYRSVFLSHEIPNNSSALICSESXIPNNSSEHICSELWCXDVLIFNSGHWWTRTKLFDVGWYFQADSLLQLSIPFAERGFNCLATGRKDRGYTKWRWKTKICELPRLSSHWSGQNHNSCKVTKRPWKRTNRKERNPISNMINKVVKSMSAPVTVMHVTPMTAYRSDGHVGTWSDQPSVPDCSHWCLPGVPDMWNEILLSYLLPK

SEQ ID NO: 2274 - protein, 428 aa, Glycine max
  unsure (1)..(428): unsure at all Xaa locations
LRFHRTAGFKYGPSVVVLKVFSTAKKPTRLRLIRPYCSVRGQHNHGTGYFSPTNSQIPRQHILKFDADRMLAFLKDWSNLRITAVAGILVSVLMIIPPADAVDALKTCACLLKDCRIELAKCLSNPSCAANIACLQTCNNRPDETECQIKCGDLFENSVVDEFNECAVSRKKCVPKKSDVGEFPAPNPDVLVNSFNIADFSGKWFITSGLNPTFDTFDXWRIRTPGPGFXSCTDRRRGGEGGENGGDLISEVGRRVXYRVDWYILTSKIENKSDDYVFVYYRGRNDAWDGLWRCCCITRSAVLPESIVPELEKASKSVGRDFSKFIRTDNTCGPEPSLVERLEKKVEEGEETIVREVEQIEEEVEKVGKTEATLFQKLAEGFKMFQEDEENFLRGLSKEEMEILDGLKMEAGEVEKLFGRALPIRKLR

SEQ ID NO: 2275 - protein, 560 aa, Glycine max
  unsure (1)..(560): unsure at all Xaa locations
MGNTWRGSLKGKYIQGFSQPEDHSKRSTTHSDPSSTKQQDDNDNNNNNNNNNNNNNNNNNNLPFNAKREAIMRRGLDNQAYYVLGHKTPNIRDLYTLGRKLGQGQFGTTYLCTENSTSIEYACKSISKRKLISKEDVEDVRREIQIMHHLAGHKNIVTIKGAYEDPLYVHIVMELCSGGELFDRIIQRGHYTERKAAELTKIIVGVVEACHSLGVMHRDLKPENFLLVNKDDDFSLKAIDFGLSVFFKPGQVFTDVVGSPYYVAPEVLLKHYGPEADVWTAGVILYILLSGVPPFWAETQQGIFDAVLKGHIDFDSDPWPLISDSGKDLIRKMLCSQPSERLTAHQVLCHPWICENGVAPDRSLDPAVLSRLKQFSAMNKLKKMALRVIAESLSEEEIAGLREMFQAMDTDNSGAITFDELKAGLRRYGSTLKDIEIRDLMEAADVDKSGTIDYGEFIAATFHXLEREEHLIAAFQYFDKDGSGYITVDELQQACAEQNMTDAFLEDIISIIKEVDQDNDGRIXDYGEFAAMMQKGNAGIGRRTMRNSLNLSMRDAPSAQ

SEQ ID NO: 2276 - protein, 503 aa, Glycine max
MNSNNFFHPNKNIFLTLNAVFLFLLFSCFRSLGLFLRCRHPTHNTFTTQHLISLFCHPQNPQSFLLNISDPNKKKQASHGFPDPWLVLVKSTPLPEEDQIEEGLKKMKGSNNRFFTVALVAAWYSSNIGVLLLNKYLLSNYGFKYPIFLTMCHMTACSLLSYVAIAWMKVVPLQSIRSRVQFFKISALSLVFCVSVVFGNISLRYLPVSFNQAIGATTPFFTAVFAYLMTFKREAWLTYLTLVPVVTGVIIASGGEPSFHLFGFIICVAATAARALKSVLQGILLSSEGEKLNSMNLLLYMSPMAVVFLLPATLIMEENVVGITLALARDDSKIIWYLLFNSALAYFVNLTNFLVTKHTSALTLQVLGNAKGAVAVVVSILIFRNPVSVTGMMGYSLTVFGVILYSEAKKRSNERTTFSYTLQLQHLVFVTAQSTSRFLKENLFSMLVIRIQSFLTIIYIFFTHTPDLIERVSRCISNDRCRNSPQNKIAINDVSLLYLCWDN

SEQ ID NO: 2277 - protein, 274 aa, Glycine max
MSFVFRGTRADIENGFPGFIPERRALRVHATRPSNSNSLTFLVTVLLLFMILNSHQMSPNFLLWLVLGVFLMATMLRMYATCQQLQVQAQAHAAAASGILGHTELRLHMPPSIALASRGRLQGLRLQLALLDREFDDLDYETLRALDSDNVSTAPSMTEEEINALPVHKYKVSGPQCGGSSMQQTSSSTPAEKKQDNSNAVGSMKASDDELTCSVCLEQVDVGDVLRSLPCLHQFHANCIDPWLRQQGTCPVCKFRAGSGWSDNGHNDIIADMV

SEQ ID NO: 2278 - protein, 95 aa, Glycine max
ARGLLNLGCATGHPSFVMSNSFTNQTLAQIELWTQKDSGKYVNGKVYVLPKHLDEKVARLHLGNLGAELTVLSKEQADYIGVSVEGPFKPETYRY

SEQ ID NO: 2279 - protein, 342 aa, Glycine max
MAFPQHHFQQHYQTQQQQQPQNKSFRNLQTIDGQMSQQVAFYNPTDLQDQSQHPPYIPPFHVVGFAPGPVPPADGSDGGVDLQLQWNYGLEPERKRLKEQDFLENNSQISSVDFLQPRSVSTGLGLSLDNTRLTSTGDSALLSLIGDDIERELQQQDAEIDRFLKVQGGRLRQAVLEKVQATQLQSVSLIEDKILQKLREKEAMVESINKRNIELEDQMEQLTVEAGTWQQRARYNENMIAALKFNLQQAYVQSRDSKEGCGDSEVDDTASCCNGRSLDFHLLSRENTDMKEMMTCKACRVNEVTMVLLPCKHLCLCKDCESKLSFCPLCQSSKFIGMEVYM

SEQ ID NO: 2280 - protein, 391 aa, Glycine max
  unsure (1)..(391): unsure at all Xaa locations
MGGSISKRRRSKQHSSNFFPRYQQPHFPQSQDNGSVGHYGYSPQSYGGGRAPEQGKSLDRKYSRIGDDYKSLDQVTDALAKAGLESSNLIVGIDFTKSNEWTGGRSFQRRCLHHIGHEQNPYEQAISIIGKTLSSFDEDNLIPCFGFGDASTHDQEVFSFYPDERFCRGFEEVLERYRELVPQLKLAGPTSFAPVIEMAITIVEQSGGQYHVLVIIADGQVTRSVDTEHGQLSAQEKKTVEAIVKASEYPLSIILVGVGDGPWDMMKQFDDNIPARAFDNFQFVNFTEIMSKNMDRSXKETEFALSALMEIPSQYKATLELNILGKDIDRIPLPPPLYGAASFNSPKTSRQYSSRRSAQSSGNDVSTKHHATCECEKDLDLCPISRPNIDT

SEQ ID NO: 2281 - protein, 241 aa, Glycine max
  unsure (1)..(241): unsure at all Xaa locations
MGRGRVELKRIENKINRQVTFAKRRNGLLKKAYELSVLCDAEVALIIFSNRGKLYEFCSSSSMLKTLERYQKCNYGAPEANVSTREALVMELSSQQEYLKLKARYESLQRSQRNLMGEDLGPLSSKELESLERQLDSSLKQIRSTRTQFMLDQLSDLQRKEHLLSEANRSLRQRLEGYQINPLQLNPGVEEMGYGRNPAQTHGEALFQQMECEPTLQIGXTAGPSMSNYMAGWLPYLPCMK

SEQ ID NO: 2282 - protein, 190 aa, Glycine max
MESATVSSSESEMALPLPLASESQQPYVSELLSFTLDRLHKEPELLRVDADRIRRQMQEVAVGNYRSFIAAADALIAIRQEVSSIDNHLESLINEIPKLTSGCTEFIESAEQILEKRKMNQTMLTNHSTLLDLLEIPQLMDTCVRNGNYDEALDLEAFVGKLSTMHPKLPVIQALAADVRLTTQSLLSQL

SEQ ID NO: 2283 - protein, 252 aa, Glycine max
  unsure (1)..(252): unsure at all Xaa locations
MKMARGKNLFLQILWCFSLIGLSSQAQNYTFVVREAKYTRLCSTKSILTVNGEFPGPTIRANRGDTIFIDVYNKGNFNITLHWHGVKQPRNPWTDGPSYITQCPIQPGRKFTQRLIFTFEEGTIWWHAHSEWLRATVYGAIHIYPNKNNPYPFPQPDAEIPIIFGEWWTSDVNEVFRQSMETGGAPNVSDALTINGQPGDLFPCSSPETFKLNVEQGKTYHLRVINXAALNLILFFSFSQHNLTVVGADAVY

SEQ ID NO: 2284 - protein, 276 aa, Glycine max
INPGIPFFWWDSLILMQGQRRTIGSFPAIVSMMQGPSSSGTDMSHQSSLNHVQNAVDFRLSDYRGSSGETACLRGTGHNVQSFNGWSTGESSSRLNLINQVNDEGLKSEHGLSSSYNAATEDGLRSEERQFEPNNVIFPVSSNTNLHGNQSRVHPSFLQGYSSTRAEMHDSQGEMHLDVGYMSYEELLALEERIGDVSTGLSEDIIIKLMKQRIYVSVMTDSSIDLEPCCICQDEFADGENVGSLDCGHEFHSGCIKQWLMQKNLCPICKTTALAT

SEQ ID NO: 2285 - protein, 247 aa, Glycine max
  unsure (1)..(247): unsure at all Xaa locations
MEDIAIFGGESATTTRHYRSVSMDSFIGKLNFDEESPKLPPSPGQRSALMSPAGGIDGNSAAFSLEFGNGEFSGPELKKIMANEKLAEIALIDPKRAKRILANRQSAARSKERKMRYISELEHKVQTXLQTEATTLSAQLTLLQRDSAGLTNQNSELKFRLQSMEQQAKLRDALNEALTAEVQRLKLATAELSGDSHGSGCLIPQHSVNPLMFQQQQQPPTASQQNIHLQQQQQQQHQNGMPTQIPT

SEQ ID NO: 2286 - protein, 134 aa, Glycine max
  unsure (1)..(134): unsure at all Xaa locations
XQAXAKDRXEKGPTKGTXQGXRXAKKXGASXXNKPKKRHXXHGXAXHXRDEEXPNEXRRAXKERGENXGAXRQAXXKPXXAXAAXQGXDXDAKXKXXPXXPXXEXPTKXXQXXHAERNXAAXXSPGXXGXXHLP

SEQ ID NO: 2287 - protein, 175 aa, Glycine max
LHERCSCTFVLSTENGVNGFTLDPSLGEFILTHPNIKIPSKGKIYSVNEGNARNWDEPTTKYVQMCKFPQDGSPPKSLRYIGSMVADIHRTLLYGGIFMYPADAKSPNGKLRLLYEVFPMSYLMEQAGGQAFTGKQRALDLIPKKIHERSPVFLGSYDDIEQMKELYAASKEDDA

SEQ ID NO: 2288 - protein, 745 aa, Glycine max
  unsure (1)..(745): unsure at all Xaa locations
MSMSERKTIDLDQGWDFMQKGILKLKNILEGLPEPQFSSEDYMMLYTTIYNMCTQKPPHDYSQQLYDKYRESFEEYIVSTVLPSLREKHDEFMLRELVKRWANHKIMVRWLSRFFHYLDRYFIARRSLPPLNEVGLTCFRDLVYKELNGKVRDAVISLIDQEREGEQIDRALLKNVLDIFVEIGMGQMDHYENDFEAAMLKDTSAYYSRKASNWILEDSCPDYMLKAEECLKREKDRVAHYLHSSSEPKLLEKVQHELLSVYANQLLEKEHSGCHALLRDDKVEDLSRMFRLFSKIPRGLDPVSSIFKQHVTAEGMALVKLAEDAVSTKKAEKKDIVGLQEQVFVRKVIELHDKYLAYVNDCFQNHTLFHKALKEAFEIFCNKGVAGSSSAELLATFCDNILKKGGSEKLSDEAIEETLEKVVKLLAYISDKDLFAEFYRKKLARRLLFDKSANDDHERSILTKLKQQCGGQFTSKMEGMVTDLTLAKENQTSFEEYLTNNPNADPGIDLTVTVLTTGFWPSYKSFDLNLPAEMVRCVEVFKEFYQTKTKHRKLTWIYSLGTCNISGKFDPKTVELIVXTTYQASALLLFNSSDRLSYSEIMTQLNLSDDDVIRLLHSLSCAKYKILNKEPNTKTISSTDYFEFNSKFTDKMRRIKIPLPPVDEKKKVIEDVDKDRRYAIDASIVRIMKSRKVLSYQQLVMECVEQLGRMFKPDVKAIKKRIEDLISRDYLERDKDNANLFRYLA

SEQ ID NO: 2289 - protein, 1059 aa, Glycine max
  unsure (1)..(1059): unsure at all Xaa locations
MAGNDWLNSYLEAILDVGPGLDDAKSSLLLRERGRFSPTRYFVEEVIGFDETDLYRSWVRASSTRSPQERNTRLENMCWRIWNLARQKKQLESETAQRVNKRRLERERGRREATADMSEDLSEGEKGDPLSDLSAHGGVGDFNRSRLPRISSADAMETWANSQKGKKLYIVLISIHGLIRGENMELGRDSDTGGQVKYVVELARALGSMPGVYRVDLLTRQVSAPDVDWSYGEPTEMLSPRDTDDFGDDTGESSGSYIVRIPFGPRDKYIPKELLWPYIPEFVDGALNHIIQMSKSLGEQIGSGHAVWXPVGIHGHYADAGDSAALLSGALNFPMLFSGHSLGRYKMLQLLKQGRLTEDEINANSQDYAGNAAERIGQLENAVWSCSXASLIEEQWRLYDGFDPVLERKLRARIRRNVSCYGRFMPRMATIPPGMEFHHIVPHDGDIEGEPEGNLDHPAPQDPPIWSEIMRFFTNPRKPMILALARPDPKKNITTLVKAFGECRPLQELANLTLIMGNRDGIDEMSSTNASVLLSVLKLIDKYDLYGQVAYPKHHKQYDVPDIYRLAAKTKGVFINPAFIEPFGLTLIEAAAHGLPIVATKNGGPVDIHRVLDNGLLVDPHDQQSIADALLKLVSNKQLWAKXENGLKNIHLFSWPEHCKTYKLPSFRCHAIRQPQHHRSXEGTWGADIHAXDRKSGISHWMIEIENHFSXEKSEGSGNDNSLNSDGNAADRGAKLENAVLSWSKGISKDTRRGGATEKSDQNPNAGKFPPLRRRKHLFVIAVDCDTTSSLLETIKAIFESAGKDRAESTVGFILSTSLTISEIQSFLISGGLSPIDFDAYICNSGSDLYYPSLNPGDRPFVVDLYYHSHIEYRWGGEGLRKTLVRWADSITDKKGDNDEQIVSPAEQLSTDYCYAFKVRKPGMAPPVKELRKLLRIQALRCHPIYCQNGTRLNVIPVLASRSQALRYLYVRWGFELSKMVVFVGECGDTDYEGLLGGLHKSVILKGVGSSAISQLHNNRSYPLSDVTPLDSPNIVEATEGSSGADIQALIEKVGYLNG

SEQ ID NO: 2290 - protein, 169 aa, Glycine max
  unsure (1)..(169): unsure at all Xaa locations
MNDAFRKSYCIEHTTDLSVESMMLDSNASDLNKEERPEVLSLLPPYEGKSVVXLGAGIGRFTDELAKKADQLLAEDXIESAIQKNESITGHHKNVKIMCADATSPNLYISEGSVDLIFSDRLLMYLSDEEVENLPARMIMWSIAGAYGFFTETCLHQSEDSTREYNPAH

SEQ ID NO: 2291 - protein, 427 aa, Glycine max
  unsure (1)..(427): unsure at all Xaa locations
MSFRSIVRDVRDSFGSLSRRSFDVRLTGHHRGKSQGSVQDLHDQPLVIQNSRWASLPPELLFDIIRRLEESENTWPARKHAVACAAVCQSWRNMCKDIVKSPEFCGKLTFPVSLKQPGPRDGIIQCFIKRDKSNLTYHLFLCLSPALLVENGKFLLSAKRTRRTTYTEYVISMDADNISRSSNTYIGKLRSNFLGTRFIICDTQPPYSSAHICPPMTGKTSRRFYSKKVSPKVPSGSYNIAQVTYELNVLGTRGPRKMHCVMHSIPASALDAGGTVPGQPELLPRSLXDSFRSISFSKSLDHSIEFSSSRFSEIGESIIEDDDGKMRPLVLKNKPPRWHEQLQCWCLNFRGRVTVASVKNFQLIAATQPAAGAPTPSQPAPPEHDKIILQFGKVGKDMFTMDYRYPLSAFQAFAICLSSFDTKLACE

SEQ ID NO: 2292 - protein, 309 aa, Glycine max
NDLKDDTMIPIECFEEPWVIFRGKDGKPGCVQNTCAHRACPLHLGSVNEGRIQCPYHGWEYTTDGKCEKMPSTRLLNVKIKSLPCFETEGMIWVWPGNDPPTATLPSLLPPSGFEVHAEIVMELPIEHGLLLDNLLDLAHAPFTHTSTFAKGWSVPSLVNFLTPASGLQGYWDPYPIDMEFRPPCMVLSTIGISKPGKLEGQSTSQCATHLHQLHVCLPSSKQKTRLLYRMSLDFAPVLKHIPFMQHLWRYFAEQVLNEDLRLVLGQQERMNNGANVWNFPVSYDKLGIRYRLWRNALERGNKQPPFSK

SEQ ID NO: 2293 - protein, 323 aa, Glycine max
MTTFMDMYNTTSSIMTPDFLDQCSDQELMKALEPFMKSDSSSTTSSSITTYPSFSSFSSSPNLSSTTWSTQFCSSSYHQKGPTPTQASSFKLNQLTPSQIFQIQAQIQVPRGQFLSPKPIPMKHVRASPSSKPTKLYRGVRQRHWGKWVAEIRLPKNRTRLWLGTFDTAEEAALAYDNAAFKLRGENARLNFPHLRHHGARAYGEFGNYKPLPSAVDAKLQAICQSLGTKLQKLKTQNPIVLDTHKAETETSEFQDFNKVENYQTSSSSALSDEYSSSSSSSSPESDITLLDFSDSCETIDNLGLDLEKYPSVEIDWAALSDS

SEQ ID NO: 2294 - protein, 425 aa, Glycine max
ASTNLTIYCLMLTSWLTVGWIGNDAISPIIGEHDPYIHVSVRELTHLRVVTVLMTFIMVVAILTSIAIVRRILMATSVLKVAAKVIGEVQALIIFPLIPYTVLAVFYMFWISAALHLFSSGQVVQNNCNSNCCTYDLIAKRVNCDRCCGYSIHYTPHIGVAILFHLFGCYWATQFFIACSSTVIAGSVASYYWARGETSPEIPFLSVFSSMKRLMRYSLGSVALGSLIVSFVESIRFLLESIRRKLKGSSHVPDSWIGKAAYQSSQCFLRCIEWTIKSVNRNAYIMIAITGKSFFRASAIATELIMNNILRIGRVNVIGDVILFLGKLCVSLSSAAFAFLMLDAHKYRSAHNKISSPLLPVVVCWALGYIVATLFFAVVEMSIDTIILSFCQDSEEHGTAQYAPPLLIETLGDQNEMQRLTQGPQ

SEQ ID NO: 2295 - protein, 145 aa, Glycine max
YEQCREFLMQVQAIAKDRGEKCPTKVTNQVFRYAKKAGASYINKPKMRHYVHCYALHCLDEEVSNELRRAFKERGENVGAWRQACYKPLVAIAARQGWDIDAIFNAHPRLSIWYVPTKLRQLCHAERNSAAASSSVSAGSAHLPF

SEQ ID NO: 2296 - protein, 458 aa, Glycine max
  unsure (1)..(458): unsure at all Xaa locations
MKFQVIELLFGKSTPKQMIPKVTLLAVFAVLLFTVTPLSYPLFRYSSSSSSLKSNKQLSKKPSSAFDDLNESASLPSTSIKKCDIFTGEWVPNPKAPYYTNKTCWAIHEHQNCMKYGRTDSEFMKWKWKPNGCDLPVFNPFQFLEIMRGKSMAFVGDSVGRNQMQSMICLLSRVEWPIDVSYKRDDYFMRWKYPSYNFTMAAFWTTHLVKSKEADAKGPGPTGLCNLYLDEPDEKWITQIEDFDHVILNGGHWFTRSMVFYEKQKIVGCHYCLLENVPDLTMYYGYRKAFRTAFRAINRLENFKGTVFLRTFAPSHFENGLWNEXGGNCIRTKPFKSTEXHHLEGLNMEFYMIQLEEFKNTDKKTRKKGMKYILFNITKTSLLTPDGHPSRCGHWPNENVTLYNDCVHWCLPXGPIDTWSDFLLGMLKMEGVSSADERLQLHSNCQMKLIAYIYQYFM

SEQ ID NO: 2297 - protein, 390 aa, Glycine max
  unsure (1)..(390): unsure at all Xaa locations
MCMFYLSIRSSFLNIQLCNITVFTSKVCIFMTETDLIDLKCQIMKPYVWLQTSGDSIHQVEQEIAMFCPLICQEIIQKGMGSSKSCAICLPQQVSPPIWRFLPVLLATSSIILDYXNYHQVPGRSNKERKSYDEKFIRMDTKRLCELTSAADSLQLKPLVDLTSRALARIIEGKSPEEIREIFHLPDDLTEVTGXEEKYEPLENTTDDPRIRLLNRFYRIKRIEKKERERLKNVEVEEEHVDERSVDDLLSFINGNDGDPKEVKTSKNKKKNRRKKEQQQKNSSLKEASEVNKEVNGQSIRHQSAEADRIAETSNSHTEDVFAHREFDDGDIDDGIDPALKEKIDREVEDFARRLNSDWPERMQELLSSGQERKTMLFTPNGNSFLRRNA

SEQ ID NO: 2298 - protein, 332 aa, Glycine max
  unsure (1)..(332): unsure at all Xaa locations
MLSSNRRMAVERVPLVSLDDGIVGARDSSSSSSSSTYQRYDIQQVAKWIEQILPFSLLLLIVFIHQHLQGXFFVTICISAVMFKSNEILKKQRLLRRDRKVSVLLGISFAFMLHVISIYWWYRNDDLLYPLAMLPPKTPPPFWHTIFIILVNDTLVRQAAMAFKCLLLIYYKNGRGHNFRRQGQMLTLVEYTLLLYRALLPTPVWYRFFLNKDYGSLFSSLTTGLYLTFKLTSVVEKVQCFVSALKALSKKEVHYGVHATTEQVNAAGDMCAICQEKMQAPILLSCKHMFCEECVSEWFERERTCPLCRALVKPADLRTFGDGSTSLFFQLF

SEQ ID NO: 2299 - protein, 110 aa, Glycine max
  unsure (1)..(110): unsure at all Xaa locations
MSGVWVFKNGVVRLVENPGGEAVEGSRGGRRKVLVHRASNEVITSYAGLXVFKNGVVRLVENHGSEPKVLVHTARTEIIIPYARDFNKFKPMHMYDIVVKNKNAFEVRDM

SEQ ID NO: 2300 - protein, 750 aa, Glycine max
  unsure (1)..(750): unsure at all Xaa locations
MDAYSSGEEVVVKTRKPYTITKQRERWTEEEHNRFLEALKLHGRAWQRIEEHIGTKTAVQIRSHAQKFFTKLEKEALVKGVPIGQALDIDIPPPRPKRKPNNPYPRKTRIGTTSLHSGAKDGKLNLVESSHVNQALDLKKEFLHYSDLGLKVMNENRDXNPGEVFTLLQEVPCSSVSSAKKSSITMSVPLGNPCAFKEITPSVKEVIPRDEKTESFVTVELENGKLEINDGKQTNGTSKDSRLEDSDALHMKLVQNEKPDGLDCELTIDGMQGNQNYPRHVTVHVGLMATNGNLGTNTQNPSQDMLFRDSMFQPIGGVNGQRNVFTNTAPSNTSESQNNTARSSVHQSFLPYPPFTQHNQDDYQSFLHMSSTFSNLIVSTLMQNPAAHAAASFAATFWPYANPETSANSPRCSQGGFTNRQIGSPPCVAAIAAATVAAATAWWAAHGLLPLCAPLHTSFACPASVTTVPSMNTGEAPALKAEQEKTTLQNPPLQDQMLDPEYSEAQQAQHSASKSPAAILSDSESGDAKLNTSSKVTDHETNKTISEHLDSNKTKGRKPVDRSSCGSNTASSSDVETDALEKGEKGKEEPEIPDANQLAIEFSNRRRSVSNLTDSWKEVSEEGRLAFQALFSREVLPQSFSPPHALKNTDHQMDNANDNKQNIDDKDEDLDGKKCSSNYEAMQKNLLFVENNEGLLTIGLGQGKLKTHRTGFKPYKRCSMEAKENRVGASSNQGEEQGCKRIRLEGETST

SEQ ID NO: 2301 - protein, 607 aa, Glycine max
KRNLVFDKRLINLQEVQHYYNAKLNTPVHEISCSSVSSANKNTITMSVPLGNPCAFKEITPSVKEVIARDEKTESFVTVEPENGKLEINDGKQTNGTSKDSRLEDSDALHMKLVQNEKPDGLDCELTIDGMQGNQNYPRHVTVHVVDGNLGTNTQNPSQDMLFRDSMFQPIGGVNGQRNVFTNTAPSNTSESQNNTARSSVHQSFLPYPPFTQHNQDDYQSFLHMSSTFSNLIVSTLMQNPAAHAAASFAATFWPYANPETSANSPRCSQGGFTNRQIGSPPSVAAIAAATVAAATAWWAAHGLLPLCAPLHTSFACPASVTTVPSMNTGEAPALKAEQEKTTLQNPPLQDQMLDPEYSEAQQAQHSASKSPAAILSDSESGDAKLNTSSKVTDHETNKTISEHLDSNKTKGRKPVDRSSCGSNTASSSDVETDALEKGEKGKEEPEIPDANQLAIEFSNRRRSVSNLTDSWKEVSEEGRLAFQALFSREVLPQSFSPPHALKNTDHQMDNANDNKQNIDDKDEDLDGSKKCSSNYEAMQKNLLFVENNEGLLTIGLGQGKLKTHRTGFKPYKRCSMEAKENRVGASSNQGEEQGCKRIRLEGETST

SEQ ID NO: 2302 - protein, 690 aa, Glycine max
  unsure (1)..(690): unsure at all Xaa locations
LCLPQFCVRVSASGSADEERTIIRKEKVGWKINYSGEKPATPLLDTVNHPIHMKNLSTQDLEQLAAELRADIVHSVSDTGGHLSSSLGVVELSVALHHVFNTPEDKIIWDVGHQAYPHKILTGRRSRMHTIRKSSGLAGFPKRDESVHDAFGVGHSSTSISAGLGMAVARDLLGKNNSIISVIGDGALXTPSGLCLLSLVTKXNSNMIVVLNDNKQVSLPTCXTLDGPATPXVGALSSALSKIQASSEFRKLREAAKTITKQIGGQTHQVAAKVDEYARGMISASGSTLFEELGLYYIGPVDGHNIEDLVTIFEKVKAMPAPGPVLIHVVTEKGKGYPPAEKAADRMHGVVKFDPKTGHQLKAKSSTLSYTQYFAESLIKEAEIDNKIIVAIHAAMGGGTGLNYFHKRFPKRCFDVGIAEQHAVTFAAGLAAEGLKPFCAIYSSFLQRGYDQXVVHDVDLQKLPVRFALDRAGLVGADGPTHCGAFDITYMACLPNMVVMAPSDEAELMHMVATAAAIDDRPSCFRFPRGNGIGATLPLNNKGTPLEIGKGRILVEGSRVAILGYGSVVQQCRQASEMLKELGIDVTVADARFCKPLDTGLIRLLAKEHEILITVEEGSIGGFGSHVSQFLSLSGILDGPLKWRAMMLPDRYIEHGSPQVQIEEAGLSSKQIAATVLSLMERPNEALLFK

SEQ ID NO: 2303 - protein, 354 aa, Glycine max
  unsure (1)..(354): unsure at all Xaa locations
CNVEIAAQVSRLSSSKHGTXSSLSLEGLMESPSVDNDGDCFSPLQLNATSINIEVYYNKAVNYTLMVTFISFLQVLLLIRQMEHSNTQSGAAKVSILMIGQQAIVDAYLCLIHLTAGILVESLFNAFATAAFFKFVVFSIFEMRYLLAIWKASRPLSSGEGWETMRRELSVLYSRFCXVLIYLKFLWQSDLVISSLWICPXVIGSIXSMIMLCLQALHPHYILGITVTRLAIPLYIFGCPNNFMRIKPDKSWCVCLAVFIGLQAAILLLQHYLGSRWFIPRQILPEKYSYYRRFDQDTRHATDCVICMTAIDLSQRSNDCMVTPCDHFFHSGCLQRWMDIKMECPTCRRPLPPA

SEQ ID NO: 2304 - protein, 922 aa, Glycine max
  unsure (1)..(922): unsure at all Xaa locations
MSSIVKGIFLRSTADVCKNSIVSNLTPQRSATPGTRSTRVHWNLPLTSKSKTGKRATRTSYQPPIRRHASCAKGWTSPTIKDRDWLFSLSLQRPLSITCHRAGRFFVCPDYNQPMEHQRQATMKRIAYLLDKGVNGKKLPDGLWEEVLEGLQFVENDMGDILGNPLKPLLLSVRSGAAISMPGMMDTVLNLGLNDEVVAGLAAKSGERFAYDSYRRFLDMFGDVVMDIPHSLFEENNEKLKQTKEYKIDADAKNYNHKIVFEQHNKICLNEGVDAFISQIKKSVENVYFGECYDWXVPPVDEYLSAINNADKKSAAMLASSITGSGTIAFMADYPSKNRLLFPLRSKVDTTSFVANEIQARYITRRCWLTKSPSYNFSCGGSYFELEYKLVNXRYKIAVDMGHGGQIVICSGLMMVXDKEEHYPLLPGQSEDPSTNREKVIAVCFGTSPGAAVGHVVFTXNDAEXCLAQGKSVFLMMNQARKXRIKCSHADYEIFTDVGGMTSHTKLVAWSRGRGCVSGFFHILVNDAXKVFVVEDKVIXRSXWISMSGSTGEVILGKQPLSPPALSDDLEIFMSWSDKISYLKIMENAGTPENALIARQNGTQIIGFFKMENSLFXNASAVRKEXPMIMSVTPEQRKAALDLLLPYQRSDFEGIFRAMDGLPVTIRLLDPPLHEFLPEGDLEHIVRELTSDTGMKEEEIFSRIEKVXEVNPMLGFRGCRLGISYPELTEMQARAIFQAAVSVSNHGITVHPEIMVPLIGTPQELRHQVNLIRNVADKVLSEMGSSLSYKVGTMIEVPRAALVADEIAKEAEFFSFGTNDLTQMTFGYSRDDVGKFLPIYLSGGILQHDPFEVLDQKGVGQLIKICTEKGRAARPNLKVGICGEHGGEPSSVAFFAEIGLDYVSCSPFRVPIARLAAAQVAV

SEQ ID NO: 2305 - protein, 260 aa, Glycine max
GLSLNFPSSSLLFPHPNFYTHSPPPSCLLQSQQSLIGFEQPPSSLLGLNHLSPSQISQIQAQIEAQQSQNQNPHSLNFLGPKPVPMKHVGGPPKPTKLYRGVRQRHWGKWVAEIRLPKNRTRLWLGTFDTAEEAALAYDKAAYRLRGDFARLNFPSLKGSCPGEEYKPVHSAVDAKLDAICANLAEMQKQGKTEKGARSAKKSKQGPNQEAKPEPQASAESEGSADSSALSDLTFDVTEPQWEHFNLQKFPSYEIDWDSL

SEQ ID NO: 2306 - protein, 204 aa, Glycine max
TDESLKDAFSQYGKVTEAKVVMDKFSGRSRGFAFVTFDEKKAMEEAIEDMNGLDLEGRAITVDKAQPQGAGRDRNGDRDFDRDRGSRGGRDYGGGRAPRGGGGGDCFKCGKPGHFARECPDGDGGRGDRYGGRDDRYGGGRSDRGGDRSDRGGDRSDRDRSDRGGDRSDRDGDRSERGSDRYSSRSRDGGSGGDRYSRDRSGPY

SEQ ID NO: 2307 - protein, 150 aa, Glycine max
MSHQEQAVLSLLSKLALSFDGAVLGVALAFAAVRTLFKFTATSASLRKLRRAPSISVSDLRSLLAEPPSDADAGEIVIIRGTVDAKSAVDGTWKTLKPGVLVSRESGDKGVILQRTQTCIYNDWKGLLGWTSDLRAICARSLRQQDSTSF

SEQ ID NO: 2308 - protein, 372 aa, Glycine max
  unsure (1)..(372): unsure at all Xaa locations
MGTSANAVAGGRGGAPVPKDVDYANYFCTYAFLYHQKEMLSDRVRMDAYFDAIFQNKRHFAGKTVLDVGTGSGILAIWSAQAGARKVYAVEATKMSEHARALVKANNLQDVVEVIEGSMEEITLPEKVDVIISEWMGYFLLRESMFDSVINARDRWLKPTGVMYPSHARMWMAPIRTGIVDHKLGDYESTMDDWHHFVDETKTYYGVDMSTLTKPFSEEQRKYYLQTSLWNNLHPHQVVGTAGIIKEIDCLTATVADIEKVRSNFSMSITVENTKLCGFGGWFDVHFRGRSEDPAEHEIEXHLSEGDDLRVSFLMSRSKENHMRLNEGDDLRVSFLMSRSKENHRLMEVELGCEIHQHSGKILAPFKNSHGL

SEQ ID NO: 2309 - protein, 234 aa, Glycine max
MMWSFASNALTSIRLKIGSKQPSQTSAECSDDEVCSNASRDEGLECPICWESFNIVENVPYVLWCGHTLCKNCILGLQWAVVKNLKYPCKNFFLLWMVESLNGDRNKLVSTCTDNQPIWSPKCNLLGSQVTNCNLRRASVSPCSRLLGSNHDVGVNDGETHHFSLHKSLDFFLHFTSKFPLVVIFLLIALFLIPCCAVILVLYFLVTILFAIPSFLVLYFAYPTIQRLVREITS

SEQ ID NO: 2310 - protein, 430 aa, Glycine max
  unsure (1)..(430): unsure at all Xaa locations
MGNSEEEKSVKTGSPSSSPATTEQTNQPNIHVYPDWAAMQYYGPRVNIPPYFNSAVASGHAPHPYMWGPPQPMMQPYGPPYAAFYSHGGVYTHPAVAIGPHLHGQGVSSSPAAGTHSSVESPTKLSGNTDQGLMKKLKGFDGLAMSIGNCNAESAERGAENRAVTSVEYTGRVTVDGXSDGNTAGANQTKKKRXCREGTPTTDGEGKTELQNGPGXDKETSSSKKIVSATPASVAGTLVGPVVSSVGAKTLQLRNPSTVDSKANXPLSAPHHCAIVLNETFLQNERELKRERRKQANRESNSRIRMRKHAETEELARKVEMLTAENVSLKSEIIRLTEGSEQMRMENSALREKLRNTQLGQREEITLSSIDSKRAAPVSTENLLSRVNNSGSNDRTAENENDFCENKPNSGAKLHQLLDTNPRANAVAAG

SEQ ID NO: 2311 - protein, 336 aa, Glycine max
MERKIIDFDQGWDYMQKGITKLKKILEGAPETPFSSEEYMMLYTTIYNMCTQKPPNDFSQQLYDKYKDAFDEYIKITVLPSLREKHDEFMLRELVQRWLNHKVMVRWLSRFFHYLDRYFISRRSLPGLGAVGLTCFRESVYMEVRVNARKAVIALIDKEREGEQIDRSLLKNVLDIFVEIGMGEMGQYEQDFEVHMLEDTADYYKSKAANWIEIDSCPDYMLKAEDCLRRERDRVSHYLHCSTEQKLVEKVQLELLVIHANQLLEKENSGCHALLRDDKVEDLSRMYRLYHKIPKGLDPVANVFKQHITGEGTSLVQQAEEATSIKVPRPKMFLLP

SEQ ID NO: 2312 - protein, 409 aa, Glycine max
MGYICDFCGDQRSMVYCRSDAACLCLSCDRNVHSANALSKRHSRTLLCERCNSQPAFVRCVEEKISLCQNCDWLGHGTSTSSSTQAREAINCYSGCPSAAELSSIWSFVLEIAAISESTCEQELGLMSINENKSVGVPPEDQNVSGSDEVTDLPALNKSLVGASLMPESSSEPCILDQPAGPTNECLPKLYCPATKCPALSEDDNLYDDFNMDEVDLDLENYEELFGMALSHSEELFENGGIDSLFGTKGMSAGDSNCQEAIAAEGSSVGQVNAMQPACSNAASADSILSTKTEPILCFTGRQAQSNLSFSGVTGESSAGDYQDCGASSMLLMGEPPWFAPCPENSLQSANRSNAVMRYKEKKKTRMFDKKVRYASRKARADVRRRVKGRFVKAGDVYDYDPLSTTRSF

SEQ ID NO: 2313 - protein, 179 aa, Glycine max
GSRRVGVSVSASKSEDRKRINDVLDKHLERSSPSTSRPITSASKNSNLQVEESETESEESDVSGSDGDDTSWISWFCNLRGNEFFCEVDDDYIQDDFNLCGLSSQVPYYDYALDLILDVESSHGDMFTEEQNELIESAAEMLYGLIHARYILTSKGMAAMLDKYKNYDFGRCPRVFICS

SEQ ID NO: 2314 - protein, 140 aa, Glycine max; identical to SEQ ID NO: 1266

SEQ ID NO: 2315 - protein, 472 aa, Glycine max
  unsure (1)..(472): unsure at all Xaa locations
MATAAEKLSALKSAVAGLNEISENEKNGFISLVGRYLSGEAQHVEWSKIQTPTDEVVVPYDTLAPTPEGSSEVKNLLDKLVVLKLNGGLGTTMGCTGPKSVIEVRDGLTFLDLIVIQIENLNSKYGSNVPLLLMNSFNTHDDTQKIVEKYQNSNIEIHTFNQSQYPRLVVEDFLPLPSKGHTGXKDGWYPPGHGDVFPSLLNSGKLDALLSQGKEYVVCCQFRXLGEHIVDLKILNHLIQNKNEYCMEVTPKTLADVKGGXTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARENPENPSIELGPEFKKVSNFLGRFKSIPSIVELDSLKVAGDVWFGAGVILKGKISIVSNPGVKLEVPDGAVISDKEINGPEDL

SEQ ID NO: 2316 - protein, 251 aa, Glycine max
  unsure (1)..(251): unsure at all Xaa locations
LQVSIIVIARGADSLRQNCPTKCTSPIEKKSDPDSDGAVSSLDSEHVCPSSQHVTPTTDASSGEVWSTPVLPVQLSPKKALRAAMLKSRFADTILKAQQKXFLDHGDKGNPQKMQQEKERLERIQREERARIEAQIKIAEAAARMRAEEESRQRREKEREAARAAIEKMKRTVDIEHNVEIIKELESLSGCTLSYKAVGCRNGYKVALETLDKPQFENPLERLGLFIKEDFTADEDEEVLNGGFEEGEIFN

SEQ ID NO: 2317 - protein, 181 aa, Glycine max
  unsure (1)..(181): unsure at all Xaa locations
PNVDMMTFDNEVELYKIKLYHPYAKLIIRIKTDDSNSTLKFSSKFGCSVEDAKTFLEKAKSLELDVIVVXFHVGSRCNDPNTYISSIRDAKEVFKMGESLGMKMTVLDVGGGFPGTKGETVVQFEDMAKAINEGIDLHFNDVEDLRVIAEPGRYFATSSHTLVFNVIGKRKITESNGEPHF

SEQ ID NO: 2318 - protein, 394 aa, Glycine max
  unsure (1)..(394): unsure at all Xaa locations
MTEMLEEESLSVQCRVGSAFNIKGAMQCPNCRKIEKGQWLYANGCRSYPEFSMDEWTHDEDLYDLSYSEMSFGVHWCPFGNLARLPSSFEEGEFSSSAYHDVLGQHAIFAEHTAVSSASHPCPYIAYFGPIHPSSSNSGGTVSEASNFNHWNGSSVPSDMPTSYTFPAVDLHYHSWEHHSPPFSTASSRLVAADQPSVSPGSQRPARGGSDVPRSGSFMHPFLVGHSCTTFNALISAXSAARVGSSVASSMIPPYPGSNARTRDRVQALQAYYQPQQPPNSTTMRTPIASGTRRSSSHNGSPQLAPIATSSDQSAGFVYIPSGSSGRNFQEETHLPSRFHAWEREHLPSLALNNVGRESSWRAYHQTASVSDPSIRSSSFRLRHESDRMPSQNR

SEQ ID NO: 2319 - protein, 433 aa, Glycine max
  unsure (1)..(433): unsure at all Xaa locations
MPSLVAEAFQANGAEPLNLKPIFCASGIKGKRVTALSAEKNGLTDFIQRIIADKPDIDTPFSVLDLGVVMGLMDQWACKLPTVQPFYAVKCNPNLSLIGALAALGSSFDCASKAEIESVLSLGVSPDRIIYANPCKSESHIRYADSHANPSPTSDTPPXVGVNVTTYDSLDEVEKIRNCHPTRELLLRIKPPQDSGPRTSLGLKYGALPEEVHELLQAAHEAGLKVTGVSFHTGPPLEPATAXLPARPAPNGRKRLLEMPPLGVGVPRRALVWTRRGWLHLRDGRLLLAAVETGRLFAEPASATRTGAWGKPVRGVASLYXLHVGIDGTLNNIVFDYATVTCMPLACTSKPENPTCCRDLNLKTYPSTVFGPTCDSIDTVLRDYQLPELQVNDWLVFPNMGAYTTSSGTNFNGFSSSAKSIFLACSSPEHTMF

SEQ ID NO: 2320 - protein, 368 aa, Glycine max
  unsure (1)..(368): unsure at all Xaa locations
MEHADKGKESSNSINEVEVTNSPIICGLPDDISLMCLARIPRKYHSVMKCVSKRWRNLICSEEWFCYRRKHKLDETWIYALCRDKSNEIFCYVLDPTLSRRYWKLIDALPPQISKRYCIGFAALGNNLCXFACYVLDEKLNAVVGLVSNSTDYSCDAFDPSTKSWTFHIDPKIASDIEISVVLDRKIYTRCVRDVVFASPSCALEYAPSGMVSEXTGPAVAVDCTLYVLVLSAGPNLLVQHIGTRERILDGELSPLPIRQPLXLVVVGTPCQLVAVGKSIFIVGKTISGVVVDVGDLGNEGQVMMGFYIPGLLSDFNVISCKCLSIVIIVYYYVMTCINVTSFFFLGTMIVQRIELMTLCKLHDSSIN

SEQ ID NO: 2321 - protein, 112 aa, Glycine max
IKKLVSRSSKAGLHFAVGRIHRLLKIRVSANVRVGDTADVDSADILKYLAAEALEVTGNANKDLKVKRITPIHLLLAIRGDEELDSLIKGTIAGGGVIPHIHKCLIDKSSKE

SEQ ID NO: 2322 - protein, 228 aa, Glycine max
  unsure (1)..(228): unsure at all Xaa locations
CTIFCLIQGAIMHEDFEGHKGTIEAGDLQWMTAGRGIVHSEMPAAQGTQKGLQLWINLASKYKMIEPRYQEVLSKDIAEAEDDGIKVRVIAGEALGIKXPIYTKIPNMFLDFSLRSGGHLQQNIPTSWNSFFYILEGEGILGNMISQPSNSHHILLLGPGDGLKAWNKSSKLLRFILVGAQPLGEPLVQFGPFVMNSQEEIDQTIDDFENFANGFEKARHWTSESQIN

SEQ ID NO: 2323 - protein, 167 aa, Glycine max
  unsure (1)..(167): unsure at all Xaa locations
MGRSPCCDKVGLKKGPXWTPEEDQKLLAYIEEHGHGSWRALPAKAGLQRCGKSCRLRWTNYLRPDIKRGKFSMQEEQTIIQLHALLGNRWSSIATHLPKRTDNEIKNYWNTHLKKRLNKMGIDPVTHKPKNDTXRSTQNPSKTTSNISSIAQSHRSRLETSARLLSA

SEQ ID NO: 2324 - protein, 113 aa, Glycine max
MMRLRWSLLVMVTFAVSLFWVGSLQVQASNSVSAFVQNAIYSNRIAVFSKSYCPYCLRAKRLLAELNEKPFVVELDLRDDGFQIQSVLLDLIGRRTVPQVFVNGKHIGGSDDT

SEQ ID NO: 2325 - protein, 462 aa, Glycine max
MQPPRRKNNNLPNSETSTTMKGKRNSSISISIVVVVFSIFLFGVFMYNEDVKSMAEFTFLRPKAQEIQEETVSNNNSRTQPERNRVEDSEESQEPIDLKAVVAEEKIVEEYEEENEEVVLPPEECDLFTGEWVFDNLTHPLYKEDQCEFLTSQVTCMRNGRSDSLYQNWRWQPRDCSLPKGRRLMFVGDSLNRNQWESMICLVQSVVPQGKKSLSKNGSLSIFTIEDYNATVEFYWAPFLVESNSDDPKMHSILNRIIMPESIEKHAVNWKNVDYLIFNTYIWWMNTATMKVLRGSFDEGSTEYDEVPRPIAYGRVLNTWSKWVEDNINPNRTKVFFSSMSPLHIKSEAWNNPDGIKCAKETIPILNMSTTLQVGTDRRLFVVANNVTQSMKVVPVNFLNITTLSEFRKDAHTSVYTIRQGKMLTPEQQADPATYADCIHWCLPGLPDTWNEFLYTRIISQS

SEQ ID NO: 2326 - protein, 386 aa, Glycine max
MEHKLALTVGQPIRCKAPVCRKAGEPLGIEEVIVAPPVPGEARIRIICSSHCRTDISFRNMQGPPANFPTILGHEAIGVVESVGEDVTEVAKGDMVVPIFIAECGECIDCKSSKSNLCSKFPFKVSPWMPRHATSRFADLKGEIIHHFLSVSSFSEYTVVDIAHLIKIDPAIPPNRACLLSCGVSTGVGAAWRAAGVEPGSTVAIFGLGSIGLAVAEGARLCGATRIIGVDINSERYEIGKKFGITDFVHSGECEKKSASQVIIEMTDGGADYCFECVGNASLMHEAYASCRKGWGKTIVLGLDKPGSKLSLSCSEILVSGKSLVGCMFGGLKPKSHVPILIKRYLDKELNLDGFVTHEVEFKDINKAFDLMIKGQCLRCVIWMDK

SEQ ID NO: 2327 - protein, 373 aa, Glycine max
  unsure (1)..(373): unsure at all Xaa locations
RKTERHMTSAAPLVKGGFQEACKNVXQDVCRIFFQDLCKSDPATVTNCKHEFHLQCILEWCQRSSQCPMCWQPISLRDTTSQELLEAVELERSLRDTPSRNAAIFHHPALGDFELQHLPMAMNEADIEERIIQHLTAAAAMRRSHHGRQTECHRSXGRPHFLVYSTQPSAPPSAAGGGSEPAAIPVGSPSTPLTFDGNEQSSLQQIPHVQTQSSSLTSASTVSTTNLQGVHSDDRSFASHSFPASQDRAQPSEQSFSDSLRSRFNAVSMRYKDSISKGTRGWKERLFSPNSSMSELGSEVRRELNAKIASVSRLMERLETRENNSAAGTSLSNHLVNRSIAETSNQSNVEARGENSLHGNNTPTTFSASSDSK

SEQ ID NO: 2328 - protein, 326 aa, Glycine max
RHISAFTLTTLAKKKRYLPVIHANVYQTIKLLHDGSKEFAQNDVDSSKYVISNENKEIGEKLLEIGGRLDYPYLSKELAQEIENLWKDPAIQETYARGSELQIPDCTDYFMENLQRLSDANYVPTKEDVLYARVRTTGVVEIQFSPVGENKKSDEVYRLFDVGGQRNERRKWIHLFEGVSAVIFCAAISEYDQTLFEDENRNRMMETKELFEWILKQPCFEKTSFMLFLNKFDIFEKKILKVPLNVCEWFKDYQPVSTGKQEIEHAYEFVKKKFEESYFQSTAPDRVDRVFKIYRTTALDQKVVKKTFKLVDETLRRRNLLEAGLL

SEQ ID NO: 2329 - protein, 107 aa, Glycine max
MALPKAKEIVSSNSVVVFSKTYCPFCVDVKKLFGDLGANYKAIELDTESDGKELQAALVEWTDQRTVPNVFIGGNHIGGCDSTTALHTQGKLVPLLISAGAGAKSTA

SEQ ID NO: 2330 - protein, 86 aa, Glycine max
GKMENGLIENHGFQPQYGVSELSEKNFWRMFDAGLYEPFRRKYGAVGPFMSVYFKSKKGRKTEKEVQKAEQGPLETAYAEADQPVD

SEQ ID NO: 2331 - protein, 198 aa, Glycine max
  unsure (1)..(198): unsure at all Xaa locations
MANTDALSFFKDFMAGGISAAVSKTAVAPIERVKLLLQVQAASTQIAADKQYKGIVDCFVRIPKEQGFASFWRGNLANVIRYFPTQALNFAFKDIYKQIFLGGVDKNTQFWRYFAGNLASGGAAGASSLCIVYPLDFARTRLAADIGKGDGRQFNGLADCLKKTFKSDGLIGMYRGFGXVSSQGIIIYRAGYFGFFDT

SEQ ID NO: 2332 - protein, 360 aa, Glycine max
  unsure (1)..(360): unsure at all Xaa locations
MATPVEPPNGIRTEGKHYYSMWQTLFEFDSKYVPIKPIGRGAYGIVCSSVNRETNEXSHLDEXQNTFENRVSRQRTSLKTGFLRKLHHLNIIAVKDIXYVVFKGMDTDLHQIIKSSQALSNDHCQYFLFQLLRGLKYLHSANILHRDLKPGNLLINANCDLKICDFGLARTNCSKNQFMTEYVVTRWYRAPELLLCCDNYGTSIDVWSVGCIFAELLGRKPIFPGSECLNQLKLIINILGSQREEDIEFIDNPKAKKYIKSLPYSPGTPLSRLYPNAHPLAIDLLAKMLVFDPTKRISVTEALQHPYMAPLYDPNCDPPAVIPIDLDIDEDLGEEMIRDMMWKEMLHYHPESAMESAGLC

SEQ ID NO: 2333 - protein, 155 aa, Glycine max
MASTKKITLKSSDGEAFEVEEAVALESQTIKHMIEDDCADSGIPLPNVTSKILAKVIEYCKKHVEANSADEKPSEDVLKAWDADFVKVDQATLFDLILAANYLNIKSLLDLTCQTVADMIKGKTPEEIRKTFNIKNDFTPEEEEEVRRENQWAFE

SEQ ID NO: 2334 - protein, 530 aa, Glycine max
  unsure (1)..(530): unsure at all Xaa locations
MAEIEGSPGSSMHGVTGREQTFVASVASPIVPTDTTAKFALPVDSEHKAKVFKLFSLANPHMRTFHLSWISFFTCFVSTFAAAPLVPIIRDNLNLTKSDIGNAGVASVSGSIFSRLAMGAVCDMLGPRYGCAFLIMLSAPTVFCMSFVKDAAGYIAVRFLIGFSLATFVSCQYWMSTMFNSXIIGLANGTAAGWGNMFRGATKDIMTFIXSSTKXAGATPFTDWRIALFVPGFMHVIMGILVLTLGQDLPDGNLGALQKKGNVAKDKFSKVLWYAITNYRTWIFALLYGYSMGVELTTDNVIAEYFYDRFNLKLHTAGIIAASFGMANLVARPFGGYASDVAARLFGMRGRLWTLWILQTLGGVFCIWLGRANSLPIAVLAMILFSIGAQAACGATFGIIPFISRRSLGIISGLTGAGGNFGSGLTQLVFFSTSKFSTATGLSLMGVMIVACTLPVSVVHFPQWGSMFLPPSKDVSKSTEEFYYTSEWNEEEKQKGLHQQSLKFAENSRSERGKRVASAPTPPNATPTHV

SEQ ID NO: 2335 - protein, 237 aa, Glycine max
MCGGAIISDFIGVKRGRNLAAQELWSELDPFSDFLGFDTTNTTNQPPLQKIPDKKVVSSCEKKKKKSVSAEKKKSDSGRARKNVYRGIRQRPWGKWAAEIRDPHKGVRVWLGTFPTAEEAARAYDDAAKRIRGDKAKLNFPATTISAAAAPPPSKKQRCLSPDTTTEQSSSSSSQSTTGSTGESGGGNDELDLKQLEWFLGLENELPVSNNMGAEWDNMDDLWMLDDVVVPNRHLIY

SEQ ID NO: 2336 - protein, 250 aa, Glycine max
  unsure (1)..(250): unsure at all Xaa locations
MEGQRSQRWGYLKDKAIATSLAEEEMENSMDGEEDDTGDEDKRKRVMERARGPNTERVPLRLCLVDRCTANLTEAKQYYRRHKVCEVHAKASSATVAGVKQRFCQQCSRFRELAEFDETKRXSCRRRLAGHNERRRKISGDSYGEGSGRRAVSLTQTQERNRIDMKLPMTNSPFTRPTDQIKPTSTRPTDSLSSVIHLSSIFPASSCPPNDGPLPCLGSWILVLNPATIYIYKTLVPFMLSFKGCIATKV

SEQ ID NO: 2337 - protein, 207 aa, Glycine max
  unsure (1)..(207): unsure at all Xaa locations
MGRGKIEIKRIENSSNRQVTYSKRKNGILKKAKEISVLCDAQVSLIIFGVSGKMHEYISPSTTLIDVLDRYQRASGKTLWDAKHENLSNEIDRIKKENDSMQIELRHLKGEDITSLNYKELMALEDALENGLSGVREKKMEVHRMFKRNDKILEEQNKELNFLLQQHLALEGVGNXMDNGFNEIKRVFNSHMQRAASLKQPNLKERI

SEQ ID NO: 2338 - protein, 630 aa, Glycine max
FGSSVTQEDGPEVDGELTQLTRGVDGSSTKALPTIWLEVMRFFTNPHKPMILALSRPDPKKNITTLLKAFGECRPLRELANLTLIMGNRDDIDEMSSGNASVLTTVLKLIDKYDLYGQVAYPKHHNQSDVPEIYRFAAKTKGVFINPALVEPFGLTLIEAAAHGLPMVATKNGGPVDIHRALNNGLLVDPHDDIAIADALVKLLSEKNMWHECRKNGWKNIHLFSWPEHCRTYLTRVAACRMRHPQWQTNNPEDDKAVEEEESFNDSLKDEHDMSLRLSIDGDLAAASGGTGLDMQDQVKRILSKIRKTDSGSNGNGGGNINMLLDNVTSTSTSTNTSKYPLLRRRRRLIVIALDLYDNNGAPEKKMIEMVQKIIKAVQLDPQTARVTGFALSTAMPVIETVEFLTSGNVQVNEFDALICSSGSQVYYPGINTEEGKLLPDPDYEVHIDYRWGCEGLKKTIWKLMNGDENSPIEEDLKSSNAHCISYKIKDLSKAKKVDELRQKLRMRGLRCHPMYCRGSSRMHVIPLLASRAQALRYLFVRWRLNVANMYVILGETGDTDYEEMISGTHKTIIMKGVVSKGSEELLRGPGSYQRDDIVPNESPLVASITETTHENIANALKQLSKSGGI

SEQ ID NO: 2339 - protein, 480 aa, Glycine max
  unsure (1)..(480): unsure at all Xaa locations
FGSSVILNDSRHSLLPKIEEGPKTFVNALSSTLSKLQSSKSFRRFREAAKGVTKRIGXMHELAAKVDEYARGMMGPLGSTLFEELGLYYIGPVDGHNIEDLICVLQEVASLDSMGPVLVHVITDENQGDENSQKSDISDGQQDEGSVKSDSLDNPVRPQTYGNCFVETLVVEAEKDKDIVVVHAGLTMEPSLELFQEKFPDRFFDVGMAEQHAVTFASGLACGGLKPFCVIASSFLQRAYDQVVHDVDQQRIPVRFVITSAGLVGSDGPLQCGAFDINFMSCLPNMIVMAPSDEVELMHMVATATRINSQPICFRYPRGALVGRGYTISDGIPIKIGRGRVLVEGKDVAFLGYGSMVQNCLKAHSLLAKLGIEVTVADARFCKPLDIKLLRQLCKHHSFLVTVEEGSIGGFGSQVAQFIAVNGLLDGRIQWRPIVLPDRYIEHASPNEQLDQAGLSGHHIAATALSLLGRTREALLFMCS

SEQ ID NO: 2340 - protein, 423 aa, Glycine max
MDRLNGSANLMIVSDLDFTMVDHDDPENLALLRFNALWEAYYRHNSLLVFSTGRSPTIYGELRKQKPLLTPDITIMSAGTEITYGESMVPDDGWKQYLDHKWNRDIVMEETAKFPELTLQSETEQRPHKVSFYLEKGKAPNVTQTLSKRLENRGLDVKIIYSNGIALDVLPQAAGKGQALAFLLEKLKADEQGPINTLVCGDSGNDAELFTVPEVNGVLVSNAQEELLQWYAENARGNPRIIHATERCAAAIVQAIGNFSLGPNVSPRDIGDLMSNRKVHSPSHEVVMFYIFYERWRRGEVENPEQYIQKLKSVFHSTGNFVHPSGIDQPMHQTIDTLAKAFGDKTGKDFRVWVDCISLAEVSLGSWLVKFDKWELSGNESRGCSTKALMNAKVDVPDEYTWMHLHHTWLDDVGGQDDVSWLL

SEQ ID NO: 2341 - protein, 493 aa, Glycine max
  unsure (1)..(493): unsure at all Xaa locations
MQKWMKSPYESYSQFLLRVKPRLSSYLFTLLAFILFAAILYGHDFVFIFRPHLYSNDHTTQTLFSTPVDVRSSTTKKENIEENKTAGTKSKREEEEECDVFNGRWVPDEMTRPRLQGSEREENKTVLTKTKREEEEQECDVFSGMWVRDELTRPLYEESECPYIQPQLTCQEHGRPEKXYQRWRWQPHGCNLPTFNARLMLEKLRGKSMIFIGDSLNRSQYVSLICLLHQIIPENAKSMETFDSLTVFTAKEYNATIEFYWAPFLLESNSDNAVIHRVTDRIVRKGSINTHGRHWKGADIVVFNTYLWWITGSKMKILYVSLFSQTFRLGSFNDKVKEIIDMPTEDAYRMAMKSMLRWVRLNMDSNKTRVFFTSMSPSHAKSIEWGGEAGGNCYNETTTIDDPTYWGSDSKKSIMQVIGEVFRKSKVPITFLNITQLSNYRKDAHTSIYKKQWNPLTPEQLANPASYADCVHWCLPGLPDTWNELLFVKLFYP

SEQ ID NO: 2342 - protein, 950 aa, Glycine max
MSSIVKGIFIRSTADVCKNSMVLKKQSEIVGRRSTRVQWQLHLRSKSNTWKRGSRRSYQPPIRGQAILTPATPPTTKKRVFTFGKGRSEGNKAMKSLLGGKGANLAEMATIGLSVPPGLTISTEACQEYQQNGKKLPDGLWEEVLEGLQFVENEMGAILGNPLKPLLLSVRSGAAISMPGMMDTVLNLGLNDEVVAGLAAKSGERFAYDSYRRFLDMFGDVVMDIPHSLFEEKLEKLKHTKGVKLDTDLTTYDLKDLVEQYKNVYLEARGEKFPSDPKKQLELAVKAVFNSWDSPRAIKYRSINQITGLKGTAVNIQSMVFGNMGNTSGTGVLFTRNPSTGENKLYGEFLINAQGEDVVAGIRTPEDLEVMKSCMPDAYKELEGNCEILEKHYKDMMDIEFTVQENRLWMLQCRSGKRTGKGAFKIAVDMVNEGLVDIRSAIKMVEPQHLDQLLHPQFEDPSTYKDKVIAVGLPASPGAAVGQVVFTADDAEEWHAQGKSVILVRNETSPEDVGGMHAATGILTARGGMTSHAAVVARGWGKCCVSGCSDILVNDAEKVFVVGDKVIGEGEWISLNGSTGEVILGKQPLSPPALSDDLEIFMSWADEIRHLKVMANADTPEDAVTARQNGAQGIGLCRTEHMFFASDERIKAVRMMIMAVTPEQRKAALDLLLPYQRSDFEGIFRAMDGLPVTIRLLDPPLHEFLPEGDLEHIVRELTSDTGMKEEEIFSRIEKLSEVNPMLGFRGCRLGISYPELTEMQARAIFQAAVSVSNHGITVHPEIMVPLIGTPQELRHQVNLIRNVADKVLSEMGSSLSYKVGTMIEVPRAALVADEIAKEAEFFSFGTNDLTQMTFGYSRDDVGKFLPIYLSGGILQHDPFEVLDQKGVGQLIKICTEKGRAARPNLKVGICGEHGGEPSSVAFFAEIGLDYVSCSPFRVPIARLAAAQVAV

SEQ ID NO: 2343 - protein, 129 aa, Glycine max
  unsure (1)..(129): unsure at all Xaa locations
MGRFTFDAVVSLFVTVHPHETSALLHSFFCFFFILSAYFVVLPLRDEGAISLGLSNLPGLFVGSLVLTLIAAPFSSLIFSLPNLSXRFFSGSLILVFILWHSSSAGYSKSNITGSTPLTFSSRKKGKWC

SEQ ID NO: 2344 - protein, 274 aa, Glycine max
MYGQSSYESDLALLDSIRRHLLGDSEEHKFGAPNVSSGNTPAYSRSSCFSRLYPCLSNDWGELPLKEDDSEDMLLYGVLRDAINAGWVPSLDASSPESFSSGFIPAVTVKSEPDLFPAPEPVYIPPAAQKAEPAVVPAKGKHYRGVRQRPWGKFAAEIRDPAKNGARVWLGTFETAEDAALAYDRAAYRMRGSRALLNFPLRINSGEPEPVRVTAKRYSPEPSSSSSDSASSTKRRKKVVGSTVTAQSGLRKEQVGSQVAHSAHVESSCWSTNA

SEQ ID NO: 2345 - protein, 864 aa, Glycine max
  unsure (1)..(864): unsure at all Xaa locations
MSSWRSLLLRIGDKSPEYGPSSDYKDHIDTCFGALRRELDHSQSEILEFLLMCAEQLPHKIPLYGTLIGLINLENEDFVKQLVEKTQSKFQDALDSGNCNGVRILMRLLTVMMSSKVLQPSSLVAVFETFLSSAATTVDDEKGNPLWQPCADFYITCILSCLPWGXGAELTEQVPEDIERVMVGVKAYLSIRKHTSDTGLSFFENDDEXGEGLTDKDFLEDLWDRIQVLSSNGWKVDSVPRPHLSFRDELLAGKSHEFGSDFSTSLPSLPSVPSGVSIGKQKHEAELKYPQSIHRLNIFPPSKIEDLQPIDRFVMEEYLLDVLLFFNGCRKECASFMVGLPVSFRYEYLMAETIFSQLLMLPQPPFKPVYYTLVIIDLCKALPGAFPAVVAGAVRTLFERIADLDMECRTRLILWFSHHLSNFQFIWPWEEWAYVLDLPRWAPQRVFVQEVLEREVRLSYWDKVKQSIENAPGLEELLPPKGGPNFSFGAEDDKESNEHVLSGQLNNMVKGKAPVREIISWIDESVLPNNGLEVTLRVVVQTLLNIGSKSFTHLMTVLERYGQVFAKLCPDQDKQVMLIAEVSSFWKSNTQMTAIAIDRMMGYRLVSNLAIVRWVFSAENIEQFHMSDRPWEILRNAVSKTHNRISDLRKEILSLKKNISSSEEAAKEAKAELDAAESKLTLVDGEPVIGDNPARLNRLKSHAEKTKEEVVSLQESLEAKEALLSRAIEENEALFLLLYKSFSNVLTERLPEGSRTLHELKSAQVDVVMAVDPEEPSSMELDNQNQRPQNSHTNGEKKGGAYNVGEKEQWCITTLGYVKAFSRQYAAEIWPHVEKLDAEVLTEDAPLLFRSAVYSGLRRPIHEA

SEQ ID NO: 2346 - protein, 149 aa, Glycine max
  unsure (1)..(149): unsure at all Xaa locations
MDHQADTNRTDLMTITRFVLNEQSKYPESRGDFTILLSHIVLGCKFVCSAVNKAGLAKLIGLAGETNVQGEEQKKLDVLSNEVFVKALISSGRTCLLVSEEVEEAIFVPSSHRGKYIVVFDPLDGSSNIDXRVSIGTIFGIYMVKNEAE

SEQ ID NO: 2347 - protein, 422 aa, Glycine max
  unsure (1)..(422): unsure at all Xaa locations
MDKDKSLGLPPPSGRYSXYSPTRSVFNVKSEPSPSSSSTTSYPPLALGTTSSESSHYGHGMSTDSSGFSHDISRMPDNPPRNRGHRRAHSEILTLPDDISFDSDLGVVGAGDGPSFSDDAEEDLLSMYLDMDKFNSSSATSTFQMGEPSNAVGASASTPGSGAPNYSAENVVFGTIERPRVRHQHSQSMDGSTTIKPELLVSGSEDMSAADSKKAISAAKLAELALIDPKRAKRIWANRQSAARSKERKMRYIAELERKVQTLQTEATSLSAQLTLLQRDTNGLNSENSELKLRLQTMEQQVHLQDALNDALKEEIQHLKILTGQXYGTPNGGPMMNFASFGGGQQFYPNNHAMHTLLAAQQFQQLQIHPQKQQQHQFQQLQQQQREQHQQSIDLKMREATPTPCPKDNASSDVNPSGAKDC

SEQ ID NO: 2348 - protein, 313 aa, Glycine max
  unsure (1)..(313): unsure at all Xaa locations
NSARSNLRKAAAQEVVDKVRQHSGVLVDQAQLVSKELIRVAILWHEMWHEALEEASRLYFGEHNIEGMLNVLEPLHEMLEEGAMKNNVTIKERIFIEAYRQELLEAYECCMNYKRTGKDAELTQAWDIYYHVFRKIDKQLQSLTTLDLESVSPELLECRNLELAVPGSYRADAPVVTIASFARQLVVITSKQRPRKXTIHGSDGDDYAFLLKGHEDLRQDERVMQLFGLVNTLLENSPKTAEKDLSIQRYAVIPLSPNSGLIEWVPNCDTLHHLIREYRDARKITLNQEHKXWLSFAPDYDHLPLIAKVEVID

SEQ ID NO: 2349 - protein, 419 aa, Glycine max
MEHLPVEVIGNTLSLLGSARDVVVASVTCKKWREAWRNHLHSLSFNYCDWPLFHDFTSARLEILITQTIFQTKALQSLTIFLDDEHKFSAAPVIAWLMYTRDSLRQLLYNVRTTPCFNIIEKCSRQRLEVLALARNPITGVDPSYLKFPCLKSLSLSFISISALDLTLLLSACPKLETLAMVGVEIAMSDSQASVELSSVSLKFFDLELFSSDKFILEADLLEKLHLKDCSFEAFELIGKGTLKVLKIDDVNIIHLDIGDSTENLEIIDVCNFTVMWPKFYHMISKASKLYKLRLWGVVFDDEDEVVDIETISVCFPQLTHLSLSYDLRDGVLHYGLQGLSCLMNVVVLELGWTVISDLFSVWVAGLLEGCPNLKKLVIYGFVSEVKTHEECQILARFSEFILQLGRKYGHVKFEFEYE

SEQ ID NO: 2350 - protein, 221 aa, Glycine max
MKLFSFSLACVFVFALLASSLASAAIVEHIFKVQNTTIKRFCKEQVIVTVNGLFPGPTINVHEGGTVIVHVLNEGPYDITLHWHGVLQLFSPWADGPEYITQCTIRPRSKYTYKFNVTQQEGTVWWHAHASYLRATVHGAFIIKPRSGRFPFPKPYKQIPLILGDLYNSRVEDITTEAQASGGRPNISYAFTINGLTSGHLMNCTENETFKMKVQQGKNYM

SEQ ID NO: 2351 - protein, 322 aa, Glycine max
MAPSSKAEKKAAVDAAAWMFNVVTSVGIIIVNKALMASYGFSFATTLTGMHFATTTLMTVVLRMLGYVQPSHLPLPDLLKFVLFANFSIVGMNVSLMWNSVGFYQIAKLSMIPVSCLLEVVLDKIRYSRDTKLSIGVVLMGVGVCTVTDVSVNGRGFIAAFIAVWSTSMQQYYVHFLQRKYSLSSFNLLGHTAPAQAASLLLLGPFLDYWLTNKRVDRYDYNTASLIFIFLSCTIAIGTNLSQFICIGRFTAVSFQVLGHMKTILVLIMGFFFFGKEGLNLQVVFGMIIAVAGMIWYGNASSKPGGKERRSHTLPTNKTETR

SEQ ID NO: 2352 - protein, 553 aa, Glycine max
  unsure (1)..(553): unsure at all Xaa locations
MGGVTSLLMLLCLFAGAMSPVKGEDPYFFFTWNVTYGTLSPAGVPQQVILINNEFPGPNINSTSNNNIVVNVFNNLDEPLLFHWAGVQQRKNSWEDGVAGTNCPIQPGTNYTYHFQVKDQIGSFFYYPSLGLQRAAGGFGGLRINSRLLIPVPYADPEDDYTVLAGDWFTKSHSTLRKLLDGGRSLGRPQAVLLNGQNAKGDGTDKPXFTMIFGKTYKYRICNVGLKNTINFRIQNHPMKLVEMEGSHTVQNTYNSLDVHLGQCFGVLVTANQEPKDYYMVXASTRFTKSILTGKGIMRYTTGKAPPSPEIPEAPVGWAWSLNQFRSFRWNLTASAARPNPQGSYHYGQVNITRTVKFINSVSRDSGKLRYAINGVSHVDGETPIKLAEYFGVPEKVFKYDIISDNPSQDVGKNVVLQPNVIRFKHRTFIEIIFENPEKSVQSYHLNGYAFFAVAIEPGTWTPEKRENYNLLDAVSRHTMPVFPKSWAAILLSFDNVGVWNLRSELAENRYLGQQLYISVLTXERSLRXEYNIPEYALLCGVVKGLPKPEPYH

SEQ ID NO: 2353 - protein, 179 aa, Glycine max
MARPQQRYRGVRQRHWGSWVSEIRHPLLKTRIWLGTFETAEDAARAYDEAARLMCGPKARTNFPYNPNEPLSSSSKLLSATLTAKLHKCHMASLSLQMSKQKQSQTEPHQGSSSDSGNAIAGTSSDNTGFRWPEEEAQVEVPPAQQQQFQPVLQDDHIEQMIQELLDYGSMELSFVDSA

SEQ ID NO: 2354 - protein, 436 aa, Glycine max
  unsure (1)..(436): unsure at all Xaa locations
SSTSVSEAADVSMEDRDVSSHSLLPPSPFSRTLNNSNLPLPPRKAHRRSNSDIPFGFSTVLQSSPPLIPLRNPVSAKPAQLVKRETPWDRGVENNNNNNVEGSGEKKSPEGEVVDDLFSAYMNLDSFDALNSSGTDDKNGGENRDDLDSRASGTKTNGGDSSDNEAESSVNESGDGGVRQGGNEKREGMKRSAGGEIAPTTRHFRSVSMDSFIGNFFFDEESPKLPPSPGQRSALMSPAGGIDGNSAAFSLEFGNGDFSGPELKKIMANEKLAEIALIDPKRAKKILANRQSAARSKERKMRYISELEHKVQTXLQTEATTLSAQLTLLQRDSAGLPNQNSELKFRLQSMEQQAKLRDALNEALTAEVQRLKLATAELSGDSHGSGCLIPQHSVNPLMFQQQQQPPTASQQNIHLQQQQQQQHQNGNANSNSDLKQ

SEQ ID NO: 2355 - protein, 401 aa, Glycine max
  unsure (1)..(401): unsure at all Xaa locations
MALLVMVKKKRGGGRKGLEEEEEDGFVPVLNLKVFSYKELQLATRGFSEKVGHGGFGTVFQGELSDASVVAVKRLERPGGGEKEFRAEVSTIGNIQHVNLVRLRGFCSENSHRLLVYEYMQNGALNVYLRKEGPCLSWDVRFRVAVGTAKGIAYLHEECRCCIIHCDIKPENILLDGDFTAKVSDFGLAKLIGRDFSRVLVTMRGTWGYVAPEWISGVAITTKADVYSYGMTLLELIGGRRNVEAPLSAGGGGGGEKSGDEXEREVGSSRPWAAQRIIEGNVSDVMDKRLGNAYNIEEARRVALVAVWCIQDDEAMRPTMGMVVKMLEGLVEVSVPPPPKLLQALVTGDSFHGVKADSGNGASSTGGSLSDGDLEVSTADSESYTGNVFSPLDVNVNVSVR

SEQ ID NO: 2356 - protein, 407 aa, Glycine max
  unsure (1)..(407): unsure at all Xaa locations
MEHSLKRKSPESGDNLLFNRFSLDDLNEDLLERVLSWLPTSSFFRLTSVCKRWKSAAASVSFKLACSPVPLRDPWFLMVAPNLNQSIVFDTAENSWKRLNHPHLPLKDSNISCMPVAASGGLVCYRKLLGNFVVCNPVTGSCSELPPLHFALENQSLNAVVMSTTFNDQMSYKIVLVFGELPNLLFKVYNSGSSCWEDEAALRRNVDDNSMDCDSTDDDNVVYFLSKAGTVVVSSMQRSPSKQYSSVITNKDGQEIVYFLSSSGTVVACNLTSRCFLEYPRLLPVFSEYSIDIVECGGEMVVVLLSEFLESTSLRVWKYDXANRCWQQIAAMPAAMSQEWYGKKADINCVGASGRIFICLNSPELCTYVLCDLVTNKWTELPKCCLNGEVMEFMSAFSFEPRIEASV

SEQ ID NO: 2357 - protein, 86 aa, Glycine max
ANRCWKQIAAMPAAMSQEWYGKKADINCVGAGDRIFICLNSPELCAYVLCDLVTNKWTELPKCCLNGELMEFMSAFSFEPRIEASV

SEQ ID NO: 2358 - protein, 251 aa, Glycine max
GSRCGFPRESILILTDDMEERNPQKFPTKYNILKAMRWLIEGSQSGDSLVFQFSGHGCQELDTNGDFDELDERDEAICPVDWEKQGIILDDDINAAIVRPLPYGAKLHAIIDSCNSGTVLDLAYVWSQRDTWDYQYGGPDKDTSGGLAICISGCGDYQSSKEIPVLSGGGGGNAVTGVFTYSFIYTMLNEPAGLSYGGLLSSMRSTIRGMLNNPNASLFNTDFTLAPRQDLQKPQLSSSMEFDVYTARVEL

SEQ ID NO: 2359 - protein, 167 aa, Glycine max
LEKLWNWNPLLLPPRFSSLKHAFPSTTTRLVAHNSVSETVPIHKEKEQTLPSVKPTYSPTPPNRGLRTPHSGYHFDGTTRKFFEGWYFKVSIPERKQSFCFMYTVESPLFRKPLTQLELAQYGPRFTGVGAQILGADDKYVCQHSPQSHFFWGSRHELMLGNTFEPN

SEQ ID NO: 2360 - protein, 209 aa, Glycine max
  unsure (1)..(209): unsure at all Xaa locations
MATTQGQVITCKAAVAWEPNKPLSIEDVQVAPPQNGEVRIQILYTALCHTDAYTWSGKDPEGLFPCILGHEAAGIVESVGEGVTAVQPGDHVIPCYQAECGECKFCKSGKTNLCGKVRAATGVGVMLSDRKSRFSVNGKPLYHFMGTSTFSQYTXVVHGGRVAKIDPQAPLDKVCLLGCGGSTGXLGAVWNTTKGEPRSXVAFFGLGTV

SEQ ID NO: 2361 - protein, 141 aa, Glycine max
  unsure (1)..(141): unsure at all Xaa locations
MDQLPVEVIGNILSHLRAARDVVIASATCRKWRLACCKHLHTLSFSSKDWPIYRDLTTTRLEILITQTIFQTSGLQSLSILMEDVDEFSASTGTAWLLYTRETLRQLHYNVKTTPMVNILGICGRHKLEXLALAHISFVGG

SEQ ID NO: 2362 - protein, 152 aa, Glycine max
MGRGKIEIKKIENLNSRQVTFSKRRNGLLKKAKELSVLCDAEVAVIIFSSTGKLYEFSNTSMEHTLSRYSKGAESDSAEQPIDVPPTDVMAVEPDTNLLMEEITKLRSAYLRMMGKELDGLSLKELQQLENQLSEGMQSVKDKKEQVLVEQL

SEQ ID NO: 2363 - protein, 316 aa, Glycine max
MGSQGGGDNNGKHSQLQPLVRQNSMYSLTLDEVQNHLGDLGKPLSSMNLDELLKNVWTVEANQSTGVDIEGTAQTRQAALQRQASLSLTSALSGKTVDEVWRDIQQSKDNKDKKSQERQSTLGEMTLEDFLVNAGVVAEASTRKNTGATIGVDSNVVAPQFPQHGPWIQYPQPQYQHPQQGLMGIYIAGQNIAQPLHMGAGAASDVPYADGQVALSSPVMGTLSDTRRPGRNGGTPEDMIEKTVERRQKRMIKNRESAARSRARKQAYTTELEHKVSRLEEENEKLRRQQELEKMLSSAPPPEPRYQIRRTSSASF

SEQ ID NO: 2364 - protein, 323 aa, Glycine max
MKRQMLHDLIENAGGCAVTDGGFATQLEKHGASINDPLWSAIYLIKDPHLIKQVHLEYLEAGADILVTSSYQATLPGFSSKGLSIEEGESLLEKSVKLAVEARDGFWNSAIINPGNKYRRALVAASIGSYGSYLADGSEYSGCYGPDVNLKKLKDFHRRRLQVLVEAGPDLLAFETIPNKLEAQACVELLEEESVKIPSWICFTTVDGENAPSGESFKDCLEALNKSNKVDAVGINCAPPHLMENLICKFKQLTKKAIIVYPNSGEVWDGKAKKWLPSKCFHDDEFGFNATRWRDLGAKIIGGCCRTTPSTIQIISNALREKS

SEQ ID NO: 2365 - protein, 333 aa, Glycine max
MDTCNVFEGSWVRDDSYPLYDASHCPFVERGFNCLANGRKDRDYTKWRWKPKNCEIPRFDARGILEQLRGKRVVFVGDSLSRTQWESMICLLMTGVEDKKSIYEIKGNKITKQIRFLGVRFSTFDVRIDFYRSVFLVRPGSVPRHAPQRVKTTLRLDKIDDISHEWIDSDVLIFNSGHWWTRTKLFDVGWYFQVDNSLKLGMTINSGFNTALLTWASWVESTINTNRTRVFFRTFESSHWSGQNHNSCKVTKRPWKRTNRKERNPISNMINKVVKSMSAPVTVMHVTPMTAYRSDGHVGTWSDQPSVPDCSHWCLPGVPDMWNEILLSYLLPK

SEQ ID NO: 2366 - protein, 492 aa, Glycine max
  unsure (1)..(492): unsure at all Xaa locations
MALLVEKTSSGREYKVKDMTQADFGRLEIELAEVEMPGLMSSRTEFGPSQPFKGARITGSLHMTIPNRXVFIETLTALGAEVRWCSCNIFSTQDHAXAAAIARDSASVFAWKGETLQEYWXWCTERALDWGPGGGPDLIVXDDGGDTTLLIHEGVKAEEIFEKTGQFPDPASSDNAEFQIVLSIIRDGLKTDPKRYHKMKDRIVGVSEETTTGVKRLYQMQANGSLLFPAINVNDSVTKSKFDNLYGCRHSLPDGLMRATDVMIAGKVAVVCGYGDVGKGCASAMKQAGARVIVTEIDPICALQALMEGLQVLTLEDVVSEADIFVTTTGNKDIIMLDHMKKMKNNAIVCNIGHFDNEIDMLGLETCPGVKRINIKPQTDRWVFPDTKRGIIVLAEGRLMNLXGCATGHPXSFVMSCSFTNQVIAQLELRKEKGSGKYEKKVYVLPKHLDEKVASLHLGQLGARLTKXLSKDQADYISVPVEGPYKPAHYRY

SEQ ID NO: 2367 - protein, 573 aa, Glycine max
MKTFQLSGKLCCSWFLLGLLALIGSLASATEIHFHEFVIQAKPVRRLCKTQNIITVNGQFPGPTVEARNGDFVVIKVVNAAQYNISIHWHGLRMLRNPWADGPSYVTQCPIQPGGSYTYRFRIRDQEGTLWWHAHTGFLRATVYGAFIIYPRLGSPYPFSMPKQEVPLLLGEWFDTDLVLLQRQADFAGLPPNTSVAYTINGQPGDLYRCSSQETVRVPVDAGETIMLRIISSTLNQELFFSIGNHTMTVVGTDAAYTKPFKTTVLMIGPGQTFNVIVTADQPPGFYYMAAHAYESAVNAPFDNTTTTAILEYRSTRRRNQNRSRPVLPALPAFNDTPTATAFTARIRGLTRVRVFKKVDVNLYFIVGLGLINCTNPNSPRCQGPNGTRFTASMNNVSFVLPSTTSLMQAYYEGIPGVFTTDFPPVPPLQFDYTGNVPPGLWTPSRGTKLEKVKYGSKVQIVLQDTSIVTTEEHPMHVHGFHFFVVGSGFGNFNPATDPLKFNLVDPPVRNTIGTPPGGWVAIRFVADNPGIWFVHCHIDSHLNWGLGMALLVENGVGLSQSVLPPPPDLPQC

SEQ ID NO: 2368 - protein, 84 aa, Glycine max
MKVKILQWHAIASWTWDAQDETCGICRMAFDGCCPDCKLPGDDCPLIWGVCNHAFHLHCILKWVHSQTSQAHCPMCRREWQFKG

SEQ ID NO: 2369 - protein, 242 aa, Glycine max
MSEMVSALAQVMGTTNRNPYMPQSTSFPFSTSVVKDQPQPYPSQPPPDQEVAKKPHYRGVRQRPWGKWAAEIRDPKKAARVWLGTFETAEDAALAYDKAALKFKGTKAKLNFPERVHQDVPFMQQHQQRSSNRNVFPIHATSTTSSATGSGSSVDAVAPPSLSTHDQHGHQVFPNLYQYAQILSSDDAQLPYFTSHLFNQQQQQQQQQPFNSQFSSTFSSTSSYFYNQQQQYDQQGHDHSNH

SEQ ID NO: 2370 - protein, 271 aa, Glycine max
MEYQQQKQQWKRSQRTKPSSSSSSHINNLDDGCLMHIFNFLPPIPDRFNTALVCHRWNYLACHPRLWLRVDRSVKELSEPGVFPNIETAVSASRPGDTILIAAGGTHRVANIQIRKPLCLIGAGEVTTKPSPDDTTLVCSRGSDSALEFLSTCKLANLTVRAELGCCLLHRKGRLTIDGCILQCESNPLDYLSCPIVSTASSSVVLPSQTKSNNGDGVFVSQTRIEGGAKAVLTSGDLALQRVRVIYARTSLLFWFDVEQMCDQIDYDKPL

SEQ ID NO: 2371 - protein, 161 aa, Glycine max
MGFPVGYSELLFPKLLLHILSLLGLLRKLICSLLRFMGLHDFLEPDIAWAETQTRVPEEFESVSATLIREILPVVKFRELVDPPETCAVCLSEFEENDEIRRLANCRHIFHRGCLDRWMGYDQRTCPLCRTAFIPDEMQGAFIERLWAASGIAEYPHVAPF

SEQ ID NO: 2372 - protein, 301 aa, Glycine max
MPDQDIFSCISEPRLVARKFLARPQHEGVGAVVRRSIGRFELKYFDPFLVLDEFSVTAPAGFPDHPHRGFETVTYMLQGAVTHEDFEGHKGTIEAGDLQWMTAGRGLVHSEMPAAQGTQKGLQLWINLASKHKMIEPRYQEMLSKDIAETMIDGIKVRVIAGEALGIKSPIYTRTPTMYLDFTLKPGAHLQQLIPKSWNAFVYILEGEGVFGNQKSQPVTSHHILLLGPGDGLEAWNKSSKVLRFILVGGEPLGEPVVQFGPFVMNTQEEIDQTIDDFENYTNGFEKARHWRSESAISLDY

SEQ ID NO: 2373 - protein, 760 aa, Glycine max; identical to SEQ ID NO: 1723

SEQ ID NO: 2374 - protein, 244 aa, Glycine max
MGRGRVQLKQIENKISRQVTFSKRRTGLRKKANEISVLCDAQVALIVFNAKGKLFEYSSESSMENVLERYERHTHIGKLVGDGDESQGNWSLQCFKLTGKVEVLERNLRNFVGEDLDPLNLRELQSLEHQLETAIKRIRTRKNQVMNESISDLQKKARQLQEQNGILTKKIKEKGKEVVERPHCGPETLGLTCPPELQRQQRVFPSLTLCETLQAGHLEEVVEARTVPTASTHIPPWMLHPFTR

SEQ ID NO: 2375 - protein, 226 aa, Glycine max
MLEGGAIMEDSAAQKRKQREFALASVSEVSSAPSSASPGVSLFAGDRLQILNESRHVALNAYLSDIQLFRLGPIESVCMVEESEADKQTSYSSGVAIQFRNEEESEAFHCVFQQWKKGFDVQGGNLPNGTDVITSKSKFDEKIEPSSAKMYFHYYGQLLHQQNMLQDYVRTGTYYAAVLENRADFVSRVVIDVGAGSGILSLFAAQAGAKHVYAVEASEMAEYARK

SEQ ID NO: 2376 - protein, 125 aa, Glycine max
QTGGNLPNGTNAITSKSKFDEKIESSSAKMYFHYYGQLLHQQNMLQDYVRTGTYYAAVLENRADFVGRVVIDVGAGSGILSLFAAQAGAQHVYAVEASEMAEYARKLIAGNPILGQRITVIKGKS

SEQ ID NO: 2377 - protein, 213 aa, Glycine max
MASKLLLSLSLLLLTLTLHTSCTTALAKRTNPNPTITTTTDFIKSSCKATRYPAACVQTLSGHASAIRQSEQQLAVTALSVSVSKTRSCASFVKRMGSVKGMKPREYNALRDCVENMNDSVDRLSQSVKELGLVMGKGKGKKDFTWHVSNVQTWVSAAITDQDTCLDGFDGPHVDANLRASVRPRVVDASQVTSNALALVNRFASKYRSASQT

SEQ ID NO: 2378 - protein, 249 aa, Glycine max
MACLSRYHHHHHPRGATWLSSPDEMLQHCPLSAHHRRLRDDDAEPIYLPSLSSAYRIFPVYAMGAPDPTPEPELDGPDPIWNAVRDEAKLEAEKEPILSSFLYASILAHDCLEQALAFVAANRLQNPTLLATQLMDIFCNVILHDKAIQRSIRLDVQAFKDRDPACLSYCSALLYMKGYHALQVHRVAHTLWHQGRKVLALALQSRVSDVFGVDIHPAAPVAAGLAFVHATGGGTGVTAMGESGFRKAN

SEQ ID NO: 2379 - protein, 409 aa, Glycine max
MNAIATAAVLSLPFSFSKSSKLDTKKGLKGRFRVFAVYGEEIDKKNAWSALFDVEDPRSKVPQYKGKFLDVYQALEVARYDIQYCDWRARQDLLTIMLLHEKVVEVLNPLARDYKSIGTMKKELAELQEELAQAHQQVHISEARVSSALDKLAYMEELVNDKLLQERSTTEVSQTSSSPSTSFKPVDIEKRRSPRKSLDISGPVQSYHPHLKNFWYPVAFSTDLKDDTMIPIECFEEPWVIFRGKDGKPGCVQNTCAHRACPLHLGSVNEGRIQCPYHGWEYTTDGKCEKMPSTRLLNVKIKSLPCFETEGMIWVWPGNDPPTATLPSLLPPSGFEVHAEIVMELPIEHGLLLDNLLDLAHAPFTHTSTFAKGWSVPRFCVFFNTQRTESHLCCTLETENHAILKRFKK

SEQ ID NO: 2380 - protein, 230 aa, Glycine max
MTSGFGESTRASAPSPSCSGNSSNDAGDFECNICFDLAQDPVITLCGHLFCWPCLYRWLHHHSHSQECPVCKALVQEEKLVPLYGRGKTQTDPRTKSYPGMEIPHRPSGQRPQTAPPPPPPEANPFGSYGFGLMGGFIPMATARFGNFTLSTAFGGFIPSLLNIHFHGFQDATVYGTTSGYPFGFNGFHGGNTRGFTQATGQVQRQEDNVLKNLLMLIGFLVLLTVIFVW

SEQ ID NO: 2381 - protein, 589 aa, Glycine max
MEPAKTIHNNVKYSPIFLAIFVLILASALSSANAKIHEHEFVVEATPVKRLCKTHNSITVNGQYPGPTLEINNGDTLVVKVTNKARYNVTIHWHGVRQMRTGWADGPEFVTQCPIRPGGSYTYRFTVQGQEGTLWWHAHSSWLRATVYGALIIRPREGEPYPFPKPKHETPILLGEWWDANPIDVVRQATRTGGAPNVSDAYTINGQPGDLYKCSSKDTTIVPIHAGETNLLRVINAALNQPLFFTVANHKLTVVGADASYLKPFTTKVLILGPGQTTDVLITGDQPPSRYYMAARAYQSAQNAAFDNTTTTAILEYKSPNHHNKHSHHRAKGVKNKTKPIMPPLPAYNDTNAVTSFSKSFRSPRKVEVPTEIDQSLFFTVGLGIKKCPKNFGPKRCQGPINGTRFTASMNNVSFVLPNNVSILQAHHLGIPGVFTTDFPGKPPVKFDYTGNVSRSLWQPVPGTKAHKLEFGSRVQIVLQDTSIVTPENHPIHLHGYDFYIVAEGFGNFDPKKDTAKFNLVDPPLRNTVAVPVNGWAVIRFVADNPGAWLLHCHLDVHIGWGLATVLLVENGVGKLQSIEPPPVDLPLC

SEQ ID NO: 2382 - protein, 358 aa, Glycine max
MSTKFGRLVPLVFSKRGFSTSTSIQKGGGGSEEGLKSLNLCSAINQALHIALDSDPRSYVFGEDVSFGGVFRCTTGLADQFGKKRVFNTPLCEQGIVGFGIGLAAMGNRAIAEIQFADYIFPAFDQIVNEAAKFRYRSGNQFNCGGLTVRAPYGAVGHGGHYHSQSPEAFFCHVPGIKVVIPRSPREAKGLLLSCIRDPNPVVFFEPKWLYRLAVEEVPEDDYMLPLSEAEVIRQGSDVTLVGWGAQLAIMEQACLDAEKEGISCELIDLKTLIPWDKETVESSVNKTGRLLVSHEAPITGGFGAEISASIVERCFSRLEAPVARICGLDTPFPLVFEPFYMPTKNKILDAIKSTVKY

SEQ ID NO: 2383 - protein, 126 aa, Glycine max
  unsure (1)..(126): unsure at all Xaa locations
MDLELPAHAATVNESQQQKFALPVDSENKATVFRLFSFAKPHMRAFHLSWVSFFACFVSSFAAPPLLPIIRDNLNLTATDIGNAGVASVSGAVFARIAMGTACDLVGPRLASASLIXLTAPFVYFT

SEQ ID NO: 2384 - protein, 376 aa, Glycine max
MGAEPLSKNEVALAQTQAPFVLGLQPSALVDHVARVDWSLLDQIPGEHGGSIPVELGELEHILREVKIHIVSCHDNDDDDYPSSHIKTLAGGSVANTIRGLSNGFGISSGIIGACGDDEQGKLFDHNMSSNGVDLSRLRKKKGHTAQCVCLVDDLGNRTMRPCLSNAVKVQAEELAKEDFKGSKWLVLRYAILNLEVIQAAILLAKQEGLLVSLDLASFEMVRNFKQPLLKLLESGNIDLCFANEDEATELLRGEQNADPATAVEFLAKYCQWAVVTLGPNGCIAKHGNEIARVPAICEAKAIDATGAGDLFASGFLYGVIKGLSLEECCKVGACSGGSVIRSLGGQVTLENRHWMYKQMQIKDLPTPDTIQITNE

SEQ ID NO: 2385 - protein, 400 aa, Glycine max
MQAAATTPLYQLVSFKPKLQTFPSKSQLCPLGTPFCRLGMASVSGFRLRPLRAVGGSSSSSASGDDGFVTLIEYVAKEGMNVKDDLVVLLDHIQYACKKIAALVASPFNYSLGKQTALGSVGSDRDAPKPLDIVSNEIILSSLRKSGRVAVMASEENDAPTWISDDGPYVVVTDPLDGSRNIDASIPTGTIFGIYKRLEELDDLPTEDKAMLNSLQSGSRLIAAAYVLYSSATILCITFGSGTQAFTLDHSTGDFILTNPSIKIPPRGQIYSVNDARYFDWPEGLRQYIDTVRQGKGRYPKKYSARYICSLVADLHRTLLYGGVAMNPRDHLRLVYEANPLSFIVEQAGGRGSDGKNRILSLQPVKLHQRLPLFLGSLEDMEELESYGDIQQKVNPGYEV

SEQ ID NO: 2386 - protein, 338 aa, Glycine max
AVAWRAGEALVMEEVEVSPPQPMEIRIKVVSTSLCRSDLSAWESHAIFPRIFGHEASGIVESVGQGVTEFKEGDHVLTVFIGECMSCRQCTSGKSNTCQILGLERRGLMHSDQKTRFSLKGKPVYHYCAVSSFSEYTVVHSGCAVKVSPLAPLEKICLLSCGVAAGLGAAWNVADVSKGSTVVIFGLGTVGLSVAQASKLRGASRIIGVDNNPQKCENAKAFGVTEVVDPNSYKEPIAQVIKRITDGGADFSFECVGDTDTITTALQSCCDGWGLTVTLGVPKVKPEMSAHYGLLLMGRTLKGSLFGGWKPKSDLPSLVEKYLNKEGECLRCVIHMPR

SEQ ID NO: 2387 - protein, 412 aa, Glycine max
LRVLTDSTYHNHRNHQLPFRVLFHSFLFHFAILLSLINMSSPQVITCKAAVAWRAGEALVMEEVEVSPPQPMEIRIKVVSTSLCRSDLSAWESHAIFPRIFGHEASGIVESVGQGVTEFKEGDHVLTVFIGECMSCRQCTSGKSNTCQILGLERRGLMHSDQKTRFSLKGKPVYHYCAVSSFSEYTVVHSGCAVKVSPLAPLEKICLLSCGVAAGLGAAWNVADVSKGSTVVIFGLGTVGLSVAQASKLRGASRIIGVDNNPQKCENAKAFGVTEVVDPNSYKEPIAQVIKRITDGGADFSFECVGDTDMITTALQSCCDGWGLTVTLGVPKVKPEMSAHYGLLLMGRTLKGSLFGGWKPKSDLPSLVEKYLNKEIQIDDYITHNLSFDDINKAFNLMKEGECLRCVIHMPR

SEQ ID NO: 2388 - protein, 216 aa, Glycine max
  unsure (1)..(216): unsure at all Xaa locations
MSFTGTTDKCKACDKTVYVVDMLTLEGIPYHKNCFRCSHCKGYLTMNTYSSMDGVLYCKPHFEQLFKESGNFSKNFQTAKSSDKQNETNKAPNRLSSMFSGTLDKCSVCXKTVYPLEKMTLEGECYHKNCFRCAHAGCHLTHSSYAALDGVLYCRHHFQQLFMEKGNYHHVLQSANHKKNVTPEPAEPAAEGDEEPPKPEESDSEEHTEEKPQNEA

SEQ ID NO: 2389 - protein, 243 aa, Glycine max
MGRGRVQLKRIENKINRQVTFSKRRGGLLKKAHEISVLCDAEVALIIFSHKGKLFEYATDSCMEKILERHERYAYAERQLVANDSETQENWTIEYTRLKAKIDLLQRNHRHYMGEDLASMSLKELQSLEQQLVTGIKNIRTRRNDLMSESISELQKKEKRIQEENNTLAKKIKEKEQAVAQQAAQWEQPNYRVDTSFMPQQQPLPTSLNICGNNYCQEAAPELGRNGLDLTLEPLYSCNLGCF

SEQ ID NO: 2390 - protein, 389 aa, Glycine max
MHSQNVVEMEGKTEIRMTSAAAFVEGGIQESCDDACSICLEEFCASDPSTVTTCKHEFHLQCILEWCQRSSQCPICWQPISLKDPTSQELFEAVEQERSWRATPSRNAAIFHHPAFGDFELQHLRMNANDADFEERIIQHLAAAATMRRVNQLGRREGQQTRSSPHVHPHFLVFSNQPIAPSSGLDPVSRGENDPTAIPNRSPSAPITSDGNEASQQILHLQTQSSSSASGSPVMATNRQGIYSNDRGSTARSSPVVQDRAESSELQSFSDSLRSRLNAVSMRYKESISKGTRGWKERLFSHSSSMSELGSETRRREMKAGIASVSRLMESLETSENNRAVGTSLSNQNHIEDSSMGGVSNQNNVEASGEKSSHDDNTPAACSASSHLN

SEQ ID NO: 2391 - protein, 721 aa, Glycine max
  unsure (1)..(721): unsure at all Xaa locations
MSLSAFSFPLHLRQTTPPSDPKTSSTPLPLSSHSHWGADLLTQSQRKLNQVKRRPHGVCASLSEMGEYYSQKPPTPLLDTINYPIHMKNLATKKLKQLADELRSDVIFHVSRTGGHLGSSLGVVELTIALHYVFNAPKDKILWDVGHQSYPHKILTGRRDKMHTMRQTDGLAGFTKRSESDYDCFGTGHSSTTISAGLGMAVGRDLKGDKNNVVAVIGDGAMTAGQAYEAMNNAGYLDSDMIVILNDNKQVSLPTANLDGPIPPVGALSSALSKLQSNRPLRELREVAKGVTKQIGGPMHELAAKVDEYARGMISGSGSTLFEELGLYYIGPVDGHNIDDLVSILNEVKXTETTGPCVIHVVTEKGHGYPYAERAAAKYHVVSKFDPATGEQFKAKATTKSYSTYFAEALIAEAEADKDIIGIHAAMGGGTGMNHFLRRFPTRCFDVGIAEQHAVTFAAGLACEGFKPFCAINSSFMQRAYDQVVHDVDLQKLPVRFAMDRAGLVGADGPTHCGAFDVTFMACLPNMVVMAPSDEAELFHMVATAAAIDDRPSCFRYPRGNGIGVELPLGNKGIPLEIGKGRILIEGERVALLGYGSAVQSCLAAASLLEHHGLRATVADARFCKPLDRSLIRSLAQSHEVLITVEEGSIGGFGSHVVQFMALDGLLDGKLKWRPIVLPDCYIDHGSPVDQLSAAGLTPSHIAATVFNLLGQTREALEVMT

SEQ ID NO: 2392 - protein, 350 aa, Glycine max
  unsure (1)..(350): unsure at all Xaa locations
MSSTVGQTIKCKAAIAWEAGKPLVIEEVEVAPPQAGEVRLKILYTSLCHTDVYFWDAKGQTPLFPRIFGHEASGIVESVGEGVTHLKPGDHALPVFTGECGDCAHCKSEEKNWXEIVRQLASAGIKVLLTARNEKKGLQALETLKDSGLSHLVLFHQVDVADATNVASLADFVKSKFGKLDILINNAGIGGVVIDDTDLITTAIMNRGAIPEDNGTKGITHTYELAEECLQINYYGAKKTTESLMPLLQLSDSLXVFDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 2393 - protein, 157 aa, Glycine max
  unsure (1)..(157): unsure at all Xaa locations
MVRGKTQMKRIENETSRQVTFSKRRNGLLKKAFELSVLCDAEVALIIFSTRGRLYEFSSSRCSSINKTVERYQRKIEDLGVSNKGIHENTQHLKEVDMSMAKKIEHLEDSRRKLLGDELDKCSIDELQQLENQLERSLDKIRATXNQLFRKRIEKLK

SEQ ID NO: 2394 - protein, 587 aa, Glycine max
MESVKFINMNAKHSSIFLLAMIFVLILASANAKIHEHEFVVEATPVKRLCKTHNSITVNGQYPGPTLEINNGDTLVVKVTNKARYNVTIHWHGVRQMRTGWADGPEFVTQCPIRPGGSYTYRFTVQGQEGTLWWHAHSSWLRATVYGALIIRPREGEPYPFPKPKHETPILLGEWWDANPIDVVRQATRTGGAPNVSDAYTINGQPGDLYKCSSKDTTIVPIHSGETNLLRVINAALNQPLFFTVANHKLTVVGADASYLKPFTTKVLMLGPGQTTDVLITGDQPPSPYYMAARAYQSAQNAAFDNTTTTAILEYKSPHHSNHSHHHSKGALKKKTKPIMPSLPAYNDTNTVTAFSKSFRSPRKVEVPAEIDQSLFFTVGLGINKCPKNFGPKRCQGPINGTRFTASMNNVSFVLPNNVSILQAHHLGIPGVFTTDFPGKPPVKFDYTGNVSRSLWQPVPGTKAHKLKFGSRVQIVLQDTSIVTPENHPIHLHGYDFYIVAEGFGNFDAKKDTAKFNLVDPPLRNTVAVPVNGWAVIRFVADNPGAWLLHCHLDVHIGWGLATVLLVENGVGKLQSIEPPPLDLPLC

SEQ ID NO: 2395 - protein, 577 aa, Glycine max
MVELRLSIRALQLPTLLILCFFLILGNFHKAEARIRHHKWEVKYEFRSPDCFKKLVITINGKTPGPTIQAQEGDTIVVQVNNSLVTENLSIHWHGIRQIGTPWFDGTEGVTQCPILPGDTFIYQFVVDRPGTYLYHAHYGMQREAGLYGMIRVAPRDPEPFAYDLDRSIILNDWYHKSTYEQAAGLSSIPFQWVGEPQSLLIHGKGRFNCSKSPSVSTDVCDTSNPQCSPFVQTVIPGKTYRLRIASLTALSALSFEIEGHNMTVVEADGHYVEPFEVKNLFIYSGETYSVLVKTDQDPSRNYWITSNVVSRNRTTPPGLGMFNYYPNHPKRSPPTVPPSPPAWDDVEPRLAQSLSIKARQGYILKPPTTSDRVIVLLNTQNNISEYRHWSVNNVSFTLPHTPYLISLKENITGAFDPTPPPDGYDFANYDIFSVASNANATSSSGIYRLKFNTTVDIILQNANTMNKNNSETHPWHLHGHDFWVLGYGKGKFDVNNDTKKYNLENPIMKNTVPVHPFGWTALRFRTDNPGVWAFHCHIESHFYMGMGVVFEEGIERVGKLPSSIMGCGQTRGFHRP

SEQ ID NO: 2396 - protein, 386 aa, Glycine max
  unsure (1)..(386): unsure at all Xaa locations
MELSTIKDAFDRVTKKQKLSCSKTQEAIDQIRQEIESVLDTLQSANNTDHELDYKTVLNELKASFLLIAPLSQMEGTQKELNVALTKYGKLLEKHFNPDISKAYRNIDIDRHTLNQIIANHFYRQGLFEIGDHFMSVVGELESAAIMKSPFLEMYQILEAMQNLNLEPALNWAATNGDKLAQSGSDXVWKLNSMQFVKILQKGSREEALHYARTHLSPFATSHMTDIQKLMGCLLWTGKLDRSPYHALLSASNWDKLAEELKRQFCNLLGQSYNSPLSVTVAAGVQVLPPLLKFMNVMAGKKHEWQSMNQLPVLVELDREFQFHSIFVCPVSKEQATEDNPPMLMSCGHVLCKQSILKMSKNSTKMFKCPYCPFDIDAAQCKQLYF

SEQ ID NO: 2397 - protein, 294 aa, Glycine max
  unsure (1)..(294): unsure at all Xaa locations
MEDNDYIRRWEDLDIDILVKIFQLLDIFELTSGISRVCSAWRLACCDPLLWKTLDLSMLRSNFIKIPLDTSVYRILRSDXHLSQQSIMTLIFHFNLYVSDEQLTYTAERCPQLRRLVLPAWNRIKKPGMCKAIRGWKELESLTMPSIANPPYILEEISTHCKNFSELKIMGPCDIFFASSLAAFLPKLRVLSLRCSMLYKDVLILILDSLQHLEVLNISHCVLMEALPAPQQKRIIKEIDVTIRQKASRLREFLTCMEDSCVMCQRTRTDEGLIRWYKYEEGLWKTDEVRSLSL

SEQ ID NO: 2398 - protein, 272 aa, Glycine max
MADAAKGTYRASRWSLNGMTALVTGGTRGIGHAIVEDLCGFGATVHTCSRNQAELDKCLTEWRSKGFLVSGSVCDVSSQPHREKFIQEVTSIFNGKLNIYVNNVGVNYRKPTIEYTAEVYSQIMAVNLDSAYHLCQLAYPLLKASGMGSIVFISSIAGVVSLGTGSVYAACKAATNQLTKYLACEWAKDNIRSNCVVPATTNTPLVEHLLRNKKYVEEMLSRTPLGRIAEPEEVSALVAYLCLPAASYITGQVVLVDGGLSVNGFQTSMRIT

SEQ ID NO: 2399 - protein, 195 aa, Glycine max
MGRSPCCDKVGLKKGPWTPEEDQKLLAYIEEHGHGSWRALPAKAGLQRCGKSCRLRWTNYLRPDIKRGKFSMQEEQTIIQLHALLGNRWSSIATHLPKRTDNEIKNYWNTHLKKRLDKMGIDPVTHKPKNDALLSTEGPSKIAANISHMAQWESARLEAEARLPRESNLRSSSHSSSSSLHHTPIGTSASSSSSL

SEQ ID NO: 2400 - protein, 278 aa, Glycine max
  unsure (1)..(278): unsure at all Xaa locations
MKENYSYQSYPDSGESSPRSREIDFESPPPWDHQNYKAKFICSYGGKIHPRSHDNQLSYVGGDTKILAVDRSIKFPAMLAKLSALCDAQDNNITFKYQLPGEDLDALISVTNDDDLDHMMHEYDHLYRASARPSRMRLFLFPSDTPPSPPPASAPPDTVIKPNNVDFLFALEKNVAVXAPPPPQPPPVSVKFNDPLPEPVAPQPEYRSRLNFNPAVSDPSAIQRQLHQLQIAENEKASYWRKNEDNYPAGDYYVQKMPEKFPPANFPASAPGYWPEKH

SEQ ID NO: 2401 - protein, 257 aa, Glycine max
IWIAAVLFKSNDILRKQTALKGERKMLVLVGIPVGFALHVVGVYWWYQNDDLMYPLIMLPPKDIPPFWHAIFIIMVNDTLVRQAAMVFKCILLMYYKNSRGRNYRKQGQMLTLVEYLLLLYRALLPTPVWYRFFLNKEYGSLFSSLMTGLYLTFKLTSVVEKVQSFFAAVKALSRKEMHYGAYATSEQVNAAGDLCAICQEKMHAPILLRCKHIFCEDCVSEWFERERTCPLCRALVKPADLRSFGDGSTSLFFQLF

SEQ ID NO: 2402 - protein, 236 aa, Glycine max
MDKDKSLGLPPPSGRYSGYSSTGSVFNVKSEPSPSSSTTLYPPLAPGTTSSESSHFGHGLSTDSSGFSHDISRMPDNPPRNRGHRRAHSEILTLPDDISFDSDLGVVGGGDGPSFSDDAEEDLLSMYLDMDKFNSSSATSTFQMVEPSNAVGASASTPASGAPTSSTENVVIGTNERPRVRHQHSQSMDGSTTIKPEMLVSGSEDMSAADSKKAMSAAKLAELALIDPKRAKRFAL

SEQ ID NO: 2403 - protein, 134 aa, Glycine max
MGLSNFPSASEGVLPVLVINTVLSVAVLKNMFRSMLQVVLGGSAAANGSNIEHDESSSSSWERRVSITQYKSLCHSHDIGGTSMAMVECCVCLCRFEANQEVSELPCKHYFHRGCLDKWFDNKHTTCPLCRSID

SEQ ID NO: 2404 - protein, 575 aa, Glycine max
  unsure (1)..(575): unsure at all Xaa locations
MLCLGFDMVEVDSERLKLESRGVGIWLRIACGWLVFMLFFSPVAGLRPLRDRTNSWGDEWVFTRKDESDLGPFSQWNISGTYRGNWKFLDTTNGSTXFPDIRKINGNSVIELVSMPTKITGVHYVQGVVIFHDVFDNEYNVGGAQIRVEGVYIWPYRQLRMVANSGKEVGLNQDGDYILSNPYHLLGVFSSQVFQESSQHKMWRRKHSPLHGMEKHCNVEIAAHVSRLSSSKHEGEHDSFQLEGLMESPSVDDDGDCFSPLQLNATSINIEVYYNKALNYTLMVTFISFLQVLLLIRQMEHSNTQSGAAKVSILMIGQQAIVDAYLCLTHLTAGILVESLFNAFATAAFFKFVVFSIFEMRYLLAIWKASRPLSNGEGWETMRRELSVLYSRFYGILLGGILLMYEFHNHLRPILLLVYSFWIPQIITNVIRDSRKPLHPHYILGITVTRLAIPLYIFGCPNNFLHIEPDQSWCVCLAIFVGLQAAILLLQHYFGSLWFIPRQFLPEKYCYYRRFAQDTNHATDCVICMTAIDLSPRSNDCMVTPCDHFFHSGCLQRWMDIKMECPTCRGPLPPA

SEQ ID NO: 2405 - protein, 167 aa, Glycine max
MEVQIPNHTVFDMPSLLQAVVADTVLAAAQSIALIGYLLTNGTSSVSPNLTEVDGRFPLEDLFGRKHAYLQNKNSETEDEEDGDEDDEDGPDEDEDGDDEEFSGEEGDEGGDPEDEANGEGSDDGDEDDDGDDNGDEEDDDDGEDEEEDEEEDEEETPQPPPTKKRK

SEQ ID NO: 2406 - protein, 253 aa, Glycine max
MAANFWTSSHYKHLLDQEDVDVVNTLDKEKGITLEDFKLIKMHMANYILKLAQQVKVRQRVVATAVTYMRRVYTRKSMAEYDPRLVAPTCLYLASKAEESTVQARLLVFYIKKLYSDDKYRYEIKDILEMEMKILEALNYYLVVYHPYRSLSPLLQDAGLNDLNMTQLTWGLVNDTYKMDLILVHPPHLIALACIYIASVLREKDTTAWFEELRVDMNVVKNISMEILDFYESNRMFTDERINAALQKLSLRP

SEQ ID NO: 2407 - protein, 247 aa, Glycine max
MTATDIARTAVGIIGNIISGALFLSPAPTFVEICKKGSVEQYSAAPYLATLVNCMVWTLYGLPMVHPNSILVVTINGSGCIIELIFVTLFLIYSGGKKRLKVLLWLLLELIFISVLTFITLTKVHTFKKRSAIVGTTCILFNIMMYASPLAIMKLVIKTKSVEYMPFYISLASFGNGVAWTTYSLIRFDKFITIPNGLGTLFAVAQLILYATYYKSTQRQIAARNGNGGVNLSQVVVGRDDQSKPDN

SEQ ID NO: 2408 - protein, 438 aa, Glycine max
MVLGWRRRKGSNKNRRKGGKSIAELVTPNHFRCPISLDLMKDPVTLSTGITYDRESVEMWFDEGNITCPVTNQVVRNFDMIPNHSLRVMIQDWCVENRQHGVERIPTPRIPIGSIEVAELLMLVKASSTDLDQYGCLELVQKLKRWGGESERNKRCIVDNGAPVALASSFDAFANDSIERNVVLLEEILSALNWMFPLQLEAHKSLGSLASLRCMVWFLKHQDLSGKEKSIVALKELLKFGDVKHLEALSQIEGVNELLVEFINKRISPTITKASLSVVWYLVSSSSNSSDKMRLKFVELGLVSSLLDILIDSDKSMCEKAVTILDSLCSSEEGRNKACGNDLTIPLLVKKILRVSPLTTDYSVSAIWKLCKFGEKDEGRTLVEALQVGAFQKLLLVLQVGCGDETKEKATELLKLLNPYRAELECIDSDYKNVKRSF

SEQ ID NO: 2409 - protein, 138 aa, Glycine max
YYLCYSFPYNDQTPCGGINNKQSRFSRGGGLWNYFFSSPAYQRGSAIGEKHLLVRFAVDRGGLVGPDGSTHYGAPDVTFTACLPNMVVMVASDDAQIFHTVATAAAISDQPCCFRYQKGNGVGVEIPPGNKSIPLEVS

SEQ ID NO: 2410 - protein, 260 aa, Glycine max
MHPINTGDDSTLSSPIPQYGQISNSCLIETQDPSLQPLNQGGNGRKRHYRGVRQRPWGKWAAEIRDPKKAARVWLGTFDTAEAAAAAYDAAALKFKGSKAKLNFPEHVLLPPPPISSSSPPCNNNNNHHSYYYGSSALAPLAPPPQHVYDQTPPPQQQPLLSSSAQEEGFPNLMQYAQLLWSRDDDDLQRIASGLHQHHHHNEAFYDSSSSTLFSSTSTTYSMTVSDQQQNIGDDTSTPKGAEYNYGGCFFRGSDFHDKN

SEQ ID NO: 2411 - protein, 308 aa, Glycine max
  unsure (1)..(308): unsure at all Xaa locations
AFPIVCFYQTGFYGCEKTTEGLGLCGNKVDAIDHHNTEIDKLSKEIALERDNVSNDPKSIMPAAFVSFKTRXRAAVCAQTQQTRNPTMWLTEWAPEPRDIYWSNLAIPYVSLTVRGLIMAVAFFFLTFFFMIPIAIVQGLASIEGIRKRAPWLNPLIDIPFIKSFIQGFLPGIALKLFLIFLPTILMIMSKFEGFGSISSLERRSASRYYLFNFVNIFLGNILTGTAFQQLNSFIHQPADQYPVTIGTAIPLKASFFITYIMVDGWASIAAEVLMLKPLIVYHLKNFFLVKTEKDREEAMDPGSIGFN

SEQ ID NO: 2412 - protein, 485 aa, Glycine max
  unsure (1)..(485): unsure at all Xaa locations
MERCDKVMNQRNMHDCPKTGPGYPSPLAAMSGPKETLLYVTAIYSGTGRDKPDFLATVDVDPSSPTYSKVIHRLPVPYLGDELHHFGWNSCSSCYGDPSAVRRYLILPSLVSGRIYVVDTRSNPRSPSLHKVVEPEDIISKTGLAYAHTSHCLASGDVMISFLGDKDGNAAGSGFLLLDHEFNLKGRWEKPGHSPSFGYDFWYQPQHKTMISSSWGAPAASTKGFNLQHVSDGLYGRHLTCIQLAWGELRQTLDLGESGVLPLEVRFLHDPSKDTGFVGCALSSNMVRFFKTEDESWSHEVAISVKPLKVQNWILPEMPGLITDFLISLDDRFLYFVNWLHGDIRQYNIEDPKNPVRTGQVWVGGLLQKGSPIVAITEDGNTWHSDVPDILGNKLRAGPQMIQLSLDGKRVYVTNSLFSAWDKQFYPELVEKGSHMLQIDVDTENGGLKINPNFFVDFGAEPGGPXALAHEMRYPGGDCTSDIWI

SEQ ID NO: 2413 - protein, 427 aa, Glycine max
MKFQDYEPPSSPKHMIPKVTLLAILVILIFAITPLWYPLLSYSTSHLKINKNNIPSSSSHDQGQEENLPSTYVEKCDIFSGEWVPNPKAPYYTNKTCWAIHEHQNCIKYGRPDSEFMKWRWKPSECELPIFNPFQFLEIVKGKSMAFVGDSVGRNQMQSMICLLSRVEWPIDVSYTTDEYFKRWKYPSYNFTMATFWTPHLVRSKMADSHGPSNTGLFNLYLDEFDEKWSTQMVVLAYIVLDGGHWFYRPMVFYEKQKIVGCHYCLLENVPDLTMFYGYRKAFRTAFKAIDSLENFKGIVFLRTFAPSHFENGKWNQGGNCVRTKPFRSNETRLESTNLELYMIQLEEFKKAEKEGRKKGLKLKLLDTTQAMLLRPDGHPSRYGHWPQENVTLYNDCVHWCLPGPIDTWSDFLLEMLKMEGMRSAIS

SEQ ID NO: 2414 - protein, 346 aa, Glycine max
MMFDFARIWTRNTLIGLGLGQFLSLLITSTGFTSSELAKKGINAPTSQSFLNYVFLTLVYGTVLLYRRKALKAKWYYYIILGLVDVEANFLVVKAYQYTSLTSVMLLDCWSIPSVMLLTWLFLKTKYRFKKITGVVVCVAGLVLVVFSDVHSGDRAGGSNPRKGDLLVIAGATLYAISNVSEEFLVKSADRVELMAMLGLSGGIISAIQISILERNELKSIHWSAEAALPFVGFAVAMFMFYSLVPVLLKINGSTMLNLSLLTSDMWAVLIRIFAYHEKVDWMYFVSFGAVTIGLIIYSGGDRDDDQHPPNAAIDDHRPAVKQDEEANSGNHSKGAAAGSSKTWVA

SEQ ID NO: 2415 - protein, 324 aa, Glycine max
MKFCKKYQEYMQGQEKKLPCVGFKKLKKILKKCRRNSSSQKPLNASLAAKTCPDHCPVCDGTFFPSLLNEMSDIVGCFNQRAQKLLELHLASGVRKYFLWIKGKLQGNHTALIQEGKDLVTYALINAIAIRKILKKYDKIHYSKQGQLFKSQIQSMHKEILQSPWLCELMAFHINLRETKVKSRKAHALFDGCSLTFKDGKPALTCELFDSIKVDIDLTCSICLDTVFDPVSLTCGHIFCYICACSAASVSIVNGLKSADPKMKCPLCREGAVYEGAVHLEELNILLSRSCQEYWEQRIQTERVERVKQIKEHWDSQCRAFVGV

SEQ ID NO: 2416 - protein, 77 aa, Glycine max
ASVSIVNGLKSADPKMKCPLCREGAVYEGAVRLEELNILLSRSCQEYWEQRLQTERVERVKQIKEPWDSQCRAFVGV

SEQ ID NO: 2417 - protein, 240 aa, Glycine max
MGGVTSLLMLLCLFAGAMSPVKGEDPYFFFTWNVTYGTLSPAGVPQQVILINNEFPGPNINSTSNNNIVVNVFNNLDEPLLFHWAGVQQRKNSWEDGVAGTNCPIQPGTNYTYHFQVKDQIGSFFYYPSLGLQRAAGGFGGLRINSRLLIPVPYADPEDDYTVLAGDWFTKSHSTLRKLLDGGRSLGRPQAVLLNGQNAKGDGTDKPLFTMIPGMTYKYRICNVGLKNTINFRIQNHPMK

SEQ ID NO: 2418 - protein, 513 aa, Glycine max
MEGVDQRNSSAFGVPVPRPPNQKSRMPPSHPSINVSPSATPYSQYPQRLRSPGSSHSRSLSQPPIFSLDSLPPLSPSPAAVTSMFDSISTTDMSVEESNVSSQVPLNRGHALLPPRKGHRRSSSDSPLGISGFMQSSPVPSGGESSGFEKPIQLVLKASFRDSLDGGHANEPVNGRKEEAADDLFREYMNLDNFDNLNFPGMEDKDLDSRTSGSKTVESSDNEVESHVNGKASGAQGASSSCSEERREGVKRSSNGEVAPGSRHRRSFSLDSSIGNFNIEDGLPKLPPSKNQMGQHSPSNSMDGKMSETSTEFGNGEFSAEEVKKIMESDKLAEIASTDPKRAKRILANRQSAARSKERKMRYIAELEHKVQTLQTETTTLSTQFTKLQRDNSDLKSENNECKLRLQAMEQQSLLKDALNETLDAEVRRLRRAVAELGGESLTSCMARQLAINQQMFELQHQQPSQQRHFLLQNHHTQEEIESRSQQIQGNELHPQAQIQSQQIQRNELHPQP

SEQ ID NO: 2419 - protein, 266 aa, Glycine max
MAETKLSSFKDKRWSLHGMTALVTGGTRGIGYAIAEELAEFGAAVHICARKQQDIDKCLEEWNKKGLPITGSACDVLSRDQRENLMKNVASIFNGKLNILINNAGTTTPKNLIDYTAEDVTTIMETNFGSSYHLCQLAHPLLKASGYGSIVFISSIAGLKALPYSSVYASSKGAMNQFTKNIALEWAKDNIRANAVAPGTVKTVLLDSIMKAAAEADKAVEYIVSQTPVGRLGDPEDISPLVVFLCLPAASYITGQIITADGGYII

SEQ ID NO: 2420 - protein, 271 aa, Glycine max
  unsure (1)..(271): unsure at all Xaa locations
MGYICDFCGDQRSMVYCRSDAACLCLSCDRNVHSANALSKRHSRTLLCERCNSQPAFVRCVEEKISLCQNCDWLGHGTSTSSSHRXREAINCYSGCPSAAELSSIWSFVLEIAAISESTCEQELGLMSINENKCVGVPPEDQNVSGSDEVTDLPALNKSLVGASLMPESSSEPCILDQPAGPTNECLSKLYCPATKCPALSENDNLYDDFNMDEVDLDLENYEELFGMALSHSEELFENGGIDSLFGTKGMSAGDFNCQDAIAAEAVCIGQ

SEQ ID NO: 2421 - protein, 520 aa, Glycine max
MATRVHQFFDELEAKKTILAKCTDLFTTLSTHFSSLQHSISEKSQSLDSNLQSLDSLSKETLESLHRRETSIPERESAAAARIEEQREAALADLRATHPPDPDLSATLKSLWRKMDAPALLRFVVSKRKESASLRAEIAAAMAEAVDPARLVVEAVEEFLKSKVAKSGVTDKRWACGLVIQALMVSESESREYSRRIAERAVSVVEMWKEHLDGESESGAAEVVMFLQMVVCFGLRSRFDDEYLRKLVMQFASRRDMAKLAASLQFGDKIIDIIDELIKNGKEIEAVYFASESGLTERFPPIDLLKSYHRNYKKNVSTALKKGNNNRATTDDSSTSELNSIKAIIKCVEDHKLESEFNLDNLRKWATLLEKAKAEKKKSSTSGSKPQNKRGSGSSSSRPAKSAKFSSAHSSSFSRRNLAPSLQPSPGARFSVPFNYPSQTIYDGATANLYTATYGTSHTQSPAGITQQHYSIPVDNLGPSGYRSSGSYSAQTSYGLYDYRNGAPPTYPPPYTVDQTTYRG

SEQ ID NO: 2422 - protein, 472 aa, Glycine max
MLQSLPSGVYKMSLFWFLVFSAHLALASSLVEFQDNDNPRQKQEGMQLNLYHVKGLDSSQTSTSPFSFSDMITKDEERVRFLHSRLTNKESASNSATTDKLGGPSLVSTPLKSGLSIGSGNYYVKIGVGTPAKYFSMIVDTGSSLSWLQCQPCVIYCHVQVDPIFTPSVSKTYKALSCSSSQCSSLKSSTLNAPGCSNATGACVYKASYGDTSFSIGYLSQDVLTLTPSAAPSSGFVYGCGQDNQGLFGRSAGIIGLANDKLSMLGQLSNKYGNAFSYCLPSSFSAQPNSSVSGFLSIGASSLSSSPYKFTPLVKNPKIPSLYFLGLTTITVAGKPLGVSASSYNVPTIIDSGTVITRLPVAIYNALKKSFVMIMSKKYAQAPGFSILDTCFKGSVKEMSTVPEIRIIFRGGAGLELKVHNSLVEIEKGTTCLAIAASSNPISIIGNYQQQTFTVAYDVANSKIGFAPGGCQ

SEQ ID NO: 2423 - protein, 281 aa, Glycine max
  unsure (1)..(281): unsure at all Xaa locations
MVKSTYEKFSKDFVMGGVAAIISKSAAAPIERVKLLLQNQGEMIKRGQLKKPYLGVSDGFKRVFMEEGLIAFWRGHQANIIRYFPTQAXAAGATTSLLLYHLDYARTRLGTDAIECRVTSQRQFKGLIDVYRKTLSSDGIAGLYRGFGISIWGITLYRGMYFGIYDTMKPIVLVGPFEGKFLASFFLGWSITTFSAVCAYPFDTLRRRMMLTSGHPNKYCTAIHAFQEIVRQEGFRALFRGFTANMLLGMAGAGVLAGYDQLNRISSRHSHYNETNQRVLK

SEQ ID NO: 2424 - protein, 131 aa, Glycine max
  unsure (1)..(131): unsure at all Xaa locations
KDFVMGGVAGIISRSAAAPIERVKLLLQNQGEMIKRGQLRKPYLGVSDGFKRVFMEEGLIAFWRGHQANLIRYFPTXGYFKSIFGYSKERDGYIKWFAGNVASSSAAGATTXSLLLSHSKYARTRLGTDAI

SEQ ID NO: 2425 - protein, 575 aa, Glycine max
  unsure (1)..(575): unsure at all Xaa locations
MKIIHLSGKSCCSWFLLGLLSIIASLASAAENHYHEFVIQTVPVKRLCRTQNILTVNGQFPGPTVEARNGDSLAIKVVNAGPYNISIHWHGLRMLRNPWADGPSYVTQCPIQPGGSYTYRFTIQNQEGTLLVHSHTVFLRPTGYGALIIYPKLGSXYPFSMPKREYPLLLAEWFNRDPMVLLRQTQFTGAPPNVSVAYTINGQPGDLYRCSSQETVRVPVDAGETILLRIINSALNQELFFTIANHRMTVVATDAAYTKPFTTNVLMIGPGQTINVLVTADQTPGRYYMAARAYQTAMNAAFDNTTTTAILEYKSATCSKKNGQLPRPILPVLPAFNDTATATAYTAGIRGLSKINVFTNVDVSLYFIVGLGLINCTNPNSPRCQGPNGTRFAASINNHSFVLPTTTSLMQAYYNGIPGVFTTDFPPVPPLQFNYTGNVPRGLWTPARGTKLFKLKYGSNVQIVLQDTSIVTTEDHPMHIHGFHFFVVGSGFGNFNPATDPARFNLVDPPVRNTIGTPPGGWVAIRFVADNPGIWFLHCHIDSHLNWGLATALLVENGVGPSQSVIPPPPDLPQC

SEQ ID NO: 2426 - protein, 145 aa, Glycine max
MAEAQSGQASEGIKLFGTTITLHGRERKEDRNDSEDGTEEIKRPDKIIPCPRCKSMETKFCYFNNYNVNQPRHFCKGCQRYWTAGGALRNVPVGAGRRKVKPQFGQEERLALDEWHVAAVAHGDFRQLFPSKRRRMSSGGQRQPC

SEQ ID NO: 2427 - protein, 503 aa, Glycine max
VSSEFGSRRNPAVIADNVGDNVGDIAGMGSDLFGSYAESSCAALFVASISSFGTNHDHTAMSYPLIISSMGIVVCLITTLFATDLFEIKNVSQIEPSLKRQLLISTILMTAGIAIVSFTALPSEFTLYNFGAKKVVKNWHLFFCVAIGLWAGLAIGYITEYYTSNAYSPVQDVADSCRTGASTNVIFGLALGYKSVIIPVFAIAIAIYVSFSLAAMYGIAGAALGMLSTMATSLAIDAYGPISDNAGGIAEMAGMRHEIRERTDALDAAGNTTAAIGKGFATGRAALVSLALFGAYVSRAGIKTVNVMTPKVFIGLIVGAMLPYWFSAMTMKSVGSAALKMVEEVRRQFNTIPGLLEGRAKPDYANCVKISTDASLKEMIPPGALVLLTPLIAGTFFGVETLAGVLAGSLISGVQVAISASNTGGAWDNAKKYIEAGTTPHAVSLGPKGSDAHKAAVIGDTVGDPLKDTSGPSLNILIKLMAVESLVFAPFFAAHGGLIFKLL

SEQ ID NO: 2428 - protein, 136 aa, Glycine max
ARNSARAPPAQKEAIEALPTVIINENSQCSVCLDDFEVGSEAKEMPCKHRFHSGCILPWLELHSSCPVCRLQLPLDESKQDSDLSRDSRSQREDESIEHDNDEERDGEGRNASGGRRFSFPWPFNGLFSSSNSSSS

SEQ ID NO: 2429 - protein, 373 aa, Glycine max
MAAGVGFRSHKSLLIILLGFLGLFSFTVEADTKKYQFDIQVKNVSRLCHAKPIVTVNGRFPGSTIYVREGDRVLVNVTNHAKYNMSIHWHGIKQYRNGWADGPAYITQCPIQTGNSYTYDFNVTGQRGTLWWHAHIFWLRATVYGAIVIMPKPGTPFPFPQPAREFEILLGEWWHKDVEEIETQGNQMGLPPNMSDAHTINGKPGPLFPCSEKHTFAMEVEQGKTYLLRIINAALDDELFFAIGGHNLTVVEVDAVYTKPFTTQTILIAPGQTTNVLVKANQVAGRYFMATRTFMDAPIPVDSKAATAIFQYKGIPNTVLPSLPSLPAANDTRFALSYNKKLRSLNTPHYPANVPLHVDRTLFYPICSSPNSC

SEQ ID NO: 2430 - protein, 262 aa, Glycine max
  unsure (1)..(262): unsure at all Xaa locations
MMWSFASNALTSIGLKRGSKQPSQTSAECSDDEVCSNASRDEGLECPICWESFNIVENVPYVLWCGHTLCKNCILGLQWTEVKFPTHQIKIPFLISXPWRHLLSFRIIYKGNLKYPCKNFFLLWMAESLNGDRHKVFSTCTDNQPIWSTKCNLLGSQVTNCNLRRASGSPCSRMVGSNRDVRDNDGETHHFSLHKYLDFFLDFTSKFPLVVIFLLNALFLVPCSSVILVLYFLVTIVFAIPSFLVLYFAYPTIQRLVREITS

SEQ ID NO: 2431 - protein, 262 aa, Glycine max
MMWSFASNALTSIRLKIGSKQPSQTSAECSDDEVCSNASRDEGLECPICWESFNIVENVPYVLWCGHTLCKNCVLGLQWAVVKFPTQQIKIPFFISCPWCHLLSFRIIYKGNLKYPCKNFFLLWMVESLNGDRHKVFSTCTDNQPIWSPKCNLLGSQVTNCNLRRASVSPCSRLLGSNRDVRDNDGETHHFSLHKSLDFFLHFTSKFPLVVIFLLIALFLVPCSAVILVLYFLVTIVFAIPSFLVLYFAYPTIQRLVREITS

SEQ ID NO: 2432 - protein, 690 aa, Glycine max
  unsure (1)..(690): unsure at all Xaa locations
MKSLCYLLGLIAATTDREIMISPSSGLNMEEEKKEEIVERDEDLEEQVPAAAEVEPQPWTDPIPVRGLFVSMIIGITFSIIAMKLSLTXGMVPNCNVSAALLAFVFIRTWTKLLHKAGFVAKPFSRQENTIIQTCAVACYSIAVGGGFASYLLGLNRTTYELSGVENEGNNPGAIKEPGFGWMTGFLFVVCFVGLLALIPLRKIIIVDLKLTYPSGLATAVLINGFHTQGDKLAKKQVRGFTKYFCTRASGGFFKWFFSGTQDCGFAQFPTFGLQAWKQTFYFDFSMTFVGAGMICSHLVNCSLLLGAVLSFGVMYPLIDRLKGDWFPDNLEETNMKGLYGYKVFVSIALILGDGIYNFTKILISTVLNVNERMRSKNNKNVAADRHENPTEDLKQTDEFLRETIPLRIGVIGYVVFTMISIIIIPRMFPQLKWFYVVVAYIFAPSLAFCNAFGAGLTDMNMAHNYGKVALFVIAAMSGRDNGVVAGLVGCGLVKSVVSVACTLMLDFKTAYYTCTSPKAMFICQLVGTALGCVIAPLSFFLFYKAFDVGNPHGEFKAPYALIYRNMAIIGVQGFSALPLHCLKLCFGFFAFAIGVNMIRDFAPQKIGKWMPLPMVMAVPFLVGAYFAIDMFIGTVVVFAWQKLDSKKAELMVPAAASGLICGEGLWTLPAAILALARIKPPICMKFVPT

SEQ ID NO: 2433 - protein, 282 aa, Glycine max
MNAIAAEQVLEPWHKLDDKVVLVTGASSGLGRDFCIDLAKAGCCVVAAARRLDRLTSLCHEINHRWPSNVGIHRAVAVELDVAADGPAIDRAVQKAWDAFGRVDSLINNAGVRGSVKSPLKLSEEEWDHVFKTNLTGCWLVSKYVCKRMCDIQLKGSIINISSVSGLNRGQLPGAAAYASSKAGVNMLTKVMAMELGMHKIRVNSISPGIFKSEITENLLQKDWLNDVVRKIMPLRRLGTSDPALTSLARYLIHDSSEYVTGNNFIVDYGGTLPGVPIYSSL

SEQ ID NO: 2434 - protein, 275 aa, Glycine max
MASSVVVANGNLNPNDTRGKTITCKAAVAYGPGEPFVVERILVHPPQKMEVRIKILFTTICHTDLTAWQGENEARRAYPRIFGHEASGIVESVGEGVSDMNEGDLVVPIFNGECGDCKYCKCEKTNKCERFGVDAMKKVMVSDGATRFYTMDGKPIFHFLNTSTFTEYTVVDSACIVKIHIDGSNGDLNRNIKRLTLLSCGVSSGVGAAWNTADVHFGSTVAVFGLGVVGLAVAEGARARGASRIIGVDINSDKFIKAREMGITDFINPKDDERP

SEQ ID NO: 2435 - protein, 295 aa, Glycine max
  unsure (1)..(295): unsure at all Xaa locations
MGAPKQKWTAEEEAALKAGVLKHGAGKWRTILTDPEFSAILHMRSNVDLKDKWRNINVTAIWGSRQKAKLALKRNLPAPKIDNNHMALSTIVRNDEVLDTKPIAVSGGPLQSPNLKEQISRLVDNHILEAIVNMKEQKGSDKVAIASFIEQKYRSPPNLSKLLSTKLKHMVASGKIVKKXHKYRIAPSSTVSEKRRCSSLVLLEEKPKDPSEVHKNDDVNILSKSQIDAEISKVKGLTAQEAAAAAAKAVAEAEAAIAQAEAAAREAEAAEAEAEAAQVFAKAAMKALKCKMLHI

SEQ ID NO: 2436 - protein, 432 aa, Glycine max
SARGVGSFQKPDSDSGYVSYIKVSTDGGAGTGSGGGGGVHKHTIVVVVIVIIALVVICGLVFGGVRYHRRKQRLPESPREGSEEDNFLENLTGMPIRYSYKDLEAATNNFSVKLGQGGFGSVYKGVLPDGTQLAVKKLEGIGQGKKEFRAEVSIIGSIHHLHLVRLKGFCADGTHRLLAYEYLSNGSLDKWIFKKNKGEFQLDWDTRFNIALGTAKGLAYLHEDCDSKIVHCDIKPENVLLDDHFMAKVSDFGLAKLMNREQSHVFTTLRGTRGYLAPEWITNYAISEKSDVYSYGMVLLEIIGGRKNYDPSKSSEKSHFPTYAYKMMEEGKLRDIFDSELKIDENDDRFQCAIKVALWCIQEDMSMRPSMTRVVQMLEGICIVPNPPTSSSLGSRLYATVFKSSSEGATSSGPSDCNSDAYLSAVRLSGPR

SEQ ID NO: 2437 - protein, 268 aa, Glycine max
MKDDKQAPVPASTTEGQPIRCKAAVSRRAGEPLVIEDIIVAPPKPREARIRIICSSLCHSDITLRNLQDPPAIFPRILGHEATGVVESVGKDVTEVTKGDVVIPVILPECGECIDCKSTKSNRCTNFPFKVSPWMPRDGTTRFTGQNGEIIYHFLFISSFSEYTVVDIANLIKIDPEIPPDRACLLGCGVSTGVGAAWRTAGVEPGSTVAIFGLGSIGLAVAEGARLCGATRIIGVDINPEKFEIGKKFGVTDFVNAGECGGKPVGQV

SEQ ID NO: 2438 - protein, 393 aa, Glycine max
MEGDGYCGSFFQRCKPYIAMISLQFGFAGMNIITKVSLNRGMSHYVLVVYRHAFATAAIAPFAIVLERKVRPKITFLMFMQIFVLGLLGPVIDQNLYYAGLKFTSPTYSCAISNMLPAMTFVMAAIFRMEKLNVRKVRCQAKVIGTVVTVAGAMLMTLYKGQVISFLGSKYMHHPRNYVPENNTDSGEKDWFKGSVLLVLATLSWASFFILQAVTLRKYPAQLSLTALVCALGTLQSIAVTFVMEHKPSVWTIGWDMNLLAAAYAGIISSGITYYVQGIVMQKKGPVFVTAFSPLMMIIVAIMGTFILAEKIYLGGVIGAILIVMGLYSVLWGKHKENKEKEAEITIEVLKCCSENGMRLETVVEDAETNNDIEMQKGEASRELRVAIGVPKV

SEQ ID NO: 2439 - protein, 262 aa, Glycine max
MFVLTKLNLSLAIQNETTFVPPPQTARSVSMRDIGTEMTPIASQEPSRTGTPVRATTPMRSPNSSRPSTPPRASPASTLTDLHSDNLNLNMNELSEKELQMKTRREIMVLGTQLGKMNIAAWASKEEEDKDASTSLKTKAELPKSVVEARAAAWEEAEKAKYMARFRREEMKIQAWENHQKAKTEAKMRKIEVEVERIQGKAQDKLTNKLAAARHKAEEKRAAAEANRNHQAAKTEEQAEYIRRTGHVPSSYLSFSCCNWCS

SEQ ID NO: 2440 - protein, 553 aa, Glycine max
  unsure (1)..(553): unsure at all Xaa locations
LSAANTMFSSSPPFPSSSSPSVTMLHEQAAPAVASWSSSSAAQHFPTSVLLQEQRDEYKPFLHVHNKETTLNTRQMDMTSVHEKGNTSNADQLVHDFVQQLHLRSHLQNLLTCSPTRGIAASSILQPVDIDSEWPADGVPRNAVSLAQQALSASKQAVSTTGEMKLIEIDDDDPSFSALLHKCLTDSSLKKYKVVRSTRIIERLXKQRKSSKSKFLDEESDPRRLRLEKKLKEGYDPNDPLRLFLSGPESRQLLTREEESQLITQLQDLSRLEEVKIRLQTQLRREPTLAEWADAVGHSCYALQTQLHCANRSKEKLFHANLRMVVHIAKHYQGRGLSLQDLFQEGSTGLMKSIQKFKPEAGCRFGTYAYWWIRHAIRKAIFLHSRTIRLPENLYTLLGKLIEAKKSYIQEGNLHPTKEELARRVGITVEKLDNLLFASRNPISMQQTLWVDQDTTFQEITADSAIEIPDVTVSKQLMRRHVHNLLNILSPKERGIIRLRFGIEDGKEKTLSDIGKVFGLTKERVRQLECRALSKLRQCLESQGLDAYTDLLV

SEQ ID NO: 2441 - protein, 336 aa, Glycine max
MGRQPCCDKVGLKKGPWTAEEDKKLISFILTNGQCCWRAVPKLAGLLRCGKSCRLRWTNYLRPDLKRGLLSEYEEKMVIDLHAQLGNRWSKIASHLPGRTDNEIKNHWNTHIKKKLKKMGIDPATHKPLPNANEQNQNQTRQDQQLHHQPVELEEPNQQPLQVDFDPKVDPNKEPEKPETSLESSTITEEAKEEDQIITPLFDTMELMNGFCTDEVPIIEPHEILMPCAPSSSSTTSSSSSSNSTNFLEDLQLPDFEWSCNYNDNNTITNNNNNEDKDDDNNNNSSMALWDDDIIGNRYWLINEDDDSDENQVFDASLTQFSKMFMESESWGYGLF

SEQ ID NO: 2442 - protein, 107 aa, Glycine max
AYPHKILTGRRSRMHTIRKSSGLAGFPKRDESVHDAFGVGHSSTSISAGLGMAVARDLLGKNNSIISVIGDGALTAGQAYEAMNNAGFLDSNMIVVLNDNKQVSLPR

SEQ ID NO: 2443 - protein, 377 aa, Glycine max
MAGDKQKLFNRLKPFIGVVFLQFGYAGMDILSKAALNKGMSNYVFVVYRHVFAFVVMAPFALILEKKVRPKMTFSIFMKIMILSLLEPVIDQNLYFLGMKYTTATFAVSMYNVLPAITFVMAWILRLEKVKLKSIRSQAKVVGTLATVVGAMVMTLIKGPILDLFGTHASSTHNQQNGGVNLQHAIKGSVMITIGCFSCACFMILQAITIEAYPAELSLTAWICLLGTVEGGVVALVMERKNLSAWSLQWDTKLLAAVYSGIVCSGMAYYIQGAVMKDRGPVFVTTFNPLCMVIVAIMGSFFLAEIMYLGRVVGAIVIILGLYLVVWGKSNDYESSNSITKKHTLPSKQTVEEEHSNHDVITLSNLGAGNIVRDEQV

SEQ ID NO: 2444 - protein, 432 aa, Glycine max
MTMKFRANEVLNGKYTRATAKSVFLVPFTLLLIMLPLSLMRSSHESTPEISSVSVSSSLNNNTEVKQCNIFSGRWVHNPEAPYYSNETCHWIIDQQNCLKFGRPDREYLHWRWKPDECELPFFNATQFLNLVRGKKMAFVGDSVGRNQMQSLLCLLSHVSEPEDVSHKYSSDVVYFKRYFYHDYNFTLGNLWSPYFVRSSDADPRGHTYNSIMKLYVDEADEAWTSQVENFDIVIISSGQWFFRPLLFYEKGKLVGCNKCGMDNVTDLTHLYGYKKAFRTAFRALNSLENNSARAFLRTFSPAHFENGDWNKGGKCVRTMPFTKQEMRLEDGAVEYILEMYVTQVEEFREAQRVATKRGLEFLMMNTTEIMLLRPDGHPNNYGHAKDKNVTLNDCVHWCLPGPVDTWNEFLLYMLDIMGSDAFFSSKLEKVF

SEQ ID NO: 2445 - protein, 209 aa, Glycine max
  unsure (1)..(209): unsure at all Xaa locations
MGCCCDEDDGDIFRHLMNSNFPSSSSTSATTTSSCTVISPMNSHFSALSSTDILRLIFDNLPIPDLARASCVCRLWNSVASQRDMVTRAFVAPWKLNDVVGNPLSGSFWRDNSLAKFAVSHHITRGDTVASLAVKYSVQVMDIKRLNNMMSDHGIYSKGKXYSSLLVNPDILHYRTCLYLELDVYAKREVAVLYPTGFPRTGGMSHIPP

SEQ ID NO: 2446 - protein, 570 aa, Glycine max
  unsure (1)..(570): unsure at all Xaa locations
RRSWLEFLACSIPPQKLKPGRYWYDKDSGLWGKEGEKPDKIISSKLNIGGKLQTDASNGNTRVYMNGREITKIELRMLKLANVQCPRDTHFWVYEDGSYEEEGQNNIKGNIWXERQASTRFICSLLSLPVPPTNPPGVKDNSTNYSTRSVPEYLEHGRVQKLLLFGMEGSGTATLFKQAKFLYGNKFSAEESQNIKLMIQSNMYKYLSILLEGREQFEEEALAERESTSLEGEGSGQERQQLMKRSQXIYSINQRFKHFSDWLLDIMATGDLEAFFPAATREYAPMVDEIWRDPAVQETYKRRKELHNLPDVAKYFLDRAIEISSNEYEPSDKDILYAEGVTQSNGLAFMEFSFDDRSPMSEIYSENSNYPPPLTKYQLIRVNSKGLHDGCKWXLEMFEDVRAIIFCVSLSDYDQMWPTSTGQLRNKLLASKDLFESLVKHPCFKDTPFVLLLNKYDVFEDKINKVPLSICEWFGDFCPVRPHHNNHALAHQAYYYVAMRFKELYYSLTGQKLFVGQTRGRDRTSVDEAFKYIREIIKWDDEKDEDVYEINPEESFYSTEMSSSPFIRQE

SEQ ID NO: 2447 - protein, 179 aa, Glycine max
  unsure (1)..(179): unsure at all Xaa locations
MEGNNNNNNNNNADVFRPSVGPSSSPNSRRYSGILSASNLIQAPLSALLEYSGILPSRSSNQHSQPSSDAANNDGEVSIRIIGPAEQEQREEQQLQQTPPPGLVVGLSHSQNDTVLASGSPRGDAEGAAXTEGAAAGGDGAGRDSSYQRYDIQHAXRWIEQVLPFSLLLVVVFIRQHLQ

SEQ ID NO: 2448 - protein, 337 aa, Glycine max
MDTCNVFEGSWVRDDSYPLYDASHCPFAERGFNCLANGRKDRDYTKWRWKPKNCEIPRFDVRGILERLRGKRVVFVGDSLSRTQWESMICLLMTGVEDKKSVYEIKGNKITKQIRFLGVRFSTFDVRIDFYRSVFLVRPGSVPRHAPQRVKTTLRLDKIDDISHEWIGPEVLIFNSGHWWTRTKLFDVGWYFQVDNSLKLGMTINSGFNTALLTCASWVESTINPNRTRVFFRTFESSHWSGQNHNSCKVTQRPWKRTNRKERNPISNMINKVVKSMSAPVTVLHVTPMTAYRSDGHVGTWSDKPSVPDCSHWCLAGVPDMWNEILLSYLLPKEGAY

SEQ ID NO: 2449 - protein, 90 aa, Glycine max
LIRLLAKEHEILITVEEGSIGGFGSHVSQFLSLSGILDGPLKWRAMMLPDRYIEHGSPQVQIEEAGLSSKQIAATVLSLMERPKQALLFK

SEQ ID NO: 2450 - protein, 342 aa, Glycine max
MEEEVICQWSVFRSLLAILQWWAFNVTVIIINKWIFQKLDFKFPLSVSCIHFICSAIGGYVVIKVLKLKPLITVDPEDRWRRIFPMSFVFCINIVLGNVSLRYIPVSFMQTIKSFTPATTVVLQWLVWRKYFDWRIWASLIPIVGGILLTSVTELSFNAFGFCAALLGCLATSTKTILAESLLHGYKFDSINTVYYMAPFATMILAIPALLLEGNGVLEWLSTHPYPWSALIIIFSSGVLAFCLNFSIFYVIHSTTAVTFNVAGNLKVAVAVLVSWLIFRNPISYLNSVGCAVTLVGCTFYGYVRHMLSQQPPVPGTPRTPRTPRSKMELLPLVNDKLDDKV

SEQ ID NO: 2451 - protein, 342 aa, Glycine max
MEEGVICQWSVFRSLLAILQWWAFNVTVIIINKWIFQKLDFKFPLSVSCIHFICSAIGGYVVIKVLKLKPLITVDPEDRWRRIFPMSFVFCINIVLGNVSLRYIPVSFMQTIKSFTPATTVVLQWLVWRKYFDWRIWASLIPIVGGILLTSVTELSFNAFGFCAALLGCLATSTKTILAESLLHGYKFDSINTVYYMAPFATMILAIPALLLEGNGVLEWLSTHPYPWSALIIIFSSGVLAFCLNFSIFYVIHSTTAVTFNVAGNLKVAVAVLVSWLIFRNPISYLNSVGCAVILVGCTFYGYVRHLLSQQPPVPGTPRTPRTPRNKMELLPLVNDKLDDKV

SEQ ID NO: 2452 - protein, 272 aa, Glycine max
EVDERDLVGESRSHRDCNIEMETPKRFEGKVAIVTASTQGIGLAIAERLGLEGASVVISSRKQQNVDAAAEQLRAKGIQVLGVVCHVSSAQQRKNLIDKTVQKYGKIDVVVSNAAANPSVDAILQTKDSVLDKLWEINVKATILLLKDAVPHLQKGSSVVIISSIAGFNPPPSLAMYGVTKTALLGLTKALAAEMAPNTRVNCVAPGFVPTNFASFITSNDAVKKELEEKTLLGRLGTTEDMGAAAAFLASDDAAYITGETIVVAGGTPSRL

SEQ ID NO: 2453 - protein, 566 aa, Glycine max
MSCLLPHFNCHLDTFRTHPYALPTHPSKTRLNLCFQPQCVLSATSPSTLLSLEKKLALDAPSDPNTSWPYIAAVAPPSPHLKANFKSTLSAESLLTNEEAVIAAAASEALALAKAAVKVAKDAVLLVKKKPPAEAEYKSHVSSKSDDLLLKWFHQMEAEDGVAEESMGAGAEIMEGVDISPSEEESDLEPSHEELECLQERLSDNIAVRSRRLTERKAKRVRAAEKATTNFASLKPGSSSRRKRVSMQEVDYSDPLRYLRTTTSASRLLTPTEEIKLSAGIQDLLKLEKIQEDLAERFGDQPTFAQWAAVAGVDQKTLRKRLNYGIFCKDKMIKSNIRLVISIAKNYQGSGMNLQDLVQEGCRGLVKGAEKFDGTKGFKFSTYAHWWIKQAVRKSLSDQSRTIRLPFHMVEATYRVKEARKQLYSENGRQPDDEEVAEATGLSMKRLNAVLMTPKAPRSLEQKIGINQNLKPSEVISDPDAETAEEQLLKQFMKKDLEEALDSLNARERQVVRWRFGMDDGRTKTLQEIGEMLGVSRERIRQIESSAFKKLKNKKRTNHLQQYLVS

SEQ ID NO: 2454 - protein, 520 aa, Glycine max
LKLAESLKDYEEDFENPEKKPRRNKYAFACAILASMTSILLGYDIGVMSGAALYIQRDLKVSDVQIEILNGIINLYSPVGSFIAGRTSDWIGRRYTIVLAGAIFFVGAILMGFSPNYAFLMFGRFFAGVGIGFAFLIAPVYTSEISPSSSRGFLTSLPEVFLNGGILIGYISNYGFSKLALRLGWRLMLGVGAIPSILIGVAVLAMPESPRWLVAKGRLGEAKRVLYKISESEEEARLRLADIKDTAGIPQDCDDDVVLVSKQTHGHGVWRELFLHPTPAVRHIFIASLGIHFFAQATGIDAVVLYSPRIFEKAGIKSDNYRLLATVAVGFVKTVSILVATFFLDRAGRRVLLLCSVSGLILSLLTLGLSLTVVDHSQTTLNWAVGLSIAAVLSYVATFSIGSGPITWVYSSEIFPLRLRAQGVAIGAAVNRVTSGVIAMTFLSLQKAITIGGAFFLFAGVAAVAWIFHYTLLPETRGKTLEEIEKSFGNFCRKPKAEEGLDDNVEIQLKTRDQTLTSVD

SEQ ID NO: 2455 - protein, 659 aa, Glycine max
  unsure (1)..(659): unsure at all Xaa locations
MTVEKKMNDSGDEFPVGMRVLAVDDDPTCLLVLETLLRRCQYHATTTNQAIKALALLREHKDKFDLVISDVHMPDMDGFKLLELVGLEMDLPVIMLSANGDTKLVMKGISHGACDYLLKPVRMEELKNIWQHVIRRKKFDSKEKNKTRNIDKPTSNSSNGLGSSGTGNSDHNEKLTKKRKDQDRTAYEQQXNDHDNDDPSAQKKPRVVWSVELHRKFVAAVNQLGIDKAVPKKILDLMNVEKLTRENVASHLQKYRLYLKRISCVANQQTNMVVALGGADPSYLRMNSVSGVGHIQSISGSGQLHNNAFRSFPPSGIINRLNTPAGLNVHGFPSGVLQLSQSQNLKNTNDNLKFQSAIVPANQNGVHGMTVSVGLDQLQNNKGVMSVQNLTTVFDAKTTFPISNKLPDPRPKITNSGSHTPDVSFSNNALMLEPRPQGTQGSVRIETLSSSVASQHSEFSLSLLDQGRYSDNWASTVQPSVIQTNSYPPSECFGQTNIPPTDNMASVPLQGGNLSGASITSLSRQSYDSMTDMHSEGVTFTNRPGHISSNVPYQGWHDNNQDATHHSNILSINSLTPVNGAAVPAGHAAMNSALHRNLDFNYCDPLQMKHEGFVELTDEALSKQHQGNIMNLPKSQQSHFSNNLGSLERLGQFNDETGK

SEQ ID NO: 2456 - protein, 135 aa, Glycine max
WNDRRRQCGCSSPVDFLQRIQVFKRKRKAVVTQLIFFKGSRFSKERGITLMGAMIIICSLPICLIYFPQWGGMFSGPSSKKVTEEDYYLAEWNSKEKEKGSHHASLKFADNSRSERGRKLNASTELTEEITPPHV

SEQ ID NO: 2457 - protein, 202 aa, Glycine max
EADGLECLHLKDCALEFFELIGKGTLKHFKIDDVSVIHLDIGETVENLETVDISNFPIIWPKFYQMISRSSNLKRLRLWDVMFDDEDEVVDLETIATCFPYLSHLSLSYDVRDGVLYYGLQGSSYLESVVVLELGWTVINDLFSHWVEGLLKRCPNLKKLVIHGIVSEAKSHEECQMLANFTTSMVELMRRYTHVDPYFKYE

SEQ ID NO: 2458 - protein, 469 aa, Glycine max; identical to SEQ ID NO: 2208

SEQ ID NO: 2459 - protein, 288 aa, Glycine max
  unsure (1)..(288): unsure at all Xaa locations
LILEIPNWTSGCTESIEKGEQMWVKRIMSQSVLPNHITVLDLLKIPQLMDTCVRNGNYDEALDLEAFVGKLSTMHPKLPVIQALAAEVRLTTQSLLSQLLQKLRSNIQLPECLRIIGYLRRIGVFSEYGMRLLFLRCREAWLTGILEDLDQANPYEYLKGMINCHRMHLFDVVNQYRAIFADDTSXGSEENYDGGLLFSWALHQITSRXRTRKVRPPERTESGARSKLLAQCRYRASGPGRVGPAFXGVXPGRFEESVLNFVSKNMSTAXDNFHLVLDSHRWVPLPRV

SEQ ID NO: 2460 - protein, 244 aa, Glycine max
MATIILRSNEVVHALGLFCILLLVHKGDAYEFVVGGQKGWSIPSDPNSNPYSQWAQKSRFQVGDSLVFNYPSGQDSVIQVSSQDYASCNTDAYSQKFSDGHTVINLNQSGPHFFISGNKNSCLKNEKLVVIVLADRNNKNTNQTSPPSPNCPSPSPSPSLSTQSLAPSPAPSQQVAPPPLSPVAAPPQQEAPSPPSPATNNPTPAPVSDQPSPPSPPHNAASSILVNFACSVGAFIASVLVFSF

SEQ ID NO: 2461 - protein, 261 aa, Glycine max
MTSSLVKIQGEQVLTNDFQDLSIKDLSEKGTEAEIHKVGSYGSHGGICAICLDKIVLQETALVKGCEHAYCLTKMCFFLLCVTCILHWATYREKVTCPQCKHPFEFLNVHRSLDGSIQDYMFEESVCLLLRASWFTPLSVEEHVVHEDAYEDLEDYYQYEDDDDDDDMDEVYYGGSSSLRVIGNRRWGDNGYVRAGRQEARPVHRPNFQDSGASSSSHEPKKKEAGKIITGRRAKRAQKREAADKAAEAKHQQHLVRLGRK

SEQ ID NO: 2462 - protein, 282 aa, Glycine max
MATQLSDRLEPWHTLAGKVVMVTGASSGLGRDFCLDLGRAGCRVVVAARRVDRLESLCDEINSMAAGDGGRSRRAVAVELDVAADDPAVDKYVQKAWEAFGHIDALINNAGVRGNVKSPLELSEEEWNHAFRTNLTGTWLVSKYVCKRMRDAQRKGSIINIASIAGLNRGQLPGGAAYSSSKAGVNMLTRVMALELGAHKIRVNSISPGLFKSEITEKLMEKNWLNNVAMKTVPLRKFGTSDPALTSLARYLIHDSSEYVSGNNFVVDAGATLPGVPIYSSL

SEQ ID NO: 2463 - protein, 136 aa, Glycine max
MLSKYLAPIYTHLKWVLDFVLYYPFYMLYDSHPPINLGTELSTFHYEFSSGSEEHVDCAVCLSKFGEGDEVIRVMRCEHVFHKGCLDRWVGFENATCPLCRGSLTPKRPITNSGAEVVLFQFCSVQKCNDETWWLR

SEQ ID NO: 2464 - protein, 284 aa, Glycine max
MESGRIFFGASASSGNNMLFLGNTELAFRGRSIMSMEEASKRRPFFTSPDELYDEEYYEKQSPEKKHRLSSEQVHLLEKSFEEENKLEPERKTQLAKKLGLQPRQVAVWFQNRRARWKTKQLERDYDVLKSSYDTLLSSYDSIMKENEKLKSEVVSLNEKLQVQAKEVPEEPLCDKKVDPIPVDEDMAPIFGTRVEDHLSSGSVGSAVVDEGSPQVVVDSVDSYILADNYGGCVGPVERVQSEEEDGSDDGRSYLDVFVVSETEHQNHEEGETLGWWTNMYYVG

SEQ ID NO: 2465 - protein, 289 aa, Glycine max
MGAGVSTTATENDDGGTFSLSSETSLDDIPENCISSMMMNFDPQEICSLARVNKTFHRASSANFVWESKLPQNYKFLLNKVLGEQNLGSMTKKEIYAKLCQPNFFDGGTKEVWLDRSSGQVCMFISSKSFKITGIDDRRYWNYIPTEESRFKSVAYLQQMWWVEVIGELEFEFPKGNYSVFFKLQLGKPSKRLGRRVCNLDQVHGWDIKPVRFQLSTSDGQRSLSQCYLRGSGEWAYYHVGDFAIDKPNGPTNINFSLAQIDCTHTKGGLCIDGVVICPKEFTQGLKQF

SEQ ID NO: 2466 - protein, 185 aa, Glycine max
MERERALFERVRKNSTVEEEVENEVEEEDESGVSITEEEKKKGVGSSGGRRGSSGGSGGVSPPSCQAERCGADLTDAKRYHRRHKVCEFHSKAPVVVVAGLRQRFCQQCSRFHDLAEFDESKRSCRRRLAGHNERRRKSNPEASNEGSTKGHHPKETTHCRLANERERIQMNLPGSSGYKSFNIR

SEQ ID NO: 2467 - protein, 288 aa, Glycine max
MAMTTTTESDLDYELRYLSLAVTDTFTAFQNLLPDAMTSFSACGLIDPLCSQNLTPKHSTITATIDSQSSICATSNVGSPVSANKPEGRENHTKGATSGSSEPSDEDDEAGACEQSTNPADMKRLRRKVSNRDSARRSRRRKQAQLSDLELQVEKLKVENATLYKQFTDASQHFREADTNNRVLKSDVEALRAKVKLAEDMVTRSSFTTLNNQLLQTQHHQMSTPQQLNTTNLRRMAHVSPTITVHGNDVSYNNGGQNSALGNLDMSFNDINEVMNDAMSCGTIWPLD

SEQ ID NO: 2468 - protein, 222 aa, Glycine max
VRGVSFHIGGGGPDTRAYDGAISAAKNVFEMASGLGLPRMRVLDIGGGFTSGPPFEAAALKINAAIQASFGNEEGLVVIGEPGRYFAETAFTLATRIIGKRVRGDVREYWIDDGIYGTLNNIVFDYATVTCMPLACTSKPENPRCSRELNLKTSPSPVFGPTCDSIDTVLRDYKLPGLQVNDWLVFPNMGAYTTSSGTNFNGFSSSAKSTFLAYSSPEHSMF

SEQ ID NO: 2469 - protein, 471 aa, Glycine max
  unsure (1)..(471): unsure at all Xaa locations
MDQMSQQRHGYFHSESIHFRGSNISPPNVCTLVTASGHGTNLDSHYLLDAYDNGMMYGMTQYNGVQHQHNLDMGVPAAANIYYSSMNPSSGTAASLNAEVRRGNYQYFNASASSTVAPPNARHTENGIPSLPHCTSWSRSGESMMVRDPNRITQGNYLSQHFQPAAPPPWLDQQLNSNNNDGHALPWHQSLPMPYVQAPSANGSSLEKXRMGPQRYHDTAGSRSGHRFPHPPLVNPHYHSFHHQTQPVQEMRGHSINFHPPPPVTAPSYRVPTNASRSSSIFIQDAIEMGARHVGAAPLAGSHIYRPHRGSTHETTLRHRNLPPVTFLQVDQVSXWKGDRGDSQDVTLLVDHHNDMRLDIEDMAYEELLALGERIGKVNTGLSEEMITSQMKTKTYLLLPTNAINLEEAASEEQENDSCIICQDEYKSQEKIGILQCGHEYHADCLKKWLLVKNVCPICKSEALTPGEKCV

SEQ ID NO: 2470 - protein, 861 aa, Glycine max
MDQNRDESWRKLVKKMLPPGASIPADASNLDYSIAMEYVGPPVSYEVPRVEPFDTNSRAIPTAQPLSGSQRSNTHGGHMVIEPIPLPVSRIAVGVTSSPNQSPRVSGSSDSVVSVLQNPDLSSASPSASPASVHNLPSNPPKPANEAKRAPVVTFNTVDRPQRKEVEVVKPVYAEYVGVLNERKKKKIRVCYRCGKGKWETKESCIVCNAKYCSNCVLRAMGSMPEGRKCVTCICQPIDESRRLKLGKYSRVLSRLLSPLEVKQIMKAEKECSANQLRPEQLIVNGLPLKPDEMAELLGCPLPPRKLKPGRYWYDKESGLWGKEGEQPDRIISSNLNFTGKLSLDASNGNTEVYMNGREITKLELRVLKLANVQCPRDTHFWVYDDGRYEEEGQNNIRGNIWEKASTRFVCALFSLPFPHGQPHGQKDETSHYTTVPKYLEQKKTQKLLLLGIQGSGTSTIFKQAKFLYGNKFSAEELQDVKLMIQSSMYKYLSILLDGRERFEEEAVSRMNGQGSPGQTMETGSNGEASNTSECIYSLNPRLKHFSDWLLDIIATGDLDAFFPAATREYAPLVEEVWRDPAIQETFKRKDELHFLPDVAEYFLSRAVEISSNEYEPSERDIVYAEGVTQGNGLAFMEFSLDDRIPKSDTYSENLDAQLPPLAKYQLIRVNAKGLNEGCKWVEMFEDVRAVVFCVSLSDYDQLLLSPDSSGSGTLVQNKMVQSKELFETMVRHPCFKDTPLVLVLNKYDIFEEKISRVSLNTCEWFSDFCPVHAHHNNQSLAHQAYFYVAMKFKDLYASLTGKKLFVAQARARDRVTVDEAFKYIREVLKWDEEKEENFYGPPEDSFYSTDISSSPFVRQE

SEQ ID NO: 2471 - protein, 194 aa, Glycine max
MGTLEQIDAPQTRSSSSSSSSIDSNNHPSRTRTPPPSSPSSSACRNRTDLSTDLRLGLSISPSSQSELPFNSTPREESFDWPPIKSILRSTLVGKQSHLSQRPSLFVKVYMEGIPIGRKLNLMAHYSYDGLVKTLGHMFRTNILCPNSQPLNSRNFHVLTYEDQEGDWMMVGDVPWEMFLNSVKRLKITRADRC

SEQ ID NO: 2472 - protein, 437 aa, Glycine max
MNQLVESSMNTQRVSRVQAPLVDSVSCYCKVDSGLKTVVGARKFVPGSKLCIQPDINPNAHRSKNSRRERTRVQPPLLPGLPDDLAIACLIRVPRVEHGKLRLVCKRWYHLLSGNFFYSLRRSLGMAEEWVYVIKRDRDGRISLHAFDPIYQLWQSLPPVPGEYSEALGFGCAVLSGCHLYLFGGRDPLKGSMRRVIFYNARTNKWHRAPDMLRKRHLFGSCVINNCLYVAGGECEGIQRTLRSAEVYDPNRNRWSFISEMTTAMVPFIGVVHNGTWFLKGLGSNRNVICESYSQETDTWTPVSNGMVNGWRNPSISLNGQLYALDCQDGCKLKVYDRASDSWKKFIDSKLHLGRSRALDAAALVPLNGKLCIIRNNMSISLVDVSSPNRRVESNPQLWENIAGKGHVRSLVRNLWSTIAGRGSLKSHIVHCQVLQA

SEQ ID NO: 2473 - protein, 467 aa, Glycine max
MNQLVESSTTTQKVSRVQAPLVDSVSCYCKVDSGLKTVVGARKFVPGSKLCIQPDINPNAHRSKNSRRERTRVQPPLLPGLPDDLAIACLIRVPRVEHGKLRLVCKRWYHLLSGNFFYSLRRSLGMAEEWVYVIKRDRDGRISLHAFDPIYQLWQSLPPVPGEYSEALGFGCAVLSGCHLYLFGGRDPLKGSMRRVIFYNARTNKWHRAPDMLRKRHLFGSCVINNCLYVAGGECEGIQRTLRSAEVYDPNRNRWSFISEMTTAMVPFIGVVHNGTWFLKGLGSNRNVICESYSQETDTWTPVSNGMVNGWRNPSISLNGQLYALDCQDGCKLKVYDRASDSWKKFIDSKLHLGRSRALDAAALVPLNGKLCIIRNNMSISLVDVSSPNRRVESNPQLWENIAGKGHVRFFKPEIQTPLMIILVIQLGKLLVFWENQIETGLSTFLCGKEIVLHCKEEVNCMILAIE

SEQ ID NO: 2474 - protein, 152 aa, Glycine max
  unsure (1)..(152): unsure at all Xaa locations
MGQSSLPAPSEGVLCVHLVNTAMSISIFKGIVRTILQIVGIRVSSLSPSPDISRNPPEPLXFNLSPSEGFIEEFRSRTPTLRFGSMCGSKQPQHECCCVCLTKFEPESEINCLSCGHIFHKVCMEKWLDYWNITCPLCRTSLMPEDDASCFW

SEQ ID NO: 2475 - protein, 72 aa, Glycine max
  unsure (1)..(72): unsure at all Xaa locations
MAANFWTSSHYKHLLDQEDVDMVNPLDKEKGITLEDFKLIKMHMANYILKLAQQVKVRQRVVPTRXTYMRRV

SEQ ID NO: 2476 - protein, 170 aa, Glycine max
  unsure (1)..(170): unsure at all Xaa locations
MGASFSSCVCDGDATPSRPRLGDIPESCVALVLMYLDPPDICKLARLNRAFRDASVADFIWESKLPSNYKFIVEKALKDASVEELGKRDIYARLCRPNSFDNGTKEIWLDKRTGGVCLAISSQALRITGIDDRRYWSRISTEESRXPHSCLSSQIWWLEVEDDVDFQFPP

SEQ ID NO: 2477 - protein, 679 aa, Glycine max
IRLEEAFVKGVPIGQALDIDIPPPRPKRKPNNPYPRKTNVGGAPTLHSGARHGKPLISIVSSLGKQALGLEKEPLPEKHDVDLRPSTVKENKDQSCSKVFTILQEAPCSSVSSANKNSTSILVPLRNSCALRKFIPSVKDVITQDETNDSFVTDDLENQKLEIDDGKHTQKSNGTCKVSKSENSGASELVQTEKTDGLNCALTIEGVQGNQNYPRHVPVHVVDGNLGTSTQNPSPDMVFQDSIFQPKGGVNGQPNLVTISATSNISESQNNTARSSIHQSFPPCPTFTQDDYHSFLQVSSTFSSLIVSTLLQNPAAHAAASFAATFWPYANAETSADSPMCTPDFPSRQIGSPPSVTAIAAATVAAATAWWAAHGLLPLCAPLHTAFACPPASAIAVPLMNIDESPQKTEQEEIKPQNSSLQDQILDPEHSEAQHSAPKSPAVFSSKSEERGDANLNTSPKATNHETNQVISENPDSNKMKGRKPVDRSSCGSNTTSSSEETELLLKDEKEKEEPKTPDANILDTELSNRRSRSINNLTDSWKEVSEEGRLAFQALFSREVLPQSFSPTHDLINEDNQIDSIKDNDQNTDYKDEDLESKKCSSNSDGVQKNLLFVKDNNEEEGLLIIGLGPGKLKTRPTGFKPYKRCSVEANENRIGTACNQGEEKGPKRIRLNGEAST

SEQ ID NO: 2478 - protein, 138 aa, Glycine max
  unsure (1)..(138): unsure at all Xaa locations
MSGKGAKGLITGKTSASAKDKDKXKKKPVSRSSRAGLQFPVGRIHRLLKSRSRVSANGRVGATAAVYSAAILEYLTAEVLELAGNASKDLKVKRITPRHLQLAIRGDEELDTLIKGTIAGGGVIPHIHKSLINKSSKE

SEQ ID NO: 2479 - protein, 505 aa, Glycine max
MPNPEAHHPSRSRARPSTSAAARPPARARVSLRQLLRVASVASGIQFGWALQLSLLTPYVQQLGIPHQWASIIWLCGPVSGLFVQPLVGHMSDRCTSRYGRRRPFILVGAVAIVAAVLVIAYAADIGWLLGDTADYRPAAITVFIVGFWILDVANNVTQGPCRALLGDLTSKDPRRTRVANAYYSLFMAIGNILGYATGSYSGWYKIFTFALSPACTISCANLKSAFFLDIAFIAVTTYISIMAAHEVPLNSSEAAHAEAGAGESGSAEEAFMWELFGTFKYFTTPVWIILSVTALTWIGWFPFTLFDTDWMGREIYGGDPNQGLVYDTGVRMGALGLLLNSVVLALTSLFMERLCRKRGAGFVWGISNIMMTVCFLAMLVVTYVANNMGYIGKDLPPTGIVIAALIIFTILGFPLAITYSVPYALISTHIESLGLGQGLSMGVLNLAIVVPQIIVSLGSGPWDQLFGGGNSPAFAVAAVSALISGLIAVLAIPRSGAQKARSHV

SEQ ID NO: 2480 - protein, 142 aa, Glycine max
QAAARKEILPLPGVGKEDLEDPQNLLVEGIIDRAEANDAAQRKQKMMILEQQYRDDLKKELQGFTCTSAGSIETSTEVVQTGESTTSVHENVDHDDMGKLMLSRKRRGLVKAIEKSRERNKAQTDLIKQRKKKIDEEQRQRS

SEQ ID NO: 2481 - protein, 451 aa, Glycine max
  unsure (1)..(451): unsure at all Xaa locations
IIGYLRRIGVFSEYGMRLLFLRCREAWLTGILEDLDQANPYEYLKGMINCHRMHLFISDPXNLNRVNLLEANPVPXDESVMLDAALAIINKEQSLRMSLLGASPDLSFAXFAENRTMESATASSSESETALPLPLASESQQPYVSTSGSEENYDGGLLFSWAMHQITSHLQTLKVMLPKITEGGSLSNILDQCMYCAMGLGWVGLDFRGLLPSLFEEAVLNLFSKNMSTAVENFQLVLDSHRWVPLPGVGFSAHTVGDENHEDVTPPSNLMEHPPLAVFINGVSAAMNELRPCAPISLKHVLAQELIKGLQAVSDSLLLYNTTRVLRSNESGLFLSLCWAFIEAAYPHCATCFGRCYLGGATLIMDAKNVYNGISRLLETSSARELPKPVNNVESKSVAENGESPKMENGETPDAKESEAVNSEEVNEEGTEEGPTLQTDREDTNLEKPLE

SEQ ID NO: 2482 - protein, 685 aa, Glycine max
  unsure (1)..(685): unsure at all Xaa locations
APTRPYGCEKTTEGGLNKEVPNIVSEFVGGTSLEIQERYKTIKEKNIGRLDQPSQNSGEYESTIGICVEKTLSAALDSFDNLFCRRCLIFDCRLHGCSQPLIYHSEKQTVWSDPEGDRKPCSDQCYLQLKVVKNVTEDSTSGSDQNKRTTITEEADVILAPSIIEEPSNQSIVPFPTEVDCLGSLNLNVPISGTREKWKVPNQSDTALRDSSLPPDDSQHSYKKLKTISDDVVTANSDSSKNINFGACDESIHTITSGLLDKSVKDNSNKLIDSSSTCCSDEQDKSIGDGPKDPTNKTEFKKLSNSMEGKVDGMLRXSDWKPLEKELYLRGVEMFGRNSCLIARNLLSGLKTCMEISSYMHSGGVSMPHGPPVAPSSIMEEKGKFDADCTDQEMPSRSRLLRKRGKTRKFKYSWKSAGHPSIWKRIADGKNQSCKQYTPCGCQSMCGKECTCINGGTCCEKYCGCSKSCKNRFRGCHCAKSQCRSRQCPCFAAGRECDPDVCRNCWVSCGDGSLGEPPRRGEGQCGNMRLLLRQQQRILLAKSDVAGWGAFLKNPVNKNDYLGEYTGELISHREADKRGKIYDRANSSFLFDLNDQYVLDAYRKGDKLKFANHSSNPNCYAKVMLVAGDHRVGIFAKEHIDASEELFYDYRYGPDQAPPWARKPEGSKRDESTAPQGRAKKHQSH

SEQ ID NO: 2483 - protein, 429 aa, Glycine max
MGRSPCCEKTGLKKGPWTPEEDQKLIAFIEKHGHGSWRALPAKARLRRCGKSCRLRWSNYLRPDIKRGKFSLQEEQTIIQLHALLGNRWSAIASHLPKRTDNEIKNYWNTHLKKRLDKMGIDLTTHKPKNESLAYSKDGSNLGHMAQWESARLEAEARLVRESKLQEQQNNLGPMSSPSSTQITRLVLNKITPLQQKQHSLPPCLDVLKAWQSSWSNNNNNINKYSSLNDKKKTMHVRSMYAMMLSNDDLESPTSTLCFPESVQMNNNNNNSNAMVSTDHLGLINENYLLPPTTLDEFIITKSLGTTSSEGAIETVNGGGSDSWRYFTKHNNEEEQVETDEKTIMYDTISCLQDDDGDIMVAVEALRGAGYYDDDNNSNNNNVTFTHLSSNVNNMVGFENDFDSNEDLAAVNLHVNFEENKDYWNGMLN

SEQ ID NO: 2484 - protein, 560 aa, Glycine max
MDSWVRMLFLIACIVPALVECKVRHYKFNVVLKNTTRLCSSKPIVTVNGKFPGPTLYAREDDTVLVKVNNLVNHNVTIHWHGVRQLRTGWADGPAYITQCPILSGQSYLYNFTLTGQRGTLLWHAHVNWLRSTLHGAIVILPKRGVPYPFPKPDKELVVILGEWWKSDTEDVINEALKSGLAPNVSDAHTINGLPGIVSVANCSTQDVYKLPVESGKTYLLRIINAALNEELFFKIAGHPFTVVEVDASYVKPFKTDTLSIAPGQTTNALLTADQNSGKYTIVASTFMDSPVVAVDNLTATATLHYTGTLATTPTLLTTPPPRNATQVANNFTNSLKSLNSKKYPAKVPQKVDHSLLLTVGLGINPCPSCTAGNGSRVVAAVNNVTFVMPTTALLQAHYFNIKGVFTTDFPGNPSHVYNYTATPPAAAWQTTNGTKAYRLAFNSTVQVVLQDTGVIAPESHPVHLHGFNFFVVGSGVGNYDPKTDQNNFNLADPVERNTIGVPTGGWVAFRFRADNPGVWFLHCHFEVHTTWGLKMAFLVDNGKGPNESLLPPPKDLPKC

SEQ ID NO: 2485 - protein, 296 aa, Glycine max
  unsure (1)..(296): unsure at all Xaa locations
MGASLSNLGSNGSAAAPGLGDIPENCVARVFLHLTPPEICNLARLNRAFRGAASADSVWQTKLPRNYQDLLDLMPPERHRNLPKXPYFALLYRGAPFDDGKKEVWXDRGYMXQVCMSISAKAMSITGIDDRRYWTWXPTEQSRFNTVAYLQQIWWFEVDGEFRFPFPADIYTLSFRLHLGRFSKRLGRRVCSYEHTHGWDIKPVRFELSPMDGQQASSECYLDETEPDDLHGNHKRGHWVDYKVGEFIVSGSEPTTKVRFSMKQIDCTHSKGGLCVDSVFIIPRDLRERKRSGILK

SEQ ID NO: 2486 - protein, 191 aa, Glycine max
  unsure (1)..(191): unsure at all Xaa locations
QVASKPFPVAISILLKVEKPLEVILKCKVQSLGGERQFNGLVDVYRKTLASDGVAGLYRGFNISCVGIIVYRGLYFGLYDSVKPVVLTGSLQDSFFASFALGWLITNGAGLASYPIDTVRRRMMMTXSGEAVKYKSSLDAFTQILKNEGAKSLFKGAGANILRAVAGAGVLAGYDKLQVLVFGKKYGSGGA

SEQ ID NO: 2487 - protein, 237 aa, Glycine max
MSSGGGGGGAKPFFCHVCSQRITCSDESEPFCPICMESFVEECNPNNPNPNLFTENEESSDSEISFSLLPLFLSSVSRSRPEPDMFDPMVFLQNHIQGLRADGANIQVDFGHPSEQQGFRLPANIGDYFMGPGLEQFIQQLADNDPNRYGTPPAAKDAVENLPTITVDDELLNSELNQCAVCQDEFEKGSKVTQMPCKHAYHGDCLIPWLRLHNSCPVCRYELPTDDADYENEVSRW

SEQ ID NO: 2488 - protein, 541 aa, Glycine max
MQASEQHRNSSMYYQPLQQIEAYCLPQYRTLNPQLYYHDGGHGTQFSTPSSSELYCTLESSSVALYNSPSTVSFSPNGSPISQQDSQSYPPDQYHSPENTYGSPMSGSCITDDLSSFNLKHKLRELESVMLGPDSDNLDSYDSAISNGNNFVPLEMDGWKQTMVAISSKNLKHILIACAKAISDDDLLMAQWLMDELRQMVSVSGDPFQRLGAYMLEGLVARLAASGSSIYKSLRCKEPESAELLSYMHILYEVCPYFKFGYMSANGAIAEAMKDEDRVHIIDFQIGQGSQWITLIQAFAARPGGPPHIRITGIDDSTSAYARGGGLHIVGRRLSKLAEHFKVPFEFHAAAISGCDVQLHNLGVRPGEALAVNFAFMLHHMPDESVSTQNHRDRLLRLVRSLSPKVVTLVEQESNTNTAAFFPRFLETLDYYTAMFESIDVTLSREHKERINVEQHCLARDLVNIIACEGVERVERHEVLGKWRSRFAMAGFTPYPLSSLVNGTIKKLLENYSDRYRLQERDGALYLGWMNRDLVASCAWK

SEQ ID NO: 2489 - protein, 463 aa, Glycine max
MGGQSSKDSSLVSSSSSSSSSWSAYLDPLSSYGFDEPQPSYSSYGYEAYGGDGMVRYDSAKLERRYSRISDHYSSIDQVTEALARAGLESSNLILGIDFTKSNEWTGKHSFNRKSLHHIGNGLNPYEQAISIIGKTLAAFDEDNLIPCFGFGDASTHDQDVFSFYPDERFCNGFEEVLSQYREIVPNIRLAGPTSFAPIVEMAMTIVEQSGGQYHVLVIVADGQVTRSIDTERGRLSPQEQRTVDAIVEASKFPLSIILVGVGDGPWDMMKEFDDNIPARAFDNFQFVNFTEIMSKNIPPSRKEAAFALAALMEIPSQYKAAIELNLLGSRNANAPQRVALPTPSYGSASMGTSKPYGSASFGASKPYGSASFDAPKPFGSSKPSHPGNFEQSAPSYYDNRDLVGTAPPAPSSTYDNQLCPICLTNSKDMAFGCGHQTCCECGQDLQSCPICRSPINTRIKLY

SEQ ID NO: 2490 - protein, 321 aa, Glycine max
MGSQGGAVQEPKTTTPLARQGSLYNLTLDEVHNQLGNLGKPLGSMNLDELLKSVWSAEAGGGGEASGWDFGVGDATNMPHGKAAASGSSLNPQGSLTLSRDLSRKTVDEVWKDMQLKKVTNRDKKIQERQATLGEMTLEDFLVKAGVVAEALPTKGGAMSGVDSNGAFSQHGHWLQYQPLPAATQLPNVRGGDGAAPAIQQPFQVGVNLVLDAAYSEQPASLMGTLSDTQTPGRKRGASGVVVEKTVERRQKRMIKNRESAARSRARRQAYTQELEIKVSRLEEENERLRRLNEMERALPSVPPPEPKPKQQLRRTSSAIF

SEQ ID NO: 2491 - protein, 114 aa, Glycine max
MEGDTFSGLGNGTQIDSKILQTFKKSFVQVQNILDQNRVLINEINQNHESKVPDNLSRNVGLIRELNNNIRRVVDLYADLSSSFTKSMEVSSEGDSSGAVKSDGKAGHKRHRPL

SEQ ID NO: 2492 - protein, 114 aa, Glycine max
MEGDTFSGLGNGTQIDSKILLTFKKSFVQVQNILDQNRVLINEINQNHESKVPDNLSRNVGLIRELNNNIRRVVDLYADLSSSFTKSMEVSSDGDSSGAVKSDGQAGHKPTRPL

SEQ ID NO: 2493 - protein, 114 aa, Glycine max
  unsure (1)..(114): unsure at all Xaa locations
MEGDTFSGLGNGTQIDSKILLTFKKSFVQVQNILDQNRVLINEINQNHESKVPDNLSRNVGLIRELNNNIRRVVHLHPDLXSSSPQPMAVSPQGDSSGAVKSDGKAGHKRHRPL

SEQ ID NO: 2494 - protein, 468 aa, Glycine max
MKQRQIFARVVILLLMFLVGARFAKAKEGGEEAADRILKLPGQPKVSFKQFSGYVTVNKVAGRALFYWLAEAAQNPLTKPLVIWLNGGPGCSSVAYGASEEIGPFRINKTASGLYKNKFSWNSVANLLFLEAPAGVGFSYTNRSSDLLDTGDRRTAQDSLEFVIQWLERFPRYKTRELYITGESYAGHYVPQLAKEILTYNAKTKHPINLKGIMVGNAVTDNYYDNLGTVTYWWSHAMISDQTYRQLMSTCDFHRQKESDECESVYSYAMDQEFGNIDQYNIYAPPCNNSDGSSSSATRRTMRLPHRPHVDFRHWSGYDPCTEKYAEIYYNRPDVQKALHANKTGIPYRWTACSEVLNRNWNDTDVSVLPIYRELIAHGIRVWVFSGDVDSVVPVTATRYALAQLKLSTKIPWYPWYVKNQVGGWTEVYEGVTFATVRGAGHEVPLFKPRAALQLFKSFLAGKPLPKS

SEQ ID NO: 2495 - protein, 208 aa, Glycine max
  unsure (1)..(208): unsure at all Xaa locations
MYGQSSSSSSSYESDLALLDSIRHHLLGESESIFGAPNFGSGRSSSFSSLDSCLSDNWGELPFKEDDTEDMVLYGVLRDAVNVGWVPSLDAGSPESVSSGFPAVKLEPDLMPALISPCWPXRIAAEEKKVVPAKGKHYRGVRQRPWGKFAAEIRDPAKNGARVWLGTFETAEDAALAYDRAAYRVGTVQEQVGSQVAECTRGEQLLVS

SEQ ID NO: 2496 - protein, 229 aa, Glycine max
MSNNKNNTFFPTPHGQISTSEFVNSQNNPPQATNQGIDDIRKKHYRGVRQRPWGKWAAEIRDPKKAARVWLGTFDTAEAAAMAYDAAALRFKGNKAKLNFPERVVMPIQPQTNNNNSTSSSAPTTQSSSSLPPPQSLHNNSSLSAEGFPNLEEYARLLSCSDDDDFQRVALGLYQHHNNEDFICGSSQPPPVPFFVSSSSSSSAMTSSYSDFLGQGGSTGFDEGNKRGS

SEQ ID NO: 2497 - protein, 424 aa, Glycine max
MAKKAVLIGINYPGTKAELKGCINDVWRMHRCLIDRYGFSEDDITVLIDTDESYTEPTGKNIRSALTRLIRSARPGDVLFVHYSGHGTRLPAETGEDDDTGFDECIVPSDMNLITDDDFREFVDGVPRECKLTIVSDSCHSGGLIDGAKEQIGTSTKGEGQQHSGSGSGFGLSSFLRRSVEDAIESRGARADSARGHHRHKHEHEADDDRDIELPHVDHGYVKNRSLPLSTIIDILKQKTGKNDIDVGKLRLSLYDIFGEDASPKVKKFMKVILNKLQQGDGGSGKQGGILGLVGSLAQEFLKQKIDSSDDGGYAKPAMETKVESKYEAYAGTSSAKPRLSDGGILMSGCQTDQTSADASPAGNSASAYGAFSNAIQAVIEESDGAVTNQEIVLKAREKLKRGGFKQRPGLYCSDDHVDGPFVC

SEQ ID NO: 2498 - protein, 160 aa, Glycine max
MADIEGSPGSSMHGVTGREQTFIASVASPMVPTDTTANFALPVDSEHKAKIFKLFSLANPHMRTFHLSWISFFTCFVSTFAAAPLVPIIRDNLNLTKGDIGNAGVASVSGSIFSRLTMGAVCDLLGPRYGCAFLIMLSAPTVFCMSFVNDAAGYIAVRFM

SEQ ID NO: 2499 - protein, 586 aa, Glycine max
MRPRVAYSFPEEVLEHVFSFIECDKDRGSISLVCKSWYEIERWCRRRVFVGNCYAVSPATVVNRFPKVRSIAIKGKPHFADFNLVPEGWGAYVGPWIKAMAAAYPWLQEIRLKRMVIADECLELIAKSFKNFQVLVLTSCEGFTTDGLAAIAAKCKILRELDLQESEVEEDLSGHWLSHFPDSYTSLVSLNISCLNNEVSLSALERLLGRCPNLRTLRLNRAVPLDRLPNLLLQCPQLVELGTGVYSTEMRPEVFSNLEAAFSGCKQLKSLSGFWDVLPSYLPAVYPICSRLTSLNLSYAIIQSSDLIKLISQCPNLLRLWVLDYIEDAGLYALAASCKDLRELRVFPSDPFGLEPNVALTEQGLVSVSEGCPKLQSVLYFCRQMSNAALHTIARNRTNLTRFRLCIIEPRTPDYLTHEPLDSGFGAIVEQCKDLQRLSLSGLLTDRVFEYIGTCGKKLEMLSVAFAGDSDLGLHHVLSGCDNLRKLEIRDCPFGDKALLANAAKLETMRSLWMSSCLVSYGACKLLGQKMPRLNVEVIDERGPPDSRPESSPVEKLYMYRTVSGPRLDMPGYVWRMQDDSALRIS

SEQ ID NO: 2500 - protein, 359 aa, Glycine max
MANFTSFSSSLTHIPPISAPSSSAAFDDSSEDSCSICLEPFSVHDPSTVTCCKHEYHLHCIIEWSQRSKECPICWQSLALKDPASQELLAAVEDEKCMRSRNIANSRAPLGQLNESHDDSCSDDSDFDDQIMKRLVSAARRAHFVQRQERKRSPSAGPSEALGVNSSMHVSEVQTTLTTSSSGGSLPASGVPSTVSIQPPALNTTPESARRPNTSEISFPESFKSKFSAASARYKESISKSTLGLKEKLLAHNVSVKELSKGVQREMNAGIAGVARMIERLDLSSKRSSAPLIAVHSVATSDFPSSGKSVEENGIGGSPSKENGGAVHDVSSDVPPLVTNMQSFRTKTPPFLQSGHGMV

SEQ ID NO: 2501 - protein, 333 aa, Glycine max; identical to SEQ ID NO: 652

SEQ ID NO: 2502 - protein, 274 aa, Glycine max
MSFVFRGSRGDIESGFSEYVPERTLMRVHPARPVNGNSLAFLITVILIFMILNSPQMLHHFLLWVVLAIFVMATSLRMYATCQQLQAQARAHAAAASGLLGHTELRLHMPSSIAIATRGRLQGLRLQLALLDREFDELDYDTLRALDSDTASSTRSMTEEEINALPIHTYKVPVPPKDGSAGLASSSGAAEIKQASGGTEAGAKGSEDELTCTICLDQVKRGELVRSLPCLHQFHANCIDPWLRQQGTCPVCKLRIGSVSGGNRESESDGSDIA

SEQ ID NO: 2503 - protein, 545 aa, Glycine max
MVGVDQSNMNMNRNSGVFGSSSGGALRPPNRLNNQMGVAENQNQKPYGMPPSHPNTNISPSSPYPQFLGSQSQSNSVSQRLGSPNLSPASSHSRSLSQPSFFSLDSLPPLSPSPYKEPSFSDSISTDVSAEESLPTSHAPLPNRGHALQLGHSLPPRKGHRRSSSDSPLGIADFIQSAPNNRENSASRGGNSGFEKPIQLVLKEPIKDMDRVDGFGGEPMVGRKEDDALDDLFSAYMNLDNIDGLNFSGMEDKDLDSRTSGSKTVESSDNEVESHANGKVTGSQGASSRCSEERREGVKRSSNGDVAPGSRHRRSFSLDSSIGNFHIGDESPKLPPSQNRFGQHSPSSSIDGKTSETSMEFGNGEFSSEELKKIKENDKLAEIAMADPKRAKRILANRLSAARSKERKMRYISELELKVQTLQTETTTLSTQFTKLQMDNSELKSENNEYKLRIQALEQQSQLKDALNETLDAEVRRLRRTVAELGGESLLSSRMAQQLAISQQVFQLQHQQHPNQLRHVQLDNSHSQEQTQTQSQCHNGKATAY

SEQ ID NO: 2504 - protein, 345 aa, Glycine max
MSGLIEGLPDAVAIRCLARVPFYLHPVLELVSRSWQAAIRSPELFKARQEVGSTEDLLCVCAFDPENLWQLYDPMRDLWITLPVLPSKIRHLSNFGAVSTAGKLFVIGGGSDAVDPLTGDQDGCFATDEVWSYDPVVRQWAPRASMLVPRSMFACCVLNGKIVVAGGFTSCRKSISQAEMYDPDKDVWIPMPDLHRTHNSACSGVVIGGKVHVLHKDLSTVQVLDNAGPGWTVEECVWLQGQMAVVGDALYVMSHGLIFKQDKEVRKVVGSASEFRKRIGFAMTGLGDDLYVIGGFIGPDRWNWDIKPLSEVDVLTLGSERPTWRQAAPMTRCHGPILGCTLLRI

SEQ ID NO: 2505 - protein, 342 aa, Glycine max
MAFPQHHFQQHYQTQQQQQPQNKSFRNLQTIDGQMSQQVAFYNPTDLQDQSQHPSYIPPFHVVGFAPGPVPPADGSDGGVDLQLQWNYGLEPERKRLKEQDFLENNSQISSVDFLQPRSVSTGLGLSLDNTRLTSTGDSALLSLIGDDIERELQQQDAEIDRFLKVQGGRLRQAVLEKVQATQLQSVSLIEDKILQKLREKEAMVESINKRNIELEDQMEQLTVEAGSWQQRARYNENMIAALKFNLQQAYVQSRDSKEGCGDSEVDDTASCCNGRSLDFHLLSRENTDMKEMMTCKACRVNEVTMVLLPCKHLCLCKDCESKLSFCPLCQSSKFIGMEVYM

SEQ ID NO: 2506 - protein, 322 aa, Glycine max
FSCGNDYALKVRKPYTITKQRERWTDEEHKKFLEALKLYGRAWRRIEEHVGTKTAVQIRSHAQKFFSKLLRDPTGNNTNTVESIEIPPPRPKRKPVHPYPRKLVETPNKEILIPEQLMKSNSLKSSDFDQENQSPKSVLSGVGSDSLGSSDSDTPYGSLSPMSSISGIHTSSFTRAEHKTTSDEAGMDTDSAHDEKPLMKFKLPPNECVSIKDDTAEESSGRTFKLFGMTLFVTDTCKPSPTIEACKPIPLNIRVRCLSSSMGDDGKLELRGHSTASETSAISKLKVRVGPEACGKGFVPYKRCISVVTADNREEQCIHLSL

SEQ ID NO: 2507 - protein, 166 aa, Glycine max
  unsure (1)..(166): unsure at all Xaa locations
MEVQIPIHTVFDVPSLLQAVAADTVLAAAQSIALIGYLLTNDTNSVSPNLTAANGRFPLEDLFGRKHAYLENKNSETEDDDEDGDEDDEDGHDQDDDGEDEEFSGEEGDEKGDPEDDPEANGGGSDDDDDDDNDNEEDDDDGEDEEEEEXEEDDEETSQPPTKKRK

SEQ ID NO: 2508 - protein, 561 aa, Glycine max
VGPPDRIPVASVAGSAAGFRCHVRPPPSLIKSSGPLNEHVAPTVGSGPFLLPSGTANGFLGEETDGRPGCSLDTRRVSCKRKAVERNVGQSSDGGSSSYSQHTDGSTWNTLPTQAYGGISFNRSAPTDQVNARLGLSTGDGSSESIPVSNVARSSGSFHRNFRPRTSPSSQQISVPPTAISSGNVIRSSGVSSPSPILQRFHPVDNSFDLRAVPPVDTMVPQSQPLVIHVPALPRNAQSFRWSGGSSSTNNHSSNSVMCADRNNLPNEEASSRSMPRNIIEYPMFVPATNLRNVVRNPARTSNNANLSIPGNVGSSSRTGSNPAVNPPPASAWVSRPNPQQYPRRLSEYVRRSLFSPGLEAAGSSSNSYTPFRGPPTSSESRGLSSGVNPFERQGDSEFGIPYSLQSLVVAGEGSSRLVSELRNVLGLMRRGGNLRFEDVMILDPSVFSGIADIHDRHRDMRLDVDNMSYEELLALEERIGNVSTGLSEEIVSKLLKKKKYSAEPDSQHEAEPCCVCQEEYKDGDDLGSLDCGHDYHRDCIKQWLMHKNLCPICKTTGLAT

SEQ ID NO: 2509 - protein, 336 aa, Glycine max
MENSTEESHLRSENSVTYESPYPIYGMSFSPSHPHRLALGSFIEEYNNRVDILSFHPDTLSVTPHPSLSFDHPYPPTKLMFHPRKPSPSSSSDLLATSGDYLRLWEIRDNSVDAVSLFNNSKTSEFCAPLTSFDWNDIDPNRIATSSIDTTCTIWDIERTLVETQLIAHDKEVYDIAWGEARVFASVSADGSVRIFDLRDKEHSTIIYESPHPDTPLLRLAWNKQDLRYMATILMDSNKVVILDIRSPTTPVAELERHRGSVNAIAWAPHSSTHICSAGDDTQALIWELPTLASPTGIDPVCMYSAGCEINQLQWSAAQPDWIAIAFANKMQLLKV

SEQ ID NO: 2510 - protein, 576 aa, Glycine max
MVTMGLKALFVWCIIWLAFAQLSLGGRVRHYKFDVEYMIRKPDCLEHVVMGINGQFPGPTIRAEVGDILDIALTNKLFTEGTVIHWHGIRQVGTPWADGTAAISQCAINPGETFQYRFTVDRPGTYFYHGHHGMQRSAGLYGSLIVDLPKGQNEPFPYDGEFNLLLSDLWHTSSHEQEVGLSSKPFKWIGEAQTLLINGRGQFNCSLASKFINTTLPQCQLKGGEECAPQILHVEPNKTYRIRIASTTALASLNLAISNHKLVVVEADGNYVTPFAVDDIDIYSGESYSVLLRTDQDPNKNYWLSIGVRGRKPNTPQGLTILNYKPISASVFPTFPPPITPLWNDFERSKAFTKKIIAKMGTPQPPKRSDRTIFLLNTQNRVDGFTKWAINNVSLTLPPTPYLGSIKFKIKNAFDKTPPPVTFPQDYDIFNPPVNPNASIGNGVYMFNLNEVVDVILQNANQLSGSGSEIHPWHLHGHDFWILGYGEGKFKSGDEKKFNLTHAPLRNTAVIFPYGWTALRFKADNPGVWAFHCHIEPHLHMGMGVIFAEAVQKVGKIPRDALTCGLTGKMLGNRHY

SEQ ID NO: 2511 - protein, 569 aa, Glycine max
MEALKTLFLAIFVVLASALYSANAKIQEHEFVIQATPVKRLCNTHSTITVNGQFPGPTLEVNNGDTLVVKVTNKARYNVTIHWHGIRQMRTGWADGPEFVTQCPIRPGESYTYRFTIQGQEGTLWWHAHSSWLRATVYGALIIHPREGEAYPFTKPKRETPILLGEWWDANPIDVVRQASQTGAAPNISDAYTINGQPGDLYKCSSQGTTIVPIDSGETNLLRVINAALNQPLFFTVANHKLTVVGADASYLKPFTTNVIMLGPGQTTDVLIQGDQPPTRYYMAARAYQSAQNAPFDNTTTTAILEYKSAPCPAKGSSIKPVMPSLPAYNDTNTVTAFSKSFRSPRKVEVPAEIDDNLFFTIGLGLNNCPKNFNANQCQGPNGTRFTASMNNVSFVLPNNVSILQAHHLGVQGVFTTDFPTQPPVKFDYTGNVSRSLWQPVQGTKVTKLKFGSRVQIVLQDTSIVTPENHPIHLHGYDFYIVAEGFGNFDPNKDTSKFNLVDPPMRNTVAVPVNGWAVIRFVADNPGAWIMHCHLDVHIGWGLAAVLLVDNGVGLLQSIEPPPEDLPLC

SEQ ID NO: 2512 - protein, 236 aa, Glycine max
  unsure (1)..(236): unsure at all Xaa locations
MDRVIQPPLVDTTACLCRVDTGLKTVAGAKKYVPGTKLCLRPDIKPSIHPTRNKPARGDRSRSQSPLLPGLPDDLAIACLIRVPRVEHRKLRLVCKRWYRLLVGNFFYSLRKSLGIAEEWIYVIKRDRDGKISWHXAFDPVYQLWQPLPPVPKEYSGALGFGCAVLNGCHLYLFGGKDPLKGSMRRVIFYSARTNKWHRAPNMLCRRHFFGSCVINNCLYVAGGENEGVHRSLRSG

SEQ ID NO: 2513 - protein, 139 aa, Glycine max
  unsure (1)..(139): unsure at all Xaa locations
ARAIYDGLVSGWRNPSTTLNGKLYALDCKDGCKIRVYDEVADSWSKHIDSKLHLGSSRALEAAALVPLNGKLCIIRNNMSISLVDVSKLEDLKGSSAEQLWETIAGKGQFKTLVTNLWSSLAGRXRLKTHIVHCQVLQA

SEQ ID NO: 2514 - protein, 144 aa, Glycine max
  unsure (1)..(144): unsure at all Xaa locations
MDRLKSSPQLMIVSDLDHTMVDHHDSENWSLFRFNALWEAHYRQDSLLVFSTGRSPTLYKQLRKEKPLITPDIAIMSVGTEITYGKSMVPDDGWVRCLNQKWDKDIVIEETSKFPEPKRQAETEQRPHKGSFYVERXQAKHXTE

SEQ ID NO: 2515 - protein, 147 aa, Glycine max
  unsure (1)..(147): unsure at all Xaa locations
MDRLKSSPQLMIVSDLDHTMVDHHDSENWSLFRFNALWEAHYRQDSLLVFSTGRSPTLYKQLRKEKPLITPDIAIMSVGTEITYGKSMVPDDGWVRCLNQKWDKDIVIEETSKFPELKRQAETEQRPHKVSXFYVEKDKAKHVTETL

SEQ ID NO: 2516 - protein, 176 aa, Glycine max; identical to SEQ ID NO: 679

SEQ ID NO: 2517 - protein, 256 aa, Glycine max
MNDYKGREGESSVVVVRKRFKEKQQPCPSTRPIINQQHRRSASLPNTQYEESETDVEVSDVSVSEGDDTSWISWFCNLRGNEFFCEVDDDFVQDDFNLCGLSSQVPYYDYALDLILDVESSHGDTFTEDQNELIESAAEMLYGLIHARYILTSKGMAAMLHKYKNYNFGRCPRVFCSGQPCLPVGQSDVPRSSTVKIYCPRCEDMYHPKSKYQDIDGAYFGATFPHLFLMTYGNLKPQKQSQNYVPRVFGFKVHKS

SEQ ID NO: 2518 - protein, 435 aa, Glycine max
  unsure (1)..(435): unsure at all Xaa locations
MGADKFEALTMIGKAACGEVRVCRXKATGHVYAMKKLKKSERLRIGQVEHVKAERNLLAEVDSNCIVKLYYSFQDEEYLYLIMEYLPGGDMMTLLMRKDILTEDEARFYVGETVLAIESIHKHNYIHRDIKPDNLLLDRNGHMKLSDFGLCKPLDCSNLQEKDFSVGMNRSGALQSDGRPVAPKRTQQEQLQHWQKNRRMLAYSTVGTPDYIAPEVLLKKGYGVECDWWSXLGAIMYEMLVGYPPFYSDEPMLTCRKIVNWRTTLKFPEEAKLSAEAKDLICRLLCNVEQRLGTKGADEIKAHPWFKGVEWDKLYQMKAAFIPEVNDELDTQNFEKFEEADNQTLPSSKSGPWRKMLPSKDVNFVGYTYKNYEIVNDPEIPEIAELKKKSTKPKRPSIKSLFDDESATAANQPVRGSFLNLLPPQMEVPEKSESQ

SEQ ID NO: 2519 - protein, 503 aa, Glycine max
  unsure (1)..(503): unsure at all Xaa locations
MVLSKTASETDVSVHSTFASRYVRTSLPRFKMAEESIPKEAAYQIIHDELMLDGNPRLNLASFVTTWMEPECDKLIMAAINKNYVDMDEYPVTTELQNRCVNMIAHLFNAPLEESETAVGVGTVGSSEAIMLAGLAFKRRWQNRRKLEGKPYDNPNIVTGANVQVCWEKFARYFEVELKEVKLRDGYYVMDPEKAVEMVDENTICVAAILGSTLNGEFEDVKLLNDLLVEKNKETGWDTPIHVDAASGGFIAPFLYPELEWDFRLPLVKSINVSGHKYGLVYAGIGWVIWRSKEDLPEELIFHINYLGADQPTFTLNFSXGSSQVIAQYYQLIRLGYEGYKMVMENCNDNMAVLKEGLEKTGRFEIISKDIGVPLVAFTLKDHTHFNEFQISDMLRRYGWIVPAYTMPPDAQHVTVLRVVIREDFSRTLAERLVIDVTKVVHELDLLPARVISTNTIMVTGEAGEENDEKVLFAKKSEIETQREITKAWKKFVMDRKKMNGVC

SEQ ID NO: 2520 - protein, 77 aa, Glycine max
SAEAALPFVGFAVAMFMFYSLVPVLLKINGSTMLNLSLLTSDMWAVLIRIFAYHEKVDRMYFESFGAVTIGLIIYSE

SEQ ID NO: 2521 - protein, 385 aa, Glycine max
MELSSIKDAFDRVAKKQKLSSSKSQEVVDQVGCEIEQALATIQSSHDPSAPVDQKSVLTELKFKLNAIGPLQQLEGSNKELNISLTKYQKLLEKLLNPDISKAYRNVDFDTHIVDQIIANHFYRQGLFDLGDSIINEAGEPDAAALRSQFLEMHQIIGAMRERNLQPALTWVSANREKLVQIGSNLELKIHTLQFVEVLQNGTRADALKYARTYLAPFASLNKGEFPKLMGCLLYAGRLESSPYSELLSPIHWEMTTEELTRQFCTLLGQSYENPLSVAVAAGVEGLPTLLKLANVMAAKKQEWQEMKQLPVPVELGKEFQFHSIFVCPVSRDQGSEENPPMLLPCLHVLCKQSIMKLSKNSTRTFKCPYCPAEATVANCKQLYF

SEQ ID NO: 2522 - protein, 479 aa, Glycine max
  unsure (1)..(479): unsure at all Xaa locations
MEARSAFSIDRSNAKQLNDMGMSEAFPSSLPALPSPLEETFPKLSDSRPAFMEKELKTKPFTHSSHLTSSGAVGHMFSSSPGYSTDLHHSSFSSHEKQPRNTHFISQSLSNMASLPLSYSSNSEPIPSTTSTPYSNGNSVSWHTDSLPSFLDFPANTSIGNSQVESSDCNIMATEEYSKRNDWQEWADQLISDVDPLTSNWNDLLADNIQDLEPKVAKSSSQLPIGHQSQSHQQLPASSGENRVGVAPTSSTNSAPAKPRMRWTPELHEAFVEAVNQLGGSERATPKGVLKLMKVDGLTIYHVKSHLQKYRTARYRPESSEGAAEKKLSPIEEMSSLDLKTGIEITXEALRLQMEVQKRLHEQLEIQRNLQLRIEEQGRYLQMMFEKQCKPGIETCKAPSSVIETPSGGSSDATKDSPAKTEMEASQVNHGRSGPDQVKGSTTFEEGSLEKCGKPDSPKTEHAIASEDSAQAPKRQRTE

SEQ ID NO: 2523 - protein, 573 aa, Glycine max
  unsure (1)..(573): unsure at all Xaa locations
MMMNYFPDEVRKHIFDYKVSHSDRIALSLVCKSWYRIVRCSRXKVFIGNCYSITPERLIQRFPGLKSLTLKGKPHFADFSLVPYDWGGFVHPWIEALAKNKVGLEELRLKRMVVSDESLELLSRSFTHFKSLVLVSCEGFSTDGLAALAANCRFLRELDLQENEVEDHKGQWLSCFPDNCTSLVSLNFACLKGEVSLGALERLVARSPYLKSLKLNRSVPFDALQRIMMRAPQLSDLGIGSFVHDPESEAYIKLKNTILKRKSITSLSGFLEVAPHCLAAIYPICPNLTSLNLSYAAGIQGSDLIKLIRHCVKLQRLWIMDCIGDKGLGVVATSCKDLQELRVFPSVPFGDPAAVTEKGLVAISMGCPKLHSLLYFCHQMTNAALITVAKNCPNFIRFRLCILDATKPDPDTMQPLDEGFGAIVQSCRRLRRLSLSGQLTDQVFLYIGMYAEKLEMLSIAFAGDSDKGMLYVLNGCKKLRKLEIRDCPFGNVALLTDVGKYETMRSLWMSSCEVTVGACKLLAKKMPRLNVEIFNENEQEDCSLEDGQKVEKMYLYRTLAGKRKDAPEYVWTL

SEQ ID NO: 2524 - protein, 269 aa, Glycine max
  unsure (1)..(269): unsure at all Xaa locations
LRMWNFASSLIAGSVGLKNDSPKPTHSASEFSDDETSMVSREERLECPICWESFNIVENVPYVLWCGHTLCKNCILGLQWAVVKFPTLPIQLPLFISCPWCNLLSLRLVYRGNLKFPRKNYFLLWMVESMNGDRVKSHSTVCGGSSTSLANNXDSLTNGSQVTHGNLRRGVVPHPDTSSSNQYHGNTGNHLNTERFHVYLRKSLIFFVQLTAKFPLVIIFLLIVLYAIPASAAILALYVLVTILFALPSFLILYFSYPSLDWLVREIIT

SEQ ID NO: 2525 - protein, 109 aa, Glycine max
MSGVWVFKNGVVRLVENPGGEAVEGSRGGRRKVLVHRASNEVITSYAVLEQKLYSLGWERYYDDADLLQFHKRSTVHLISLPRDFNKFKPMHMYDIVVKNKNAFEVRDM

SEQ ID NO: 2526 - protein, 109 aa, Glycine max
MSGVWVFKNGVVRLVENPGGEAVEGSRGGRRKVLVHRASNEVITSYAVLERKLYSLGWERYYDDPDLLQFHKRSTVHLISLPRDFNKFKPMHMYDIVVKNKNAFEVRDM

SEQ ID NO: 2527 - protein, 321 aa, Glycine max
MAVEFMMGYRNDTFAEDNAVREAASGLESVEKLIKLLSHTQQQYQTTSKSSMENIDTDYTAVADVAVSKFKKVISLLGRTRTGHARFRRAPVPVPVPVASPPPSEPRVYRATPLQQIPPPTLHTHSVTDHSLIPKIERKDSSKTINFSYSNSFVSSLTAGDTDTKQPCSSSPSPATAFQITNLSQVSSAGKPPLSSSSLKRKCSSENLGSAKCGSSSSRCHCSKKSRKMRQKRVVRVPAISLKMADIPPDDYSWRKYGQKPIKGSPHPRGYYKCSSVRGCPARKHVERALDDPSMLVVTYEGEHNHTLSAAEATNLILESS

SEQ ID NO: 2528 - protein, 509 aa, Glycine max
MAEGKTATQKSLQDFDPQKTPRRNKYAFACAILASMTSILLGYDVGVMSGAIIYIKRDLKLTDVQIEILVGIINLYSLIGSCLAGRTSDWIGRRYTIVLAGSIFFAGAILMGISPNYPFLMFARFIAGVGIGYALMIAPVYTTEVSPPSCRGFLTSFPEVFINGGILLGYISNYGFSKLSLELGWRMMLGVGAVPSVILALGVLAMPESPRWLVMRGRLGEATKVLNKTSDSKEEAQQRLADIKAAAGIPESCTDDSVQVTNRNHGGGVWKEFFLYPTPAVRHILIAALGIHFFQQASGIDAVVLYSPEIFKKAGLESDGEQLLATVAVGFAKTVFILVATFLLDRVGRRPLLLTSVGGMVFSLLTLGLSLTVIDHSRAVLKWAIGLSIGMVLSYVSTFSVGAGPITWVYSSEIFPLRLRAQGAAMGVVVNRVTSGVISMTFLSLSNKITIGGAFFLFGGIAMCGWIFFYTMLPETQGKTLEEMEGSFGKFASWSKGKDGDNGDIQLAN

SEQ ID NO: 2529 - protein, 325 aa, Glycine max
  unsure (1)..(325): unsure at all Xaa locations
NIGSDDVETTLYSIGSRLKAFSDWLLKYMVSGNLDTIFPAATREYGPMVEGLWKDXEIIWPCITSINNRFSSKSXFISHMQAVEISKTDYEPSDTDILYAEGISLSNSLTSMEFCFPKSNSEDSLFPEYQHESSLRYQLIRVHPKSLGENCKWLEMFEETDVVMFSVALSDYDEYTTDSKGVSTNKMLVAKNLFENIISHRSFHNKKFLLVLTKFDLLEEKIEHIPLAQCEWFSDFQPFISPNQKKGCSNGNNNSSLAQCAFQYIAVKFKRLFLSITGRILFVSLVNGLEPDTIDEALRYGREVMEWEKWDPSIELIQVRESSQA

SEQ ID NO: 2530 - protein, 244 aa, Glycine max; identical to SEQ ID NO: 1124

SEQ ID NO: 2531 - protein, 275 aa, Glycine max
  unsure (1)..(275): unsure at all Xaa locations
SNKDIVAQIISASIAGDLVLATAYSHELPRYGLEVGLTNYAAGAVFMRNSFLSHPRLTQFFLNSCLMFXYLCPAYCTGLLLARRVLKTLEMDEEYEGNVEATGEDYSVEPAESRRPFRALLDVGLVRTTTGNRVFGALKGALDGGLDIPHSDKRFAGFDKEKKEXLDAEVHRKYVFGGHVAAYMKILAEDEPEKYQSHFSEYIKRGIEADGIEALYKKVHAAIRADPTLRKSDKQPPKEHKRYNMKKLTYEERKAKLVARVAAINSAADNDEDDE

SEQ ID NO: 2532 - protein, 243 aa, Glycine max
SNKDIVAQIISASIAGDLVLATAYSHELPRYGLEVGLTNYAAAYCTGLLLARRVLKTLEMDEEYEGNVEATGEDYSVEPAESRRPFRALLDVGLVRTTTGNRVFGALKGALDGGLDIPHSDKRFAGFDKEKKELDAEVHRKYVFGGHVAAYMKILAEDEPEKYQSHFSEYIKRGIEADGIEALYKKVHAAIRADPTLRKSDKEPPKEHKRYNMKKLTYEERKAKLIARVAAINSAADSDEDDE

SEQ ID NO: 2533 - protein, 390 aa, Glycine max
  unsure (1)..(390): unsure at all Xaa locations
MERKIIDFDQGWDYMQKGITKLKRILEGAPETPFSSEEYMMLYTTIYNMCTQKPPNDFSQQLYDKYKDAFDEYINTTVLPSLREKHDEFMLRELVQRWLNHKVMVRPLSRFFHYLDRYFISRRSLPGLGAVGLTCFRESVYMEVRVNARKAVIALIDKEREGEQIDRSLLKNVLDIFVEIGMGEMGQYEQDFEVHMLEDTADYYKSKAANWIEIDSCPDYMLKAADCLRRERDRVSHYLHCSTEQKLVEKVQQELLVTHANQLLEKENSGCHALLRDDKVEDLSRMYRLYHKIPKGLDPVANVFKQHITGEGTSLVQQAEEATSNQTTNGSGFQEQVLVRKFLEXHDKYMVYVNDCFMNHTLFHKALKEAFEIFCNKTVAGSSSAELLST

SEQ ID NO: 2534 - protein, 390 aa, Glycine max
  unsure (1)..(390): unsure at all Xaa locations
MERKIIDFDQGWDYMQKGITKLKKILEGAPETPFSSEEYMMLYTTIYNMCTQKPPNDFSQQLYDKYKDAFDEYIKITVLPSLREKHDEFMLRELVQRWLNHKVMVRWLSRFFHYLDRYFISRRSLPGLGAVGLTCFRDSVYMEVRVNARKAVIALIDKEREGEQIDRSLLKNVLDIFVEIGMGEMGQYEQDFEVHMLEDTADYYKSKAANWIEIDSCPDYMLKAEDCLRRERDRVSHYLHCSTEQKLVEKVQLELLVTHANQLLEKENSGCHALLRDDKVEDLSRMYRLYHKIPKGLDPVANVFKQHITVEGTSLVQQAEEATSNQTTNGSGFQEQVLVRKFLEXHDKYMVYVNDCFMNHTLFHKALKEAFEIFCNKTVAGSSSAELLST

SEQ ID NO: 2535 - protein, 217 aa, Glycine max
MKFCKTYQQYMQGHGHNKLPSVGFKNLKKIIKSCRRAYTQPTCPDHCPVCDGTFFPSLLNEMSDIVGCFNQRAQQLLELHLASGFRKYFLMLKGKLHKNHTALIEEGKDLVIYALINSIAIRKILKKYDKIHYSKQGQLFKSKVQTMHKEILQSPWLCELIALHINLRETKAKPREASALFYGCYLTFNDGKPSLTCELFDSVKIDFDLTCSICLVS

SEQ ID NO: 2536 - protein, 313 aa, Glycine max
MYSRLIHPHDGIVTQDDLQGAASNLSHAHKGDPCLVLTADPKPRLRWTQDLHERFVDAVTQLGGASKATPKAIMRTMNVKGLTLFHLKSHLQKYRLGKQSGKDVGEGCKDGSYLLESPGADNSSPKLPTSDTNEGYEIKEALRAQMEVQSKLHLQVEAEKHLQIRQDAERRYMAMLERACKMLADQFIGATVIDTDSQKFQGIGSKAPRGTLVDPLGFYSMPSTEVAGVNVPEEEIPLSLPPQRADCSTESCLTSHESSGGLALEGSPGEGKRRMLGMDSMAAPLIWSEAKMRTQAINVAQGNLPQGITRYGM

SEQ ID NO: 2537 - protein, 143 aa, Glycine max
MMAMEGQQPQSSSENGRESEDYGEEGREKGPHPLAQAGTGSFPGGFIGKHRLQAAITNLNNQISILQEELKKVETIGESSTVCKDLISSVESTPDPLLPFTKGSVDAGWDRWFGGSPPLSKSQTLDLDILFCIYLYFLVTMNI

SEQ ID NO: 2538 - protein, 131 aa, Glycine max
MIAMDGHQPQPSSETLASENGRESEDYGEEGREKGPHPLAQAGTGSFPGGFIGKHRLQAAITNLNNQISILQEELEKVETIGESSTVCKDLISSVESIPDPLLPFTKSSVDAGWDRWFGGAHHSRNHKRWI

SEQ ID NO: 2539 - protein, 584 aa, Glycine max
  unsure (1)..(584): unsure at all Xaa locations
MGLCHGKPIETSQSEGGHHAFPGGEKDAVVVSAAGPKTATKGRSFRPSPLPSXFKNSPSSNSNPSSVSSTPLRIFKRPFPPPSPAKHIRALLARRHGSVKPNEAAIPEGSECEVGLDKSFGFAKQFSAHYELSDEVGRGHFGYTCSAKGKKGAFKGVDVAVKVIPKAKMVTAIAIEDVRREVKILRALTGHKNLVQFYEAYEDDANVYIVMELCKGGELLDRILSRGGKYSEEDARVVMIQILSVVAFCHLQGVVHRDLKPENFLFTSKDDKSTLKAIDFGLSDYVKPDERLNDIVGSAYYVAPEVLHRSYGTEADMWSIGVIAYILLCGSRPFWARTESGIFRAVLKADPSFDEAPWPSLSVDAKDFVKRLLNKDYRKRLAAAQALSHPWLVNHHDDMRIPLDMIIHKLVKAYICSSSLRKSALRALAKTLTVAQLTYLRDQYTLLGPNKSGLISMQNFKTAVLRSSTDASKDSRVLEYVSMVSSIQYRKLDFEEFCAAAISVHQLEGMETWEQHARRAYELFEKEGNRPIMIEELASELGLSPSVPVHVVLQDWIRHSDGKLSFLGFVRLLHGVSARAFQKA

SEQ ID NO: 2540 - protein, 545 aa, Glycine max
SRSTQRPPKPSPHWFKNSPSSNSNPSSVSSTPLRIFKRPFPPPSPAKHIRALLARRHGSVKPNEASIPEASECELGLDKSFGFAKQFSAHYELSDEVGRGHFGYTCSAKGKKGAFKGVDVAVKVIPKAKMTTAIAIEDVRREVKILRALTGHKNLVQFYEAYEDDANVYIVMELCKGGELLDRILSRGGKYSEEDARVVMIQILSVVAFCHLQGVVHRDLKPENFLFTSKDDKSSLKAIDFGLSDYVKPDERLNDIVGSAYYVAPEVLHRSYGTEADMWSIGVIAYILLCGSRPFWARTESGIFRAVLKADPSFDEAPWPSLSVDAKDFVKRLLNKDYRKRLTAAQALSHPWLVNHHDDMRIPLDMIIHKLVKAYICSSSLRKSALRALAKTLTVAQLAYLRDQFTLLGPNKSGLISMQNFKTAVLRSSTDASKDSRVLDYVSMVSSIQYRKLDFEEFCAAAISVHQLEGMETWEQHARHAYELFKKEGNRPIMIEELASELGLSPSVPVHVVLQDWIRHSDGKLSFLGFVRLLHGVSSRAFQKA

SEQ ID NO: 2541 - protein, 282 aa, Glycine max; identical to SEQ ID NO: 1896

SEQ ID NO: 2542 - protein, 184 aa, Glycine max
MGGCCCSARKPHLQGAPVYYYCPPTFEERESLTSNNGTNASVNAGFLIGLNLEASMPDTFQSPPVPLPYDMVLGGSASTYSESGRETVSSFETSITLEDVEESDCKAQANSAPTSPKKAQLSKSNVTQELVTEEEDVCPICLEEFDVENPSNLTKCEHHFHLSCILEWMERSDSCPICDQEMIF

SEQ ID NO: 2543 - protein, 191 aa, Glycine max
  unsure (1)..(191): unsure at all Xaa locations
MGGCCCSARKPHLQGAPVYYYCPPTFEERESLTSNDGLNASVNAGFLVGLNLEASMPDTFQPPPVPLPYDMVLGGSASTDSESGRETVSSFETSITLEDVEESDCKAQANSAPTSPKKAQLSKSNVTQELVTEEEARAXCPICLDEFDVENPRTLTXCGHHFHLTCILEWMERTDFCPICNLEMICDQTLN

SEQ ID NO: 2544 - protein, 323 aa, Glycine max
MTTFMDMYNTTSSIMTPDFLDQCSDQELMKALEPFMKSDSSSTTSSSITTYPSFSSFSSSPNLSSTTWSTQFCSSSYHQKGPTPTQASSFKLNQLTPSQIFQIQTQIQVPRAQVLSPKPITMKHVRASPSSKPTKLYRGVRQRHWGKWVAEIRLPKNRTRLWLGTFDTAEEAALAYDNAAFKLRGENARLNFPHLRHHGARAYGEFGNYKPLPSAVDAKLQAICQSLGTNSQKLKTQNPIVLDTHKAETETSEFQDFNKVENYQTSSSSAFSDEYSSSSSSSSPESDITLLDFSDSCETMDNLGLDLEKYPSVEIDWAALSDS

SEQ ID NO: 2545 - protein, 191 aa, Glycine max
MGGCCCSARKPHLHGTPVYYYCPPTLEEHESLTSNDGTATSLTTGLLVGLNLETSTPDTYHPPPAPLPYDMVLGGPASTDSESGRETVSGSSFETLITCKDPEESDCKIKANSAPISPSKAGLSKSKEFHALVTEEEDGCPICLEEYDVENPKTLTKCEHHFHLSCILEWMERSDSCPICDQEMIFDQTLN

SEQ ID NO: 2546 - protein, 172 aa, Glycine max
  unsure (1)..(172): unsure at all Xaa locations
MSGLIEGLPDAVAIRCLAWVPFYLHPKLELVSRAWRAVVRGPELFKARQELGSSEDLLCVCAFEPENLWQLYDPLRDLWITLPVLPSRIRHLSHFGAVSTAGKLFVIGGGSDAVDPLTGDQDGCFATNEVWSYDPVVRQWSPRAAMLVPRSMFACCVMNGKIVVAXGGFTSC

SEQ ID NO: 2547 - protein, 321 aa, Glycine max
  unsure (1)..(321): unsure at all Xaa locations
MAGNDWLNSYLEAILDVGPGLDDAKSSLLLRERXGRFSPTRYFVEEXVIGFDETDLYRSWVRASSTRSPQERNTRLENMCWRIWNLARQKKQLESETAQRVNKRRLERERGRREATADMSEDLSEGEKGDPVSDVSAHGGDAANXRARLPRISSADAMETWANSQKGKKLYIVLISIHGLIRGENMELGRDSDTGGQVKYVVELARALGSMPGVYRVDLLTRQVSAPDVDWSYGEPTEMLSPRDTDDFGDDMGESSGSYIVRIPFGPRDKYIPKELLWPYIPEFVDGALNHIIQMSKSLGEQIGSGHAVWPVAIHGHYADI

SEQ ID NO: 2548 - protein, 275 aa, Glycine max
  unsure (1)..(275): unsure at all Xaa locations
SRLIRLSGYCNLDWGTEXTKDADRNGPKGIISAVGISIVVGWGYILGITFAVTDILYLLSEDNDAGGYAIAQVFYQAFKKRYGHGTGGIICLVIVAVAIFFCGMSSVTSNSRYINVLPLSAFFIDGAMNFSXISLWHIVNKQEVPIYAVWLSVFISFCMALTSLGSIVAFEAMVSIATIGLYIAYAFPIFLRVTLARKHFVSGPFNLGRYGVVVGWVAVLWVLTISVLFSLPVSYPITIKTLNYTPVAVGCLLILVVSYWLISGRRWFKGPITNI

SEQ ID NO: 2549 - protein, 160 aa, Glycine max
MGFPVGYTELMLPKVFLQVLSVLGLIRKLITVLLCYMGFHDFFESDIAWPERAPEFQSVWAVLIREILPVVKFSEMEMEMAEAPESCAVCLYEFEGEDEIRRLTNCRHIFHRGCLDRWMGYDQRTCPLCRTPFIPHHMQAAFNDRLWAASGIPDFYYNHE

SEQ ID NO: 2550 - protein, 299 aa, Glycine max
  unsure (1)..(299): unsure at all Xaa locations
MVYVKSQKSKAYFKRYQVKFKRRREGKTDYRARIRLINQDKNKYNTPKYRFVVRFSNKDIVAQIISASIAGDIVLAAAYAHELPRYGLEVGLTNYAAAYCTGLLLARRVLKTLEMDEEYEGNVEATGEDYSVEPAESRRPFRALLDVGLIRTTTGNRVFGAXLKGALDGGLDIPHSDKRFAGFDKEKKELDAEVHRKYVFGGHVAAYMKILAEDEPEKYQSHFSEYIKRGIEADGIEALYKKVHAAIRADPSLKKSEKQPPKEHKRYNLKKLTYEERKAKLIARVAAINSAADNDEDDE

SEQ ID NO: 2551 - protein, 499 aa, Glycine max
LTTKSHRFVLLSYIAIAIAMEAKLWESPLLSPSLPLLPSLNLHFPSSTRLLARSFFSDTVPIDNKEKEQLVTSVKPTYSPTPPNRHLRTPHSGYHFDGTTRKFFEGWYFKLSIPERRQSFCFMYSVESPSFRKPLTPLEVAQYGSRFTGVGAQILGADDKYICQFSPESQFFWGSRHELMLGNTFVPNQNSKPPNKEVPPQEFNDRVLEGFQVSPLWHQGFIRDDGRSNYVETVKTARWEYSTRPVYGWGDVGSTQKSTAGWLAAFPVFEPHWQICMAGGLSTGWIEWDGKRIEFDNAPSYSEKNWGGGFPRKWFWVQCNVFEGASGEIALTAAGGLRQIPGIAETFENAALIGIHYGGIFYEFVPWNGVVNWEVTTWGYWFMSADNGRYVVEIEATTEDPGTTLRAPTAEAGLAPACKDTCFGDLKLQMWERRYDGSKGKIILDVSSNMAALEVGGGPWFNTWKGKTSTPAALSRVLELPIDVEGIFNPVPLFKPPGL

SEQ ID NO: 2552 - protein, 436 aa, Glycine max
  unsure (1)..(436): unsure at all Xaa locations
MPFRSIVRELKEIGEGISNMYRRGGEAKHVHRHGKSHIAPECSLPPPPSSSSSSSSSSSWQSRWANLPPELLLDIIQRLEASETSWPARRALVACASVCKLWREITKDVVKTPEQCGFITFPISLKQPGPRDSPIQCFIRRERMTSTYCLYLGLSPALSGDMSKLLLAAKKIRRATCTEFIISLVSDDFSWASNTYVGKLRSNFLGTKFTIXEGEPPHDSSLPLNCKLQQRVHLKQVLPNKVAAAANYKVATVSYELNVLRTRGPRRMRCMMHLIPIFAIQEGGNAPTPLKFTTNYLNDHASTTTEHASTTTPDSKGKKPEVVEFDSTGTANTPESIQRAREPLVLKNKAPRWHEQLQCWCLNFKGRVTVASVKNFQLVAAAXHAKNVSAAEQEKVILPFGKXGKDIFTMDYRYPLSAFQAFAICLSSFDTKPACE

SEQ ID NO: 2553 - protein, 118 aa, Glycine max
MEGGSFNGAQIDAKIMQTFKKNFVQVQDIFDQNRLLINEINQNHESKVPDNLTRNVGLIRELNNNIRRVYDLYADLSSSFTKSMEVTSEGDSSGGCCEIIRWESRPQETQACVEGEFG

SEQ ID NO: 2554 - protein, 386 aa, Glycine max
MEHKLATTEGQPIRCKAAVCRKAGEPLGIEEIMVAPPMPGEARIRIICSSLCRTDISFRNMQGPPANFPTILGHEAIGVVESVGEDVTEVAKGDVVVPIFLPDCGECIDCKSSKSNLCSKFPFEVSPWMPRYATSRFTDLKGEIIHHFLSVSSFSEYTVVDIAHLIKIDPAIPPNRACLLSCGVSAGIGAAWRAAGVEPGSTVAIFGLGSIGLAVAEGARLCGATKIIGVDVNPEKYEIGKRFGLTDFVHSGECENKSASQVIIEMTGGGADYCFECVGMASLMHEAYASCRKGWGKTIVLGLDKPGSKLSLSCSEILVSGKSLVGCMFGGLKPKSHVPILIKRYLDKELNLDGFVTHEVEFKDINKAFDLMIKGQCLRCVIWMDK

SEQ ID NO: 2555 - protein, 330 aa, Glycine max
MLLSLHKLNLNLSPCSSSGIYLAVMDYSSWINTSLDLNINLHRVHEELPKKQVENNFFSLDLEVKKSSVKQESAGALAEELKRVSAENKKLTEMLTEMCENYNTLRSNLMEYMRKNPDKELSSSRKRKSASSNNNSTIPMGVNGTSESSSTDEESCKNPKEDMKTKISRVYMRTEASDTSLIVKDGYQWRKYGQKVTRDNPSPRAYFKCSFAPSCPVKKKVQRSVDDQSVLVATYEGEHNHTHPSQMEVTTGSNRSVSCSASLSSSAPTVTLDWTKSKSSSESKNVNPKTESPEVPQVLVEQMATSLTKDPNFRAALVAAISGKMLHNNN

SEQ ID NO: 2556 - protein, 488 aa, Glycine max
TRPGFPIDEAKRGSLGKFSRMLKRLLNDLEVRQIMKAERFCEANQLPPEYVCGCGQPPAGEELVTLQNCPNPPKKLKPGTYWYDKVSGLWGKEGQKPSQIISPHLNVGGPIQQDASNGNTQVFINGREITKVELRMLQLAGVQCAGNPHFWVNEDGSYQEEGQKNTRGYIWGKAGTKLVCAFLSLPVPSKSSNSLGEQPSSLASRTMPDYLEHGIVQKLLLVGCSGARASTIFKQAKILYKSVPFSEDERENIKLTIQTNVYAYLGILLEGRERFEEESFGNLKKSQSSVLDTTGTSPKLDEKTVYSIGPRLKAFSDWLLKTMVSGKLDAIFPAATREYAPLIEELWNDAAIKATYERRSELEMLPSVASYFLERAVKILRTDYEPSDLDILYAEGVTSSNGVACVEFSFPQSVSEETVDTTDRYDSLVRYQLIRVHARGLGENCKWLEMFEDVEMVIFCVSLTDYDQFFCLLMATVVSLTRCSKQKV

SEQ ID NO: 2557 - protein, 541 aa, Glycine max
  unsure (1)..(541): unsure at all Xaa locations
MDDERDFELLFYSWNTKNPTDQLFIISFLVAALVGMLTIAYTAFQWRRNINLSWMKAIARSKKNPKARHIIPAAPHTWXLESASRAKNLNCCVCFKSVSPSQTLGPIVASEGFIHRCCTCGAVAHLSCSSSAHKDCKCVSMIGYEHVTHQWTVCWTDVADQPDETALCSYCEELCGGTFLSGSPIWSCLWCQRLVHVDCHSTMSNETGDICDLGQFRRLILSPLYVKELNWNLPGGFLSSITHGANEIASSVRASIRNQSKKYKHGNELSVESGNSESIGEVSTESTGDSHQIQNGHHEVGEKSSSNKGVQHQDNEVDNKLDRKPSLRRNSSINQKDESHSLGVKQKYDLIDLPLDARPLLVFINKKSGAQRGDSLRMRLNILLNPVQVFELSSTQGPEMGLYLFRKVSHFRVLVCGGDGTVGWVLNAIDKQNFVSPPPVAILPAGTGNDLARVLSWGGGLGPVERQGGLTTFLHHIEHAAVTVLDRWKVTISNPQGKQQLLPTKFMNNYLGIGCDAKVALDIHNLREENPDKFYNQVFGV

SEQ ID NO: 2558 - protein, 550 aa, Glycine max
GFFFFFFLIFHITLGTPQQKPGSLGSESSFALVTGNTTMDSAEKRLNELGYKQELRREMTLFKTLAISFSTMTLFTGITPLYGSSLQYAGPATLVWGWIVVSFFTWFVGIAMAEICSSFPTTGSLYFWAAHLAGPKWGPFSSWCCAWLETIGLIAGIGTQAYAGSQTLQSIILLSTGTNKGGGYFAPKWLFLCMYIGLTVIWAALNTFALEVIALIDIVSIWWQVIGGIVIVIMLPLVALTTKSASFVFTHLELAPESTGVSSKPYAVILSFLVSQYSLYGYDAAAHLTEETKGADKNGPIAILGSIGIITVFGWAYILALTFSIQDFGYLYDPNNETAGAFVPAQILYDAFHGRYHNSAGAIILLFVIWGSFFFGGLSITTSAARVVYALSRDKGVPFSHLWRQLHPKYKVPSNAVWLCAAICILLGLPILKVNVVFTAITSICTIGWVGGYAVPIFARLVMSEKNFKPGPFYLGKARRPVCLVAFLWICYTCSVFLLPTLYPITWDTFNYAPVALGVGLGLIMLWWLLDARKWFTGPVRNIDIQNGKV

SEQ ID NO: 2559 - protein, 257 aa, Glycine max
FGSRFNSLLSEVCAFLFNSSLFLRHPRREPKIKNKKINTINKGEKTNMSFTGTLDKCTACDKTVYVVDLLTLEGIPYHKNCFKCSHCKGCLTMCTYSSMDGILYCKTHFEQLFKESGNFSKNFAKSSEKQNELNRTPSKLSSMFSGTQDKCSVCTKTVYPLEKMTLEGECFHKTCFRCAHAGCPLTHSNYAALDGVLYCRVHFAQLFMEKGNYNHVLQAAAHRRTGSSTPPLLEEPSQEPAPPASHEDQTEEETPLE

SEQ ID NO: 2560 - protein, 179 aa, Glycine max
HYLRDKNGFHGANSVKVTSYEEEALRTMKAFWLPSATPEASIKADAPSNSTICPEGYEKLKIKTLFPVQFTEDTSELKKFKALDKTYICPSCKVTLTNTMSLVALSTCGHVFCKKCADRFMAVDKVCLVCNKACKERNLVNLEKGGTGFAGHGDHLEATDFKHLGSGSGLGLVRPAMKT

SEQ ID NO: 2561 - protein, 126 aa, Glycine max
MGYICDFCGDQRSMVYCRSDAACLCLSCDRNVHSANALSKRHSRTLLCERCNSQPAFVRCVEEKISLCQNCDWLGHGTSTSSSTHKRQAINCYSGCPSHRFLIHNAQCSSVIGFLFRRSNSQLQLK

SEQ ID NO: 2562 - protein, 345 aa, Glycine max
  unsure (1)..(345): unsure at all Xaa locations
MSGLIEGLPDAVAIRCLAWVPFYLHPKLELVSRAWRAVVRGPELFKARQELGSSEDLLCVCAFEPENLWQLYDPLRDLWITLPVLPSRIRHLSHFGAVSTAGKLFVIGGGSDAVDPLTGDQDGCFATNEVWSYDPVVRQWSPRAAMLVPRSMFACCVMNGKIVVXAGGFTSCRKSISQAEIYDPEKDVWIPMPDLHRTHNSACSGVVIGGKVHVLHKDMSTVQVLDNAGQWTVEEYGWLHGQMAVIRDALYVISYGLIIKQDKKMRKVVGSASEFRRRIGFAMIGLGDELYVIGGVIGPDRWNWDIKPLSDVDVLTLASDRPTWRQAAPMTRCGGTILGCTLLRI

SEQ ID NO: 2563 - protein, 368 aa, Glycine max
MEKELVELYEAAKKAADAAISGDGKHEESRCIDALEQLKKFPVNYKILVNTQVGKHLKVLTKHPRLKIKAFAIDLIEIWKGIIIKETSKNKNGGSDSKVESANGEKSKAGKMQKSPSVKVEKGETVKVEKIDRNGTTKSSSENMKKVQNDVKNEKTDRSASVKVEKIAKEEKPVSGAKKMSSSSAAPPKLKTMIKSNDATRDKIREILHEALSKVTGEADEDLVDVVNNSDPIRVAVTVESVLFEKWGPSNGAQKVKYRSLMFNLKDSNNPDFRRKVLLGVIEPEQLINMSTAEMASEQRKQEYQKITEKALFECERGGPPKATTDQFKCGRCGQRKTTYYQMQTRSADEPMTTYVTCVVCNNRWKFC

SEQ ID NO: 2564 - protein, 374 aa, Glycine max
QTIKCKAAIAWEAGKPLVIEEVEVAPPQAGEVRLKILYTSLCHTDVYFWDAKQTPLFPRIFGHEASVGGIVESVGEGVTHLKPGDHALPVFTGECGDCAHCKSEESNMCELLRINTDRGVMIHDGQSRFSKNGQPIHHFLGTSTFSEYTVVHAGCVAKINPAAPLDKVCVLSCGICTGFGATVNVAKPKPGSSVAIFGLGAVAVAAAEGARVSGASRIIGVDLVSARFEEAKKFGVNEFVNPKDHDKPVQQVIAEMTNGGVDRAVECTGSIQAMVSAFECVHDGWGLAVLVGVPSKDDAFKTAPINFLNERTLKGTFYGNYKPRTDLPSVVEKYMSGELEVDKFITHTVPFSEINKAFDLMLKGSIRCIIRMQE

SEQ ID NO: 2565 - protein, 181 aa, Glycine max
MAESDNESGGHTGNASGSNELSGCREQDRFLPIANVSRIMKKALPANAKISKEAKETVQECVSEFISFITGEASDKCQKEKRKTINGDDLLWAMTTLGFEDYVDPLKIYLHKYREMEGEKTAMMGRPHERDEGYGHGHGHATPMMTMMMGHQPQHQHQHQHQHQHQGHVYGSGSASSARTR

SEQ ID NO: 2566 - protein, 620 aa, Glycine max; identical to SEQ ID NO: 1181

SEQ ID NO: 2567 - protein, 330 aa, Glycine max
MELTFPHQDEDDSVVSDCESGVSGSGVVVAPPPPPPQQQQRGFFVRLGEGDVVHDLIKTRFIRGLGMLGPKTEVVSVRRNACSDVVSQARLHSFHAHARAVARLRGGGNHANVKYAWYRTNGEDDVNDIVSQGFGFAHGPKLVLSPDDAPLQSARGCGVGKDGVRHALLCRVILGRSEIVRDNTEHCYPSCEEYDSGVDSFSGPTKYIIWSNRMNTHVLPAYVVSFRVSSFKGMEKSEEEPLRPTSPWMPFPTLISALSKVLPPCDIALISKFYKDKKDKKILRHELIQRVREIAGDKLLVAAIKSYRDNKKKPSFLQSRSKNGLATRIK

SEQ ID NO: 2568 - protein, 217 aa, Glycine max
MATFILRSNKAVHAFGWLCLLLMVHKGASYDFVVGGQKGWSVPNDPSFNPFNQWAEKSRFQIGDSLVFNYQSGQDSVLYVKSEDYASCNTNSPYAKYSDGHTVIKLNQSGPHFFISGNKDNCNKNEKLTVIVLADRNKNTNQTTTTNASPPSPQSSSSSPSPAPTGQYQGQSPTSDTNQTPSPISEPPPPPNAAASAFVSLAGSVGAFMASVLVVSL

SEQ ID NO: 2569 - protein, 676 aa, Glycine max
  unsure (1)..(676): unsure at all Xaa locations
MQGQRRTIGSFPAIVSMMQGPSSSGTDMSHQSSLNHVQNAVDFRLSDYRGSSGETACLRGTGHNVQSFNGWSTGESSSRLNLINQVNDEGLKSEHGLSSSSNTNLHGNQSRVHPSFLQGSSSTRISQNISLDMGHVTNAADRGKGKEAGSSVNANNTRASSESSGYMAWGDSANSSSSLVNWGPSCKRKALEGSSRQLCSGGSSSTLVQSGNGCWPTDPVDLNASSDLTDSTPIEDIPVTSPPLFQNATNEERQEAPNGFPLISIAENVERPLRNFDRRMSHLQHQESVPLNLPSTGSARHHNHSSLHQAPGSHSINDSPDLRFTAGRTSSANAGASLNQSPALRIHSGPGNXSAFPGAARSSTPYNSGEGAVRVDFNLRMFPRDSTEHPMNVPASSGHEPIGWHTPSGNVNNSGGAPPPSWIGSSSNVHSPANRSWIFNHEVPAENMQSVSEFSPWSLFPSISSASGVHNAHSAPSSSGPPSFTQGSSSNQPYARTALVMERRGGDVLSGGPHSLRALTFDNEGRRRLISEIRQVLMAMRRGENLRAEDYMVFDHPFLYHGMAEMHDRHREMRLDVDNMSYEELLALEEHIGDVSTGLNEDVIIKLMKQRIYVRAIIMTDSYTDLEPCCICQEEFSDGENVGSLDCGHEFHSGCIKQWLMQKNLCPICKTTALAT

SEQ ID NO: 2570 - protein, 243 aa, Glycine max
MGRGKIEIKLIENPTNRQVTYSKRRNGIFKKAHELSVLCDAKVSLIMFSKNNKMHEYISPGLTTKKIIDQYQKTLGDIDLWHSHYEKMLENLKKLKDINNKLRRQIRHRIGEGLDMDDMSFQQLRTLEEDMVSSIGKIRERKFHVIKTRTDTCRKKVKSLKQMNGNLLLELKEKCVIHPQFLLHDEGDEESAAAAAAAAVALANGASTLYAFCHQHHSHLNLFSHHSNGEEQPFKTDHDLRLA

SEQ ID NO: 2571 - protein, 233 aa, Glycine max
MGRGKIEIKLIENPTNRQVTYSKRRNGIFKKAHELSVLCDAKVSLIMFSKNNKMHEYISPGLTTKRIIDQYQKTLGDIDLWRSHYEKMLENLKKLIDINNKLRRQIRHRIGEGLDMDDMSFQQLRTLEEDLVSSIGKIRERKFHVIKTRTDTCRKKVKSLEQMNRDLLFELEKCAIHPQFILHDEGDEESAVALANGASTLYAFCHQHHSHLNLPSHHSHGEEPFKTDDLRLA

SEQ ID NO: 2572 - protein, 177 aa, Glycine max
MSRVYVGNLDPRVSERDLEDEFRIYGVLRSVWVARRPPGYAFIEFDDRRDALDAIQALDGKNGWRVELSHNSKGGGRGGRGRGGEDTKCYECGEPGHFARECRLRIGSRGLGSGRRRSPSPYRRRRSPSYGYDRRSYSPRGRRSPRRRSISLPRGRSYSRSPPYRPSRHDSPYANAM

SEQ ID NO: 2573 - protein, 400 aa, Glycine max
MQAAATTPLYQLVSFKPKLQTFPSKSQLCPLGTPFCRLGMASVSGFRLRPLRAVGGSSSSSASGDDGFVTLIEYVAKEGMNVKDDLVVLLDHIQYACKRIAALVASPFNYSLGKQTGHGSVGSDRDAPKPLDIVSNEIILSSLRKSRKVAVMASEENDAPTWISDDGPYVVVTDPLDGSRNIDASIPTGTIFGIYKRLEELDNLPTEEKAMLNSLQSGSKLIAAAYVLYSSATILCITFGSGTQAFTLDHSTGDFILTNPSIKIPPRGQIYSVNDARYFDWPEGLRQYIDTVRQGKGRYPKKYSARYICSLVADLHRTLLYGGVTMNPRDHLRLVYEANPLSFIVEQAGGRGSDGKNRILSLQPVKLHQRLPLFLGSLEDMEELESYGDIQQKVNPGYEV

SEQ ID NO: 2574 - protein, 406 aa, Glycine max
MFPQENHSNGYQHQQGYSHRERVRRGTCRSRASTSSHSHSVRVYDQPRPPCTDFDVAYFHSYAHLGIHQEMIKDRVRTDTYRDAIMQHQSFIAGKVVVDVGCGTGILSIFCAQAGAKRVYAIDASDIALQANEVVKANNLSDVVVVLHGRVEDVEINEEVDVIISEWMGYMLLYESMLGSVINARDRWLKPGGLILPSSSTLYMAPVTHTDRYSDSVDFWRNVYGIDMSAMVSLAKQCAFEEPSVETITGENVLTWPHVVKYIDSYSVTIQELESVTAKFKFNSMMRAPLHGFAFWFDVEFNGHAIPSTNYHSTTSFVDNHQMNGSQRKRRTNPNEALVLSTAPEDPPTHWQQTLIYFYDPIELEQDQLIEGLVTLSQSKENARFMNIHLEYTSGGRSYVKESVMR

SEQ ID NO: 2575 - protein, 589 aa, Glycine max
  unsure (1)..(589): unsure at all Xaa locations
MIMAALNSSTCAKPQFPHPLSSSFSSSSSLTRDLGFPTRFQKKPIRKVVDCALHSPPVIHFPNQPYNKPEITKEPTTSTAERPQWNPFQKAAAKALDMFESALLSRELNQPFPKTTDPRVQIAGNFAPVPEHPVEHSLPVIGTIPDAINGVYLRNGANPLFKPKAGHHLFDGDGMVHAVKFNDGTASYACRFTETQRLMQERKLGKPVFPKAIGELHGHSGIARLMLFYARGLVRHRRAXRGAGAANAGLVFFNGKLLAMSEDDFPYELRITASGDLETIGRYSFHGQLNSSMIAHPKVDPVSGELFTLSYDVTSKILKYFHFSPEDERKSPDIEIPLDAPTMTHDFAITENFVVIPDQQVVFKLGEMIKGGSPVIYDGEKKSRFGILPKYASDASSIVWVDSPDTFFFHFWNAWEERDKDEVVVIGSCMTPPDSIFNDREERLKSVLTEVRLNMRSGKARRRVLVEEMNLEAGMVNRKRLGRKTRFAYLCIAEPWPKVSGVAKVDLESGEVKRHEYGERRFGGEPFFLPTRGGNGNEDEGYVMAFVHDEMTWQSELQILNALDLKLEATVMLPSRVPYGFHGTFVEAH

SEQ ID NO: 2576 - protein, 162 aa, Glycine max
MSDAPASPCGGGGGGSHESGEHSPRSNFREQDRFLPIANISRIMKKALPPNGKIAKDAKETVQECVSEFISFVTSEASDKCQREKRKTINGDDLLWAMTTLGFEEYIDPLKVYLAAYREIEGDSKGSAKGGDASAKRDVYQSPNGQVAHQGSFSQGVNYTNS

SEQ ID NO: 2577 - protein, 337 aa, Glycine max
MSSATKGDRKTALDVASWMFNIVTSVGIILVNKALMATYGFSFATTLTGLHFATTTLLTVFLKWLGYVQTSHLPLPDLIKFVLFANFSIVGMNVSLMWNSVGFYQIAKLSMIPVSCFLEVILDNVRYSRDTKLSISLVLLGVAVCTVTDVSVNAKGFIAAAVAVWSTSLQQYYVHFLQRKYSLGSFNLLGHTAPVQAASLLLVGPFLDYWLTNKRVDAYNYGFTSTLFIIISCTIAVGTNLSQFICIGRFTAVSFQVLGHMKTILVLALGFVFFGKEGLNLQVILGMTIAIAGMIWYGNASSKPGGKERLSLPINHTTNKTQEYNVLPVSSETDQEI

SEQ ID NO: 2578 - protein, 337 aa, Glycine max; identical to SEQ ID NO: 2577

SEQ ID NO: 2579 - protein, 572 aa, Glycine max
MAEDDGYTKDGTVDYCGNPANKKETGTWKACPYILGNECCERLAYYGMSTNLVLYFKNRLNQHSATASKNVSNWSGTCYITPLIGAYLADSYLGRYWTIAVFSIIYAIGMTLLTLSASVPGIKPTCHGHGDENCRATTLESAVCFLALYLIALGTGGIKPCVSSYGADQFDDTDSAEKERKSSFFNWFYFSINIGALIASSLLVWIQDNVGWGWGFGIPAVAMAIAVVSFFSGTRLYRNQKPGGSAITRICQVVMASIRKYNVEVPADESLLYETAETESAIKGSRKLDHTNELRFFDKATVLAQSDKVKESTNPWRLCTVTQVEELKSILRILPVWATGIIFSTVYGQMSTLFVLQGQTMDTRVGNSTFKIPPASLSIFDTLSVIFWVPVYDRIIVPIATKFTGNKNGLTQLQRMGIGLFISIFSMVAAAILELIRLRMVRRHNYYQLEEIPMTIFWQVPQYFIIGCAEVFYFIGQLEFFYEQAPDAMRSFCSALSLTTVALGQYLSSLLVTIVTKISTRNGSPGWIPDNLNFGHIDYFFWLLALLSVVNLIAFLVVSMLYTYKRPVGTLR

SEQ ID NO: 2580 - protein, 387 aa, Glycine max
MEHKVATTTEGQSIRCKAAICRKAGEPLSIEEIIVAPPMPGEARIRIICSSLCQTDISFRTMQDPPANFPTILGHEAIGVVESVGEDVTEVAKGDMVVPIFIPECGECIDCKSSKSNLCSKFPFKLSPWMPRHATSRFTDLKGEIIHHFLSVSSFSEYTVVDIAHLIKIDPEIPPNRACLLSCGISAGIGAAWRAAGVEPGSTVAIFGLGSIGLAVAEGARLCGATKIIGVDVNPERYEIGKRFGLTDFVHSGECENKSVSQVIIEMTGGGADYCFECVGMASLMHEAYASCRKGWGKTIVLGVDKPGSKLNLSCSEVLVSGKSLRGCLFGGLKPKSHVPILLKRYMDKELNLDEFVTHEMEFKDINKAFDLLIEGQCLRCVIWMDK

SEQ ID NO: 2581 - protein, 437 aa, Glycine max
MGGKSSKGSGRRYDFGASSSSRDNSYGGYPPQSPYTSYQTPQHPCASASASAPFYDYAQPKRKLDKKYSRIADNYRSLDEVTAALANAGLESSNLIVGIDFTKSNEWTGKRSFNRKSLHDIRSGQNPYEQAISIIGKTLSAFDEDNLIPCFGFGDASTHDQDVFSFYSEERFCNGFEEVLTRYRQIIPSLKLAGPTSFAPIIEMAMTIVEQSGGQYHVLLIIADGQVTRSVDTQNGNLSPQEQNTIDAIVKASEYPLSIVLVGVGDGPWEMMREFDDNIPSRAFDNFQFVNFTEIMTRNVDSTRKETDFALSALMEIPSQYKATLELGILGSRRGHSPDRVALPPPLYSRTSSSISTKSTRSNSFQQRTPTHTSYDSSVHTETSSSSLYDNKVCPICLTNAKDMAFGCGHQTCCECGEDLQFCPICRSTIHTRIRLY

SEQ ID NO: 2582 - protein, 513 aa, Glycine max
MEGVDQRNSSAFGVPVPRPPNQKHGIPPSHPNINISPSATPCSRYSQRLRSPGSSHSRSLSQSPIFSLDSLPPLSPSPAAVTSMFDSISTTDMSVEESNVSSQVPLNGGHALLPPRKGHRRSSSDSPLGISGFMQSSPVPSGGESSGFEKPIQLVLKASFKDSLDGGHANEPVYGRKEEAADDLFREYMNLDNFDNLNFPGMEDKDLDSRTSGSKTVESSDNEVESHVNGKASGAQGASSSCSEERREGVKRSSNGEVAPGPRQRRSFSLDSSIGNFNIEDGLPKLPPSKNQMGQHSPSNSMDGKMSETSTEFGNGEFSAEEVKKIMESDKLAEIASTDPKRAKRILANRQSAARSKERKMRYIAELEHKVQTLQTETTTLSTQFTKLQRDNSDLKSENNECKLRLQAMEQQSLLKDALNETLDAEVRRLRRAVADLAVNPSQVAWLDSLLLTKQMFELQHQQPSQQRHFLLQNHHTQEEIESRSQQIQGNELHPQAQIQSQQIQRNELHPQP

SEQ ID NO: 2583 - protein, 392 aa, Glycine max
MEGVGYCGSFFQRCKPYIAMVSLQFGFAGMNIITKVSLNRGMSHYVLVVYRHAFATAAIAPFAIVLERKVRPKMTFLMFMQIFVLGLLGPVIDQNLYYAGLKFTSPTYSCAISNILPAMTFVMAAIFRMEKLDMRKVRCQAKVIGTIVTVAGAMLMTLYKGQVISFLGSKYMHHPRNYVPENTTDSGEKDWFKGSILLILATLSWASFFILQAGTLRKYPAQLSLTALVCALGTLQSIAVTFVMEHKPSVWTIGWDMNLLAAAYAGIISSGITYYVQGIVMQKKGPVFVTAFSPLMMIIVAIMGAFILAEKIYLGGVVGAILIVMGLYSVLWGKHKEKKEKEAETTMEVMKCCSENGRLETVVEDAETNNDIEMQKGEASRELRVVISAPKA

SEQ ID NO: 2584 - protein, 322 aa, Glycine max
MNMEGQKKNKRVAVLVGCNYPNTSNELHGCINDVLAMKDTLEKRFGFDPSNIELLTDAPHSSNKLPTGANIKEALANMVDGAEAGDVLYFHYSGHGTRIPSKKHGHPFRHEEAIVPCDFNLITDLDLRQLVNRVPKGASLTILSDSCHSGGLIDKEKEQIGPSSSTEKDSTSKPSCSTPKAIPFESIMQQLSWLTKVNTTDIGTHLLELFGSEASLRFRIPAPDLDLLEPLRPDEGILLSGCQADETSADMNPNVACGQKAYGAFSNAVEMVLRENSPLLSNRDLVIRARKKLETQGFQQHPCLYCSDENANASFLCEMFNK

SEQ ID NO: 2585 - protein, 302 aa, Glycine max
MGTQRQNSMYSLTLDEVQNQLGDLGKPLTSMNLDELLKNVWTAEASQTIGMDNEGTSQASQAALQHQASLSLTGALSKMTVDEVWRDIQENKIIAEKKFEDRHPTLGEMTLEDFLVKAGVVADASSNRTNTGTIAGVDSNVAVPQFPSQGQWIQYPQVQYQHSPQSLMGGIYMPSQGMVQPLHMGAEASIDVSFADSQVALPSPLMGTMPDMLTPGRKWSNSEDMREKTVERRQKRMIKNRESAARSRARKQAYTNELENKVSRLEEENERLRKQKELELMLPCEPPPEPKYQLRRIASAPF

SEQ ID NO: 2586 - protein, 323 aa, Glycine max
MGTQTMGTHGGGGDSNGKQSPLQPLVRQNSMYSLTLDEVQNQLGDLGKPLTSMNIDELLKNVWTAEASQTIGMDNEGTAQASQASLQRQASLSLTGALSKKTVDEVWRDIQQNKIVGEKKFQDRHPTLGEMTLEDFLVKAGVVAGASSNRTNTSTIAGVDSNVAVPQFPSQAQWIQYPQAQYQHPPQSLMGMYMPSQGMVQPLHMGAGASLDVSFADNQMAMPSSLMGTMSDTQTPGRKKSTSEDMIEKTVERRQKRMIKNRESAARSRARKQAYPNELENKVSRLEEENERLRKRKELEQMLSCAPPPEPEYQLRRIASAPF

SEQ ID NO: 2587 - protein, 258 aa, Glycine max
MADSSREENVYMAKLAEQAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAEKSTLLAYKSAQDIALADLAPTHPIRLGLALNFSVFYYEILNSPDRACNLAKQAFDEAISELDTLGEESYKDSTLIMQLLRDNLTLWTSDITDDAGDEIKETSKQQPGE

SEQ ID NO: 2588 - protein, 389 aa, Glycine max
  unsure (1)..(389): unsure at all Xaa locations
HLQCQGVGGDALPSYMRGAVYWEPNKPLTIEEFNMPRPKAGEVLIKTKACGVCHSDLHVMKGEIPFSSPCVVGHEITGEVVEHGALTDSKTIERLPVGSRVVGAFIMPCGNCSYCSKGHDDLCXEAFFAYNRAKGTLYDGETRLFFRNSGKPAFMYSMGXGLAEYCVVPANGVSVLPDSLPYTESAILGCAVFTAYGAMAHAAQVRPGDSVAVIGTGGVGSSCLQIARAFGASDIIAVDVRDEKLQKAKTFGATHTVNSAKEDPIEKILEITGGKGVDVAVEALGKPQTFAQCTQSVKDGGKAVMIGLAQAGSLGEVDINRLVRRKIQVIGSYGGRARQDLPKLIRLAETGIFNLGHAVSRTYTFDEAGKAFQDLNEGKIVGRAVIEII

SEQ ID NO: 2589 - protein, 295 aa, Glycine max
  unsure (1)..(295): unsure at all Xaa locations
MEMEPTCVDTSLNLNVIPSPHIDHLAGEVLFEELRRLSSENKRLTETLNHLCESYVALQKHLSEFSQLRNANFDKEGTCAVPSLKRKPESENCVKSXFGTECNTITEEETFKRPKHSTEPKVSKVLTRTDASDTGLYVRDGYQWRKYGQKVTRDNPSPRAYFKCSYAPSCPVKKKVQRSVEDPSVLVTTYEGEHNHGQQHQTAEISINSSSKSETPRPAVSPSAMNIRSSAAAGPIVTLDLVKSKVVDINAQKSSLQQFLVHQMATSLTRDPNFTAALASAISGRILDDTSVGKR

SEQ ID NO: 2590 - protein, 440 aa, Glycine max
MQENYSYQSYPDSGESSPRSREIDFDNPPPWDDQNYKAKFMCSYGGKILPRSHDNQLSYVAGETKILAVDRSIKFSAMLAKLSALCDAPDNNNLTFKYQLPGEDLDALISVTNDDDLDHMMHEYDRLYRASARPSRMRLFLFPSDTLPSPPPAASAPHDSVIKPNNVDFLFGLQPQPPPIDVKFNDPLPEPVAPPPEHPLRFNFNPAVSDPSAIQRQLQQLQIAENEQAAHRRKGEDNYPAGDYYVQKVPEKFPPPNFLASSPGYWPEKHVSGDVYPPAVTATSGGGEPSVYMVPAPGTFYHAPVMRPPPPATQGYYTVQRMGSDNYREAPVYGGVPPPKAAVPASMAPAQQPIKAPAYTEGFGMVRPGGIVDNTGVPYAQVAYDSGSGRQVYYTAPGGGVTHAPPYHGVFPPVTADMRLGGVSFGQDVKVISKLTQGSV

SEQ ID NO: 2591 - protein, 141 aa, Glycine max
MGLSNFPISASEGVLPVLVINTVFSVALLKSMFRSMLQVVFGGSAASSSSNIEHDDEISSSSSSRERRVSITQYKSLCHSHDIGGGTSVAMVECCVCLCRFEDNQEVSELPCKHYFHRGCLDKWFEFDNKHSTCPLCRSID

SEQ ID NO: 2592 - protein, 283 aa, Glycine max; identical to SEQ ID NO: 1178

SEQ ID NO: 2593 - protein, 239 aa, Glycine max; identical to SEQ ID NO: 1125

SEQ ID NO: 2594 - protein, 215 aa, Glycine max
  unsure (1)..(215): unsure at all Xaa locations
MRTLCDVCESAAAIVFCAADEAALCSACDHKIHMCNKLASRHVRVGLADPTDVPRCDICENAPGTXAFFYCEIDGSSLCLQCDMIVHVGGKRTHGRYLLLRQRVQFPCDKPAQMEELGLQPMDQNESRRDESQSLKLKIRDSQQNHSVSPVPRQENNIDGHGKMDKKLIDLNTRPLRLNGAAPNNQERGMDILRGNNHKSASVPPVESFKQESEK

SEQ ID NO: 2595 - protein, 313 aa, Glycine max
  unsure (1)..(313): unsure at all Xaa locations
MVLLSKATTEQYSYIKNCMPTKFSSTIPIVDLSKPDAKTLIVKACEEFGFFKVINHGVSMEAISELEYEAFKFFSMSLNEKEKVGPPNPFGYGSKKIGHNGDVGWIEYLLLNTNQEHNFSVYGKNPEKFTCEFIXLMAEGLRIQLKDVFSKLLMDKQSDSIFRVNHYPACPEMTLNDQNLIGFGEHTDPQIISLLRSNNTSGLQIYLRDGNWISVPPARASFFINVGDSLQVMTNGRFRSVRHRVLANGFKSRLSMIYFGGPPLSEKIAPLSSLMKGKESLYKEFTWFEYKKSIYGSRLSKNRLEHFERIAAS

SEQ ID NO: 2596 - protein, 575 aa, Glycine max
MEVLLLCGQERHTKRAFVSFPVFLPRLSLCLCYLLRSSLLLSNMALVNPFLCTTRTSLPLRVSGPPNQVLPRWTLCSQYSFKTSSLRSKQLRCGATADIKADHAVLVGPTSEEERKGDYDWTQEWYPLYLTQNVPEDAPLGLRVFDKQLVLFKDGNGQFRCYEDRCPHRLAKLSEGQLIDGRLECLYHGWQFEGEGKCVKIPQLPADAKIPRAACVKTYEVRDSQGVIWVWMSLKTPPNVSKLPWFENFARPEFQDISTIHELPYDHSILLENLMDPAHIPISHDRTDWTAKREDAQPLCFEVTERTHIGFAGWWGREKDGSMPNFLRFEAPCVLQNNREIVDKNGEINYFNGCEKTTEGGQGKSMLIVRFGGTKRSPLAKVFPKWYLHQNASKVFEQDMGFLSSQNEILLKEKVSTKELYLNLKSSDTWVAEYRKWMDKAGHGMPYHFGHSTISLPKEPAVVEHAPAGLVAGQSASSPTKGGIGTMHAPNFANRYFRHVIHCKGCRTVVKAFEAWKNALSAVAIALTALAILLSGRQWKVLLLASAALCSVGVYACSTAIAMNTTNFIRTHRRL

SEQ ID NO: 2597 - protein, 547 aa, Glycine max
MKLINKPSQLRSLLSLFCSILLLLELAFVAAEDPYRFFDWTITYGDIYPLGVKQQGILINGQFPGPEIYSVTNDNLIINVHNNLTEPFLLSWNGVQQRRNSYQDGVYGTTCPIPPGKNFTYTLQVKDQIGSFFYFPSLAFHKAAGGFGAIKILSRPRIPVPFPDPAGDFSLLIGDWYQINHKKLQSVLDFGHRLPFPQAVLINGRPSGTTFTVEQGKTYRLRISNVGLQNTLNFRIQGHDMKLVEVEGTHTIQTTYSSLDVHVGQSYSVLITVDQAPKDYYIVVSTRFTNKILTSTAILHYSNSQQSVFGPIPSGPTTQIDWSIKQARSIRTNLTASGPRPNPQGSYHYGLINISRTITLVSSTAQVNKKQRYAVNSVSFTPADTPLKLADYFNIGGIFQVGSIPDSPSGRPMYLDTSVMGADFRAFVEVVFQNHENIIQSWHIDGYSFWVVGMDGGVWTPNSRNQYNLRDAVSRSTTQVYPKSWTAIYMALDNVGMWNMRSEFWARQYLGQQFYLRVYSPVGSIRDEYPIPKNALLCGKAAGRTTR

SEQ ID NO: 2598 - protein, 771 aa, Glycine max
MERKIIDFDQGWDYMQKGITKLKKIPTRPAQCAMERKIIDFDQGWDYMQKGITKLKKILEGAPETPFSSEEYMMLYTTIYNMCTQKPPNDFSQQLYDKYKDAFDEYIKITVLPSLREKHDEFMLRELVQRWLNHKVMVRWLSRFFHYLDRYFISRRSLAGLGAVGLTCFRESVYMEVRVNARKAVIALIDKEREGEQIDRSLLKNVLDIFVEIGMGEMGQYEQDFEVHMLEDTADYYKSKAANWIEIDSCPDYMLKAEDCLRRERDRVSHYLHSSTEQKLVEKVQQELLVIHANQLLEKENSGCHALLRDDKVEDLSRMYRLYHKIPKFGSSTAARRRQKGTAEGAALVQQAEEASSNQTTSGSGFQEQVLVRKFLELHDKYMAYVNDCFMNHTLFHKALKEAFEIFCNKTVGGSSSAELLSTFCDNILKKGGSEKLSDEAIEDTLEKVVKLLAYISDKDLFAEFYRKKLARRLLFDRSANDDHEKCILTKLKQQCGGQFTSKMEGMVVDLTLARDNQLKFEEYLRDNSHVNPGIDLTVTVLTTGFWPSYKSFDLNLPSEMIRCLEVFKGFYETRTKHRKLTWIYSLGTCHVTGKFDTKNIELIVPTYPAAALLLFNNADRLSYSEILTQLNLGHEDVVRLLHSLSCAKYKILIKEPNNKVISQNDIFEFNHKFTDKMRRIKIPLPPADERKKVIEDVDKDRRYAIDAAIVRIMKSRKILGHQQLVLECVEQLGRMFKPDIKAIKKRIEDLITRDYLERDKDNPNTFRYLA

SEQ ID NO: 2599 - protein, 330 aa, Glycine max
MGEQLRQANPPVKTSEYDEERVMEWEAGLPTANDLTPLSQPLIPPELASAFSILPEPHRTLLDVNRASRNTLSTLRGGGGSVHQAFSSSNNNHNYDGDGDGGVEEEEEEDDDRDGSGPDSRKQRKIDCGAAEEADSAVQTETSAERTAVKRPRLVWTPQLHKRFVDVVAHLGIKNAVPKTIMQLMNVEGLTRENVASHLQKYRLYLKRMQGLSNEGPSASDQLFASTPVPQSLHDSAPPSNHSNGHGHGHGHSNGRGHGHGHGHGHLSVPMMSMPYPPPLMSMPYPPPMMSGMPHGHMGIPMPNSSATSAYHPYNMLHQRDWPHLAPNDK

SEQ ID NO: 2600 - protein, 326 aa, Glycine max
MDLMSVECVSSSDGMDEDEIHANHHHSEFSSTKPRNGGTSNINSVGPNGIAPATSVHELLECPVCTNSMYPPIHQCHNGHTLCSTCKTRVHNRCPTCRQELGDIRCLALEKVAESLELPCKYYSLGCPEIFPYYSKLKHETVCNFRPYSCPYAGSECSVVGDIPFLVAHLRDDHKVDMHTGCTFNHRYVKSNPREVENATWMLTVFHCFGQYFCLHFEAFQLGMAPVYMAFLRFMGDENEARNYSYSLEVGANGRKLIWEGTPRSVRDSHRKVRDSHDGLIIQRNMALFFSGGDRKELKLRVTGRIWKEQQQQNSDAGVCMPNLCS

SEQ ID NO: 2601 - protein, 450 aa, Glycine max
MGGDDAVPVPGLKSWEVRNFQASHAHESKMIVPHVEENAGESGSIGSMAYGDLQSLSLSMSPSSQSSSVTSSPAITNTVATDTKKRGLQMVDQNQKQIGHRKSIDTFGQRTSQYRGVTRHRWTGRYEAHLWDNSCKKEGQGRKGRQVYLGGYDMEEKAARAYDMAALKYWGPSSHINFPLENYQNELEEMKNMTRQEYVAHLRRKSSGFSRGASMYRGVTRHHQHGRWQARIGRVAGNKDLYLGTFSTQEEAAEAYDIAAIKFRGVNAVTNFDITRYDVEKIMESNNLLSSEQAKRKREMDDGTRSEATVNQKPSTYDHTQETVLMQKRCKNQSEWKMVQFPCPQQLDQNQRIESCRTQPFSTDLDNMFRHQVEERSNMGTHLSNPSSLVTSLSSSREESPDKTSMPMLFGMPSTVSKLLANVDSWDLSSNLRTALSMPQMPIFAAWTDA

SEQ ID NO: 2602 - protein, 428 aa, Glycine max
MGGSISKRRRSRQRSASNFLPRYQQPHFPQSQDNGSVGHYGYSSQSYSGGRAPEQVKSLDRKYLRIGDDYKSLKQVTDALAKAGLESSNLIVGFDFTKSNEWTGARSFQRRCLHHIGHEQNPYEQAISIIGKTLSSFDEDNLIPCFGFGDASTHDQEVFCFYPDERFCRGFEEVLERYRELVPQLKLAGPTSFAPVIEMAITIVEQSGGQYHVLVIIADGQVTRSVDTEHGQLSAQEKKTVEAIVKASEYPLSIILVGVGDGPWDMMKQFDDNIPARAFDNFQFVNFTEIMSKNMDRSRKETEFALAALMEIPSQYKATLELNILGACRGKDIDRIPLPPPLYGAASFNSPKTSRQYSSRPSAPSSRHDVSTNPPATSASDNQVCPICLTDPKDMAFGCGHQTCCDCGQDLELCPICRSTIDTRIKLY

SEQ ID NO: 2603 - protein, 576 aa, Glycine max
MAARYWGQMGLLRCYHCNPFDVACVIVGGFGSYLLGLNRRTYEQAGVGTEGNNPGSTKEPGIGWMTAFLFVTSFVGLLALVPIRKIMIIDYKLTYPSGTATAVLINGFHTPKGDVMAKKQVHGFLKFFSASFLWAFFQWFYSGGDNCGFVQFPTFGLKAWKNSFYFDFSMTYVGAGMICSHLVNLSLLLGAVISWGIMWPLIRGLKGEWFPASIPESSMKSLNGYKVFISIALILGDGLYNFVKVLYFTATNIHATVKRKNPETFSDNQKPLPLDDLRRNEVFARESIPIWLACTGYILFSIVSIIVIPLMFPQLKWYYVVFAYLFAPSLGFCNAYGAGLTDMNMAYNYGKVALFVLSALAGKNDGVVAGLVGCGLIKSIVSISSDLMHDFKTGHLTFTSPRSMLLSQAIGTAIGCVVAPLTFFLFYKAFDVGNPDGDYKAPYAIIYRNMAILGVEGFSALPHHCLQLCYGFFTFAIAANLVRDLGPKKIGKWIPLPMAMAVPFLVGGYFAIDMCMGSLVVFLWHTLNRNEAGLMVPAVASGLICGDGLWILPSSILALLKIRPPICMSFLSASAS

SEQ ID NO: 2604 - protein, 504 aa, Glycine max
  unsure (1)..(504): unsure at all Xaa locations
MEDLEEEENGAEEVLGSSLTMEKVAAAKKFIENHYRAQMKNIQERKERRWVLERKLASSDVPNEERINLIXKDLERKETEYMRLKRHKICVNDFELLTIIGRGAFGEVRLCREKKSGNIYAMKKLKKSEMLRRGQVEHVRAERNLLAEVASHCIVKLYYSFQDAEYLYLIMEYLPGGDVMTLLMREDTLSENVARFYIAQSVLAIESIHKHNYIHRDIKPDNLLLDKNGHMKLSDFGLCKPLDCIALSTLHENQTIDDETLAEPMDVDDADNRSSWRSPREQLQHWQMNRRKLAFSTVGTPDYIAPEVLLKKGYGMECDWWSLGAIMYEMLVGYPPFYSDDPITTCRKIVHWRNHLRFPDDAQLTLEAKDLIYRLLCDVDHRLGTRGAIEIKAHPWFKGVDWDKLYEMEAAFKPQVNGELDTQNFMKFDEVDPPTAARTGSGSSRKMLTTKDLSFVGYTYKNFDAVKEGLRQSFGDSMQEYASKRAAEETSLQMLASSGDPMVP

SEQ ID NO: 2605 - protein, 254 aa, Glycine max
MGRGRVELKRIENKINRQVTFAKRRNGLLKKAYELSVLCDAEVALIIFSNRGKLYEFCSSSSMLKTLERYQKCSYGAVEVSKPAKELESSYREYLKLKARFESLQRTQRNLLGEDLGPLNIKELEHLERQLDSSLKQVRSTKTQFMLDQLSDLQTKEQMLVEANRSLTVKLEEINSRNHYRQSWEAGDQSMPYGGGGPENSHSHSHSQGFFQPLECNPTLHIGPDYRYNAVASDQITATTQPQQVSGFIPGWML

SEQ ID NO: 2606 - protein, 485 aa, Glycine max
  unsure (1)..(485): unsure at all Xaa locations
MEARSAFSIDRSNAKQLNNMGMSEAFPSSLPALPSPLEETYPKLSDSKPVFMEKELKTKPYTHSSHLTSSGAVGHMFSSSPGYSTDLHHSSFSSHEKQPRNTHFISQSLSNMASLPLSYSSNSEPIPSTTSTPYSNGNSVSWHTDSLPSFLDFPANTSIGNSQVESSDCNIMATEEYSKRNDWQEWADQLISDVDPLTSNWNDLLADNIQDLEPKVAKSSSXNFPIGHQSQSHQQLPASSGENRVGVAPTSSTNSAPAKPRMRWTPELHEAFVEAVNQLGGSERATPKGVLKLMKVDGLTIYHVKSHLQKYRTARYRPESSEGAAEKKLSPIEEMSSLDLKTGIEITEALRLQMEVQKRLHEQLEIQRNLQLRIEEQGRYLQMMFEKQCKPGIETFKASSSAIESQSGVSSDAIKDSPAKTESETIKVDQCKSGADQANGITTVEESALEVGEKQDAPESQASENPEQHASEDSAKASKRPRTEE

SEQ ID NO: 2607 - protein, 484 aa, Glycine max
MEARSAFSIDRSNAKQLNNMGMSEAFPSSLPALPSPLEETYPKLSDSKPVFMEKELKTKPYTHSSHLTSSGAVGHMFSSSPGYSTDLHHSSFSSHEKQPRNTHFISQSLSNMASLPLSYSSNSEPIPSTTSTPYSNGNSVSWHTDSLPSFLDFPANTSIGNSQVESSDCNIMATEEYSKRNDWQEWADQLISDVDPLTSNWNDLLADNIQDLEPKVAKSSSQLPIGHQSQSHQQLPASSGENRVGVAPTSSTNSAPAKPRMRWTPELHEAFVEAVNQLGGSERATPKGVLKLMKVDGLTIYHVKSHLQKYRTARYRPESSEGAAEKKLSPIEEMSSLDLKTGIEITEALRLQMEVQKRLHEQLEIQRNLQLRIEEQGRYLQMMFEKQCKPGIETFKASSSVIESQSGVSSDAIKDSPAKTESETIKVDHCKSGADLANGSTTVEESSLEVAEKQDAPEIQASDNPEQHASEDSGNASKRPRTEE

SEQ ID NO: 2608 - protein, 616 aa, Glycine max
MTIHSVVIQKLLSTNAQVGRRVAAHHLKEFTYGFRNKMAIIDSDKTLICMRSACNFMASLARHNGRFMFINTNPLFDEIFDLMTKKVGSYSPSTNSLWRTGGFLTNSLSPKKFRSRNKKLVFGPTQPPDCIFIVDTERKSSVINEAFKLQIPVVALVDSAMPLDVYKRIAYPVPANHSVQFVYLFCNLITKTLLHEKAKSDAANPDIDAQMEEAPRKGKGKTYLDKVDVTVVLYDNLAPLPQDIEETKKLLDKLVVLKFNGSQGRNMCFDGPKSAIDICDGLTYLDLIINQIETLNSKYGSRVPLLLFNKDDIHDSSLKVLEKYSKSSVEVHTFKQGEDRELKSLGEYYSKEEVHPFDDVDVFRLLMTGGTLDSLLSQGKEYILVLKSDNVATVLDPNILNHLMINDIEYCMEVTPSNSFNLMLPTTKFKLREIGGDQDKHLKDNFKLIDTTNMWVSLRAIKRFVDTVEVRQKKPSFSKDTAAGPAIKFFDNVFGVSVPESRFLPLDATSDLLLLQSDLYTCREGVLTRNPARTNPLNPVIDLGPEFEKFGDFQSRFRSIPSIIELDSLMVRGDVWFGANITLKGQVTIAAKPGLKLEIPDGVTIENKEINDPADI

SEQ ID NO: 2609 - protein, 246 aa, Glycine max; identical to SEQ ID NO: 2120

SEQ ID NO: 2610 - protein, 244 aa, Glycine max
MGRGKVELKRIENKINRQVTFAKRRNGLLKKAYELSVLCDAEVALIIFSNRGKLYEFCSGHSMAKTLERYHRCSYGALEVQHQPEIETQRRYQEYLKLKSRVEALQQTQRNLLGEELEHLDVKDLEQLERQLDSSLKQIRSNKTQQMLDQLADLHRKEEMLLETNNILRNKLEEINVALQPTWETREQNAPYNYHPSQSEGYYETAHCNSTLRIGYDSSGLNEAGGAAGTSAQNASEFMNGWMN

SEQ ID NO: 2611 - protein, 424 aa, Glycine max
  unsure (1)..(424): unsure at all Xaa locations
MGNSEDEKSVKTGSPSSSPATTDQTNQPNIHVYPDWAAMQYYGPRVNIPPYFNSAVASGHAPHPYMWGPPQPMMQPYGPPYAAFYSHGGVYTHPAVAIGPHLHGQGVPSSPAVGTHSSIESPTKLSGNTDQGLMKKLKGFDGLAMSIGNCNAESAERGAENRQSQSVDTEGYSDGSDGNTAGANQTKRKRCREGTPITDGEGKTELQNGPASKETASSKKIVSATPASVAGTLVGPVVSSVMATTLELRNPSTVHSKANSTSAAQPCAVVHNETWLQNERELKRERRKQSNRESARRSRLRKXAETEELARKVDMLTAENVSLKSEITRLTEGSEQMRMENSALREKLINTQLGQREEITLSSIDSKRAAPVSTENLLSRVNNSGSNDRTAENENDFCENKPNSGAKLHQLLDTNPRANAVAAG

SEQ ID NO: 2612 - protein, 286 aa, Glycine max
MGIRFSSSQAAPSESSPASSLGELPESCVAQIMTYMDPPQICKLATLNRAFRGASSADFVWESKLPPNYDVLLRRIFADFPSHLGKRGIYARLCRLNSLDDGTKKVWLDRGMGKLCLCVSAKGLSITGIDDRRNWNHIPTDESRFSSVAYLQQIWWFEVDGEVEFPFPAGKYSVFFRIHLGRAGKRFGRRVCNTEHVHGWDKKPVRFQLWTSDGQYVASQCFLNGPGKWIFYHAGDFVVEDGNASTKVKFSMTQIDCTHTKGGLCLDSVLVYPSEFRKVKAFLNYS

SEQ ID NO: 2613 - protein, 411 aa, Glycine max
NFSSSQLLIEIEFKFEKAYLCHCTFTDLRLRASLSYFCVDLVSVKRLPFHHSPLFISFFYIDLKLKMESEKKSSAISDVGAWAMNVVSSVGIIMANKQLMSNNGYAFSFASSLTGFHFAVTALVGLVSNATGYSASKHVPMWELIWFSLVANMSITGMNFSLMLNSVGFYQISKLSMIPVVCVMEWILHNKHYSREVKMSVVVVVIGVGVCTVTDVKVNLKGFMCACIAVLSTSLQQISIGSLQKKYSIGSFELLSKTAPIQALFLLILGPFVDYYLSGKLITNYKMSSGAILFILLSCSLAVFCNVSQYLCIGRFSAVSFQVLGHMKTVCVLTLGWLLFDSELTFKNIMGMVIAVVGMVIYSWAVELEKQSNAKTLPHAKNSMTEEEIRLLRDGVEKSPLKDVELGEAQG

SEQ ID NO: 2614 - protein, 207 aa, Glycine max
  unsure (1)..(207): unsure at all Xaa locations
MNFSLMLNSVGFYQISKLSMIPVVCVMEWILHNKHYSREVKMSVVVVVIGVGVCTVTDVKVNLKGFMCACIAVLSTSLQQISIGSLQKKYSIGSFELLSKTAPIQALFLLILGPFVDYYLSGKLITNYKMSSGAILFILLSCSLAVFCNVSQYLCIGRFSAVSFQVLGHMKTXWAVELEKQSNAKTLPHAKNSMTEEEIRLLRDGVD

SEQ ID NO: 2615 - protein, 503 aa, Glycine max
MATAAVIGLSGGKRLLSSSYHYSDVIEKLSYGSDFGSTHYQIVPTKSLIAAKKSSNYTPTFPASNQQNQSIKALKEHVDDAPTIADPWFQSYNSNDLEVESSEMGYSVEALLLLQKSMLEKQWNLSFEREVLTEHSSKGKKCKKVAVTCSGVSARQRRMNTKRKTAIKTCGAMQLKSKISPELLQHRLKGYVKGIVSEELLSHAEVVNLSERIKVGLSLEEHKSRLKERLGCEPSDDQMAISLKISRTELRARMIECTLAREKLAMSNVRLVMSIAQKYDNLGAEMGDLVQGGLIGLLRGIEKFDSSKGFKISTYVYWWIRQGVSRALVENSRTLRLPAHLHERLSLIRNAKFRLEERGITPTIDRIAKYLNMSQKKVRNATEAISKTISLDREAFPSLNGIQGETHHSYIADDRVENIPWNGVDEWALKDEVNRLINVTLVEREREIIRLYYGLEKECLTWEDISKRIGLSRERVRQVGLVALEKLKHAARKRQMEAMLLKH

SEQ ID NO: 2616 - protein, 509 aa, Glycine max
WLGKDIMATAAVIGLSGGKRLLSSSYHYSDIIEKLSYGSDFGSTHYQIVPTKSLIAAKKSSNYTPTFPASNQQNQSIKALKEHVDDAPTIADSWFQSCNSNDLEVESSEMGYSVEALLLLQKSMLEKQWNLSFEREVLTEHSSKGKKCKKVAVTCSGVSARQRRMNTKRKTAIKTCGAMQLKSKISPELLQHRLKGYVKGIVSEELLSHAEVVNLSERIKVGLSLEEHKSRLKERLGCEPSDDQMAISLKISRTELRARMIECTLAREKLAMSNVRLVMSIAQKYDNLGAEMGDLVQGGLIGLLRGIEKFDSSKGFKISTYVYWWIRQGVSRALVENSRTLRLPAHLHERLSLIRNAKFRLEERGITPTIDRIAKYLNMSQKKVRNATEAISKTISLDREAFPSLNGIQGETHHSYIADNRVENIPWNGVDEWALKDEVNRLINVTLVEREREIIRLYYGLEKEGLTWEDISKRIGLSRERVRQVGLVALEKLKHAARKRQMEAMLLKH

SEQ ID NO: 2617 - protein, 239 aa, Glycine max
MTTMLTNEHGLSLNLKETELCLGLPGGGSEVETPRATGKRGFSETVDLKLNLQTKEDLNENLKNVSKEKTLLKDPAKPPAKAQVVGWPPVRSYRKNMMAVQKVSNEEVAEKTTSSTIANSGAFVKVSMDGAPYLRKVDLTMYKSYKDLSDALAKMFSSFTMGNYGAQGMIDFMNESKLMDLLNSSEYVPTYEDKDGDWMLVGDVPWEMFVGSCKRLRIMKGSEAIGLAPRAMEKCKSRS

SEQ ID NO: 2618 - protein, 392 aa, Glycine max
MEGGGAAPPADTVMSDAAPPPQQPPVAMGIENIPATLSHGGRFIQYNIFGNIFEVTAKYKPPIMPIGKGAYGIVCSVLNSETNEHVAIKKIANAFDNKIDAKRTLREIKLLRHMDHENVVAIRDIVPPPQREIFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEADLGFLNENAKRYIRQLPLYRRQSFQEKFPHVHPEAIDLVEKMLTFDPRKRITVEDALAHPYLTSLHDISDEPVCLTPFSFDFEQHALTEEQMKELIYREALAFNLEYQQ

SEQ ID NO: 2619 - protein, 391 aa, Glycine max
MEGGGAAPPADTVMSDAAPPPQQAMAMGIENIPATLSHGGRFIQYNIFGNIFEVTAKYKPPIMPIGKGAYGIVCSALNSETNEHVAIKKIANAFDNKIDAKRTLREIKLLRHMDHENVVAIRDIVPPPQREIFNDVYIAYELMDTDLHQIIRSNQGLSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEADLGFLNENAKRYIRQLPLYRRQSFQEKFPHVHPEAIDLVEKMLTFDPRKRITVEDALAHPYLTSLHDISDEPVCMTPFNFDFEQHALTEEQMKELIYREALAFNPEYQQ

SEQ ID NO: 2620 - protein, 538 aa, Glycine max
  unsure (1)..(538): unsure at all Xaa locations
MAHSPFLLLPNLQGFWPSLLAMITCFIIMIKALRNNFIENYSNKQKPKLPPGPKPWPIVGNLPEMLANKPAHKWIHNLMKEMNTEIACIRLGNAYVIPVTCPTIAREFLRKQDATFASRSQSVSTDLISNGYSTTIFGPFGAQWKKMXRKLLTNDLLSPHKYLWVDHPRTKERDPSMFLILTNCDERTLXMKSIVNIRCVARHFXGNLTRKIIFNTRYFGKGREDGGPGFEEVEHVDSIFNLLEYVNAFSVSDYVPCLRGLDLDGHEKNVKEALKIIKKYHDPIVQERIKLWNDGLKVDEEDWLDVLVSLKDSNNNPLLTLEEINAQIIELMLATIDNPSNAFEWALAEMINQPELLHRAVEELDSVVGKERLVQESDIPKLNYVKACAREALRLHPIAPFIPPHVSMSDTMVGNYFIPKGSHVMLSRQELGRNPKVWIETYKFKPERHLKSDGSDVDLTXPNLKFISLSTGWRGCPGVMLDTTMTVMLFARLLHGFTWTAPPNVSSINLAESNDDILLAEPLVAVAKPRLASELSQL

SEQ ID NO: 2621 - protein, 227 aa, Glycine max
MARGKIQIKRIENTTNRQVTYSKRRNGLFKKANELTVLCDAKVSIIMFSSTGKLHEYISPSTSTKQFFDQYQMTLGVDLWNSHYENMQENLKKLKDVNRNLRKEIRQRMGDCLNDLGMEDLKLLEEEMDKAAKVVRERKYKVITNQIDTQRKKFNNEKEVHNRLLRDLDARAEDPRFALIDNGGEYESVIGFSNLGPRMFALSLQPSHPSAQSGAAGSDLTTYPLLF

SEQ ID NO: 2622 - protein, 336 aa, Glycine max
  unsure (1)..(336): unsure at all Xaa locations
MDPPIHHPLGKRPAAEDDSVISDCESGVSGGDTAAGFVPADENADLVRTRFVRGLAAHGLKPEVLAVGRNACSSVMAQARQHSFHVFARAVAKLRDGNANVKFAWYGASSKEEINDIVQHGFGHAHSNGLRLSPQDSPLESVKSSVVDEDGLRHLLLCRVILGKTEVVPRGSYRCRSSSQEFDSGVDDLSNPKEYVIWCNQINTHVMPEYVLSFRLPSPLKGIVKIGEPLRXLLSPWMAFPALISMLSKILPPSEVASIAKFHKDYREKRISRHELIQKVRVIAGDKLLLSVIKSFRAKKIPANFKDDKAKEWQADSQQLERNDCSYGSSISYYRK

SEQ ID NO: 2623 - protein, 712 aa, Glycine max
MDLSSLSSYRTVGVTPSDPRKSLPQWGLHFLSYTHRLNQIKKRSSGVYASLSERERGEYYSQRPPTPLLDTVNYPIHMKNLSTNELKQLADELRSDVIFSVSRTGGHLGSSLGVVELTVALHYVFNAPQDKILWDVGHQSYPHKILTGRRDKMHTMRQTNGLSGFTKRSESEFDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGPMHELAAKVDEYARGMISGSGSSLFEELGLYYIGPVDGHNINDLVAILNEVKSTNTTGPVLIHVITEKGRGYPYAEKAADKYHGVTKFDPPTGKQFKSKATTRSYTTYFAEALIAEAEADKDVVAIHAAMGGGTGMNLFHRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAINDRPSCFRYPRGNGIGVQLPTGNKGTPLEIGKGRILIEGERVALLGYGSAVQNCLAAASLVEHHGLRVTVADARFCKPLDRSLIRSLAKSHEVLITVEEGSIGGFGSHVAQFMALDGLIDGKLKWRPIVLPDRYIDHGSPADQLSLAGLTPSHIAATVFNILGQTREALEVMS

SEQ ID NO: 2624 - protein, 164 aa, Glycine max
  unsure (1)..(164): unsure at all Xaa locations
MDLSSLSSYRTVGVTPSDPRKSLPQWGLHFLSYTHRLNQIKKRSSGVYASLSERERGEYYSQRPPTPLLDTVNYPIHMKNLSTNXELRSDVIFSVSRTGGHLGSSLGVVELTRAXHYVFNAPQDKILXDVGHQSYPHKILTGRRDKMHTMRQTNGLSGFTNVRE

SEQ ID NO: 2625 - protein, 126 aa, Glycine max
  unsure (1)..(126): unsure at all Xaa locations
QMKKRPCGVYASLSESGEYYSHRPPTPLLDTVNYPIHMKNLSAKELKQLADELRSDVIFSVSRTGGHLGSSLGVVELTVALHYVFNAPXDKILWDVGHQSYPHKILTGRRDQMHTMRQTNGLSGFT

SEQ ID NO: 2626 - protein, 350 aa, Glycine max
  unsure (1)..(350): unsure at all Xaa locations
MGEMSNFQLGVIGALFLSVASSVSIVICNKALMSNLGFPFATTLTSWHLMVTFCTLHAAQRLNLFVSKSVDLKTVMLFGILNGISIGFLXNLSLGFNSIGFYQMTKLAIIPFTVLLETIFLKKQFSSKIKFALFLLLVGVGIASITDLQLNFVGTILSLLAIITTCVGQILTNTIQKKLNVSSTQLLYQSAPFQAAILFVSGPVVDQMLTKQNVFAYKYSPVVLAFIILSCLIAVSVNFSTFLVIGKTSPVTYQVLGHLKTCLVLGFGYTLLHDPFTGRNILGILIAVFGMGLYSYFCTEDNKKKQLAGDLPLASQVKDKDSLPLLAGKNVGNQNEENHETNKLSKDFVI

SEQ ID NO: 2627 - protein, 414 aa, Glycine max
RAARPTQASDLYQIEMKSGTLVLRWVNSQLGRILGWVERVIQQEHWDPISPQQRHAGSIVEVYRIVEETVDQFFGLKVPMRFTELNSLFRGIDNALQVYANNVVNELASKEELIPPVPILTRYKKEAGIKAFVKKELFDARVPEPDETRPSQISVLATPTLCVQLNTLYYAISHLNKLEDNIWERWTSKRSQEKLIKKSFDDKSKSFSQKDTFEGSRKVINAAMDRICEYTGTKIVFCDLRVPFMDNLYKPSVSGCRLDALIEPLDMELSQLCDIVVEPLRDRIVTSLLQASLDGLLRVILDGGPSRVFFTGDAKLLEEDLEVLKEFFISGGDGLPRGVVENQVARVRHVIKLHGYETRELIEDLKSASGMEMQGSKSKLGTDSKTLLRILCHRSDSEASQFLKKQYKIPSSSA

SEQ ID NO: 2628 - protein, 264 aa, Glycine max
  unsure (1)..(264): unsure at all Xaa locations
CPCNSTLCVQLNTLYYAINHLNKLEDNIWERWTSKRSQEKLIKKSLDDKSKSFSQKDTFEGSRKVINAAMDRICEYTGTKIVFCDLRVPFMDNLYKPSVSGCRLDALIEPLDMVLLXELSQLCDIVVEPLRDRIVTSLLQASLDGLLRVILDGGPSRVFFPGDVKLLEEDLEVLKEFFISGGDGLPRGVVENQVARVRNVINLHGYETRELIEDLKSASGMEMQGGKSKLGTDSKTLLRILCHRSDSEASQFLKKQYKIPSSSA

SEQ ID NO: 2629 - protein, 458 aa, Glycine max
  unsure (1)..(458): unsure at all Xaa locations
KGKVPCGCLESDVKEVDRRHDLRKSLLPSSLQNDSSLQIENVSLKESIISNANELRLMKIIPRLESAYFSMRSKIKLPETDTATHPDKDILINHDNWCGAQKDMEQHRTTDALSSFFDIMYNYTGYSKFEVRGILRNTDFXNPANVICSLIFAKXDKIYFAAAGISKKIKIFEFIALFNDFIDIHYPVVEMSNRSRLSCVCWNNYIQNYLASTDYDGADKLWDANTGQGFSRFTEHEKMSSSVDFSLLCPTKFASGSDDCSVKLWSISERNSLGTIRNAANVCCVQFSTHSSHLLAFGSADYSAYCYDLRNLRSPWCVLAGHRKAVSYVKFLDSETLVSASTDNTLKIWDLNKTSPVGASINACSLTLSGHTNEKNFVGLSVADGYIACGSETNEVYTYYRSLPMPVTSHKFGSIDPISGKDTDDDNGQFVSSVCWRGKSGMLIAANSSGCVKVLQMV

SEQ ID NO: 2630 - protein, 300 aa, Glycine max
MATTTTEFDLDYEFPDLDYDLRYLSLAGIDALTAFQNLLPDAAMTSFSACGLIDPHCSQNLTPMHSTITATIDSQSTICATSNVGSPISANKPEGRENRTKGATSGSSEPSDEDDEAGACEQSTNPADMKRLRRKVSNRDSARRSSAREQAQLSELELQVEKLKVENATLYKQFTDASQHFREADTNNRVLKSDVEALRAKVKLAEDMVTRSSFTTLNYQLLQTQQHQMSTPPQLNTTNLRRMAHVSPTITVHGNDASYNGVTVGEQNSSALGNLDMTFNNINNGVMNNAMSCGTIWPLD

SEQ ID NO: 2631 - protein, 579 aa, Glycine max
KRIERWCLWLGCCLPVLYANSEGLADSGSDDSQHLELPNLNKSSGSANECIPPNVGSGSFLLPSGNNAFLVEDTDGRPSCSLDTRRVSCKRKAVEGNNGQSSDAGSSSYSQHTDGSAWHTIPTQDNAGSSSRRSIPSEEVNARLGLGIGDEASENVSDSKTAGSSESFHRNFRLRLNPSNPPNSVPPTAFSTGSMIRHSGVPPSSQVSQRLHFVDNSLNLRSAPPIDNVVPQSQPLVIHVPALPRNRQSFRWSGGSSSRNIHSSNSVICADRDQQDASSRRMSRNMLEHPVFVPATDLRNLVQNPTVRASSSSSENLSIPGNVASSSRTGSNPATNPSSATTFSRSNPPQHPRRLSEYVRRSLFSPSSDAIGSPSHNYSSLRSGLSTSEPRALSSGSGANPRSASWLERQGDSEFGIPYSLRTLAVASEGGSSRLVSELRNVLGLMRRGGNVRFEDVVILDHQSFLSGIADVRDRHRDMRLDVDNMSYEELLALEERIGNVSTGLSEETVLKHLKQRKHSAEKGPQIDAEPCCVCQEDYGDEDDIGTLDCGHDFHSSCIKQWLMHKNLCPICKTTGLAT

SEQ ID NO: 2632 - protein, 374 aa, Glycine max
  unsure (1)..(374): unsure at all Xaa locations
GTYHADGLDNRSDXIGHVEDGAGAGRRIXSLFAAHADAKDVYAVESLEMTEYARTLIVGNPPLTQRMTVIKGKGEDVXLAKKANILISEPMGTLLVNERMLESYXVIDKDRIIRSYXKMYPGVXEIHMAPFSDEYLFVEIANKALFWQQQNYYGVDLTPLHGTAFQGYFSQPVVDAFDPRLLIAAPMFHVLDFTKIKEEELYEIDIPLRFTATVGARLHGLACWFDVLFNGSTARRWLTTAPGXPTTHWYQLRCVLSQPIYVMAGQEITGRMHLIAHTAQSYTIFLTLSAKTWGPGAEQGGILQTSSCKLDLKEPYYRMSQPQAYPLTQDQQPQPFLQTQDIDIQSQDLDEVEIMQQPSPKSCAQIDSLMQNAS

SEQ ID NO: 2633 - protein, 542 aa, Glycine max
  unsure (1)..(542): unsure at all Xaa locations
MEESLGQKWKQPEFALASVSDLSLAPSSSASPGIARFNSDGLQIHHQSHQIPFNVDPRTVQLFKVSPRSXVCVVERSDXGKKTLYSRGSHNSSLKMKRRSAAVHCVVQQWKKEVNAQEGNGRNGTITTSKSKFDDKIESSSSKMYFHYYGQLLHQQNMLQDYVRTGTYHAAVLENRADFIGRVVVDVGAGSGLLSLFXAQAGAKHVYAVEASEMAEYARKLIAGNPTLAQRITVIKGKVEDVELPEKAXLLIYEPMGTLLVNKRMLESYVIAIDRFLFPNGKMFPAVGXGIHMAPFIDEYLFVEIANKALFWRQQNYYXGVDXTPLHGTAFQGYFSQPSXDAFDPKLLIXATMFHVLDFTKIKEEELYEXLDIPLKFTATVGARLHGLACWFDVLFNGSTARRWLTTAPGSPTTHWYQLRCVLSQPXIYVMAGQEITGRMHLIAHTAQSYTIYLKLSAKTWGPGAEQGGILQTSSCKLDLKEPYYRMSQPQAYPLAQDQQPQPLLQTQDIHIQSQELDEVEMMQQPSTKSCAQIDSLMQNAS

SEQ ID NO: 2634 - protein, 364 aa, Glycine max
MYSNMLVNCSNCRTPLQLPPGAGSIRCALCRAVTLIGDPRALPSQPPASTHAPPPPSSPYSHAPPPPNPHGRKKAVIVGISYRFSRHELKGCINDAKCMKYLLINKFSFPESSIIMLTEEEDPHGPKFPTKHNIRMAMYWLAQGCQPGDSLVFHYSGHGSQQRNYSGDEADGYDETLCPLDFETQGMIVDDEINAALVRPIPHGAKLHALIDACHSGTVLDLPFLCRMNRSGQYVWEDHRPRSGVWKGSSGGEVICFSGCDDHQTSADTSALSKITSTGAMTFCFIQAIERGHGATYGSILTAMRTSIRNVGGGGGGTGGGDVVTSLLSMLLTGGSLSGVGGLGQEPQLTACEAFDVHRKPFSL

SEQ ID NO: 2635 - protein, 192 aa, Glycine max
  unsure (1)..(192): unsure at all Xaa locations
AGLIXRYGFSEDDITVLIDTDESYTEPTGKNIRSALTRLVRSAEPGDVLFVHYSGHGTRLPAETGEDDDTGYDECIVPSDMNLITDDDFREFVDGVPRGCRITIVSDSCHSGGLLEEAKEQIGESTKGEEEQSSSGFGFSSFLMSPLITALWCICCYLTILRGDQTIRASSMHQTTDFGSVNLNKMVYVKLL

SEQ ID NO: 2636 - protein, 415 aa, Glycine max
MAKKAVLIGINYPGTKAELRGCINDVWRMHRCLIERYGFSEDDITVLIDTDESYTEPTGKNIRSALTRLVRSAEPGDVLFVHYSGHGTRLPAETGEDDDTGYDECIVPSDMNLITDDDFREFVDGVPRGCRITIVSDSCHSGGLLEEAKEQIGESTKGEEEQSSSGFGFSSFLHRTVEDAIESRGFHIPSALRHNRGRDDDGDEAQNRDIELPDGGYVKNRSLPLSTLIDILKQKTGKDDIDVGKLRPTLFDVFGEDASPKVKKFMNVIFNKLQHGSDESGGGILGLVGGLAQEFLKQKLDDNDEGYAKPALETKVESKHEAYAGPTKRGLPDGGILMSGCQTDQTSADASPAGNAASAYGAFSNAIQAIIEETDGAITNQELVQRAREKLKNSGFTQKPGLYCSDHHVDAPFVC

SEQ ID NO: 2637 - protein, 518 aa, Glycine max
  unsure (1)..(518): unsure at all Xaa locations
MAESLKDYEEDFENPEKKPRRNKYAFACAILASMTSILLGYDIGVMSGAALYIQRDLKVSDVQIEILNGIINLYSPVGSFIAGRTSDWIGRRYTIVLAGAIFFVGAIFMGFSPNYAFLKLRRXLXNLVAPVAVMIXPFPSGHDQPPTIHXEATSSLQVFLNGGILIGYISNYGFSKLALRLGWRLMLGVGAIPSILIGVAVLAMPESPRWLVAKGRLGEAKRVLYKISESEEEARLRLADIKDTAGIPQDCDDDVVLVSKQTHGHGVWRELFLHPTPAVRHIFIASLGIHFFAQATGIDAVVLYSPRIFEKAGIKSDNYRLLATVAVGFVKTVSILVATFFLDRAGRRVLLLCSVSGLILSLLTLGLSLTVVDHSQTTLNWAVGLSIAAVLSYVATFSIGSGPITWVYSSEIFPLRLRAQGVAIGAAVNRVTSGVIAMTFLSLQKAITIGGAFFLFAGVAAVAWIFHYTLLPETRGKTLEEIEKSFGNFCRKPKAEEGLDDNVEIQLKTRDQTLTSVD

SEQ ID NO: 2638 - protein, 587 aa, Glycine max
  unsure (1)..(587): unsure at all Xaa locations
MQRMAYTFSFPEEVLEHVFSFIWNERDRNAISLVCKSWYEIERWCRRKVLVGNCYAVSPLMVVKRFPEVRSIALKGKPHYADFNLVPEGWGGYVWPXIGAMASAFPWLEEIRLKKMVITDESLELIAKSFKNFKVLVLTSCEGLTSDGLAAIAANCRNLRELDLQESEVEEDLSGHWLSHFPDSYTSLVSLNISCLNNEVSLSALERLLGRCPNLRTLRLNRAVPLDRLPNLLLQCPQLVELGTGVYSTEMRPEVFSNLEAAFSGCKQLKSLSGFWDVLPSYLPAVYPICSRLTSLNLSYAIIQSSDLIKLISQCPNLLRLWVLDYIEDAGLYALAASCKDLRELRVFPSDPFGLEPNVALTEQGLVSVSEGCPKLQSVLYFCRQMSNAALHTIARNRTNLTRFRLCIIEPRTPDYLTHEPLDSGFGAIVEQCKDLQRLSLSGLLTDRVFEYIGTYGKKLEMLSVAFAGDSDLGLHHVLSGCDNLRKLEIRDCPFGDKALLANAAKLETMRSLWMSSCLVSYGACKLLGQKMPRLNVEVIDERGPPDSRPESSPVEKLYIYRTVSGPRLDMPGYVWRMQDDSALRIS

SEQ ID NO: 2639 - protein, 208 aa, Glycine max
MGRGKIEIKRIENSSNRQVTYSKRKNGILKKAKEITVLCDAQVSLIIFAASGKMHDYISPSTTLIDILERYHKTSGKRLWDAKHENLNGEIERLKKENDSMQIELRHLKGDDINSLNYKELMALEDALETGLVSVREKQMDVYRMLRRNDKILEEENRELNFLWQQRLAEEGAREVDNGFDQSVRDYNSHMPFAFRVQPMQPNLQERI

SEQ ID NO: 2640 - protein, 119 aa, Glycine max
LRGHAVASWTWDAQDETCGICRMAFEGCCPDCKLPGEDCPLIWGVCNHAFHLPCILKWVNFQTSQGHCPMCRREWPFKGRELRFSFSFSRGPQEPRKMGRVNPKRNGSLQVKPDFPWNL

SEQ ID NO: 2641 - protein, 109 aa, Glycine max
MDSGPPANDLCSVCHGNFHIPCQANCSHWFCGNCIMLVWQHGSVGCSCKCPLCRRAISLLVPTEESLRQQQDPEVSQILSKIHAYNRFFGGQPTTLYQRLRDLPFLLHR

SEQ ID NO: 2642 - protein, 186 aa, Glycine max
MDSGPPANDLCSVCHGNFHIPCQANCSHWFCGNCIMLVWQHGSVGCSCKCPLCRRAISLLVPTEESLRQQQDPEVSQILSKIHAYNRFFGGQPTTLYQRLRDLPFLLHRLLREFLHPHRSLPLLIRARVFVVMIASVIYLFSPIDIIPEGILGVVGFLDDLLIVLICFLHVAALYRSVLYLRHGGS

SEQ ID NO: 2643 - protein, 271 aa, Glycine max
GEPATEKREDFGKLQYGCEHYKRRCKIRAPCCNQIFPCRHCHNDAANSSSNPADRHELVRRDVKQVICSVCDTEQEVAKVCSSCGVNMGEYYCEICKFYDDDTDKGQFHCDECGICRVGGRDKFFHCKKCCACYSVSVQNNHSCVENSMKSFCPICLEYQFDSIKGSTILKCGHTMHMECYREMATQNQYRCPICLKTIVNDMNWEYLDREIEGVHMPEEYKFEVSILCNDCNSTSTVSFHIFGHKCLQCGSYNTRRISKPKQEGLGVSGT

SEQ ID NO: 2644 - protein, 100 aa, Glycine max
  unsure (1)..(100): unsure at all Xaa locations
MSGVWVFKNGVVRLVENHGSDRKVLVHTASNEIITSYAVLEHKLSSLGWERYYDDPDLLQFHKRSTVHLISLPRVXNKFRSMHMYDIVVKNKNYFEVRDI

SEQ ID NO: 2645 - protein, 100 aa, Glycine max
MSGVWVFKNGVVRLVENPGSERKVLVHTASNEIITSYAVLEHKLSSLGWERYYDDPDLLQFHKRSTVHLISLPRDFNKFRSMHMYDIVVKNKNYFEVRDM

SEQ ID NO: 2646 - protein, 383 aa, Glycine max
MHSQKVVEMEDKTESHMSSAAAFVEGGIQESCDDACSICLEEFGASDPSTVTTCKHEFHLQCILEWCQRSSQCPMCWQPISLKDPTSQELFEVVEQERSLRATPSRNAAIFHHPAFGDFELQHLRMSLNDADFEERIIQHLAAAAAMRRANQLGWREGQRARSSAHGHPQFLVFSNQPIAPSSVAGGENDPTAIPNRSPSTPITSVGNEASQQILHLQTQSSSSASGSPVMATNPRGIYSNERGSTACSSPANQDRAEPSELQSFSDSLRSRLNAVSMRYKESISKGTRGWKERLFSRSSSMSKLGSETRRREINSGIASVSRLMESLETSENNRVVGTSLSNHTEGCSIGGVSNQNNVEARGENSSHDDNTPAACSANSHLN

SEQ ID NO: 2647 - protein, 295 aa, Glycine max
MDVRKRGRPDVNLNGAVKKTKQELESLSSGVGSKSKPCTKFFSTAGCPFGEGCHFLHYVPGGYNVVAHMMNLKPAAPPPRTVAAPPPIPNGSAPSAVKTRICNKFNTAEGCKFGDKCHFAHGEWELGKPIAPSIDDHHHHRPLGPPAGGRMAGRIEPPPAMAGSFGAISTAKISVEASLAGAIIGKGGVNSKQICRQTGAKLSIREHESDPNLRNIELEGTFEQIKEASNMVKDLLLTVSMSAPPKSTPGVPGAPAPPGSNFKTKLCENFAKGSCTFGERCHFAHGAAELRKSGV

SEQ ID NO: 2648 - protein, 615 aa, Glycine max
MDAVLQTRGLLSLPANPVNRISLFNPSQGLKHRFFSPKPKNLSGSSLSSNGFPKLSPRPNNVFAQRDQNKNLFLCRAEAAAASFGEPESEKQKFLGIEVATLKKIVPLGMMFFCILFNYTILRDTKDVLVVTARGSSAEIIPFLKTWVNLPMAIGFMLLYTKLANVLSKQALFYSIILPFIAFFGAFGFVLYPLSNYIHPEAFADKLLNILGPRFLGPLAIMRIWSFCLFYVMAELWGSVVISVLFWGFANQITTIDEAKRFYPLFGLGANVALVFSGRTVKYFSNLRSTLGPGVDGWAISLKAMMSIVVGMGFAICFLYWWVNNYVPLPTRSKKKKEKPKMGTMESIKFLVSSKYIRDLATLVVAYGISINLVEVTWKSKLKAQFPSPNEYSSFMGDFSTATGIATFIMMLLSQFIFDKYGWGVAAKITPTVLLLTGVGFFSLILFGGPIAPVIAKFGMTPLLAAVYVGAMQNIFSKSAKYSLFDPCKEMAYIPLDEDTKVKGKAAIDVVCNPLGKSGGALIQQFMILTFGSLANSTPYLGGVLLVIVLAWLSAAKSLDTQFTALRREEELEKEMERAAAVKIPVVAKDEDGNGSLKSVPLLNPTAGDSSSTLN

SEQ ID NO: 2649 - protein, 271 aa, Glycine max; identical to SEQ ID NO: 702

SEQ ID NO: 2650 - protein, 62 aa, Glycine max
YIYIYRDILPSKIENKSDDYVFVYYRGKNHAWDGYGGAVVYTRSAVLPESIVPELEKASHSV

SEQ ID NO: 2651 - protein, 384 aa, Glycine max
MLKFEADRMLVFLKDWSNIRITAVAAILVSILMIIPPADAVDALKTCACLLKDCRIELAKCLSNPSCAANIACLQTCNNRPDETECQIKCGDLFENSVVDEFNECAVSRKKCVPKKSDVGEFPAPNPDVLVNSFNIADFSGKWFITSGLNPTFDTFDCQLHEFHTESNKLVGNLSWRIRTPDAGFITRSAEQRFVQDPSYPGILYNHDNKYLHYQDDWYILSSKIENKSDDYVFVYYRGRNDAWDGYGGAVVYTRSAVLPESIVPELEKASKSVGRDFSKFIRTDNTCGPEPSLVERLEKKVEEGEETIVREVEQIEEEVEKVGKTEATLFQKLAEGFKMFQEDEENFLRGLSKEEMEILDGLKMEAGEVEKLFGRALPIRKLR

SEQ ID NO: 2652 - protein, 420 aa, Glycine max
MDKDKSLGLPPPSGRYSGYSSTGSVFNVKSEPSPSSSTTLYPPLAPGTTSSESSHFGHGLSTDSSGFSHDISRMPDNPPRNRGHRRAHSEILTLPDDISFDSDLGVVGGGDGPSFSDDAEEDLLSMYLDMDKFNSSSATSTFQMVEPSNAVGASASTPASGAPTSSTENVVIGTNERPRVRHQHSQSMDGSTTIKPEMLVSGSEDMSAADSKKAMSAAKLAELALIDPKRAKRIWANRQSAARSKERKMRYIAELERKVQTLQTEATSLSAQLTLLQRDTNGLNSENNELKLRLQTMEQQVHLQDALNDALKEEIQHLKILTGQAMPPNGGPMMNFASFGGGQQFYPNNHAMHTLLAAQQFQQLQIHPQKQQQHQFQQLQQQQREQHQQSIDLKMREATPTPCPKDNASSDVNPSGAKDC

SEQ ID NO: 2653 - protein, 232 aa, Glycine max
MDFALNPCPLRSSTFVNFVERVKQLGTLAVSAVIGNIFSAILTFCFALVGTLLGALTGALIGQETESGFIRGAAVGAISGAVFSIEVFESSLVLWQSDESGIGCVLYLIDVIVSLLSGRLVRERIGPAMLSAVQSQMGAVETSFDEVQNIFDTGGSKGLSGDLVDKIPKIKITTDNNVDASGDRVSCSVCLQDFMLGETVRSLPHCHHMFHLPCIDKWLFRHGSCPLCRRDL

SEQ ID NO: 2654 - protein, 179 aa, Glycine max
MTMEELSSLSSVERNIHIASVLEAMAVDTIFAAAKSLLCFSILTGSLLTDINHSVSPKLTPMDGRFAFDDLCKGKHTYRLNKDASDSDEDEDEEDDHDTNDQNDEEGDEDFSGEGEEEADPEDDPEANGAGGSNDDDDSDEDDDDDNDGDDDGEDEDEKEGEDEEDEEEVPQPPTKKRK

SEQ ID NO: 2655 - protein, 357 aa, Glycine max
LYYNLKCLLYLQAYYGPRVTMPPYYNSAVASGHVPHPYMWGPPQVALLSSSRSRAAIYPHGGVYTHPAVPIGPLTHSQGVPSSPAAGTPLSIETPPKSSGNTDQGLMKKLKEFDGLAMSIGNGHAESAEPGGENRLSQSVDTEGSSDGSDGNTSGANQTRRKRSREGTPTTDGEGKTEMQGSPISKETAASNKMLAVVTAGVAGTIVGPVVSSGMTTTLELRNPSSVHSKASAPQPCPVLPAETWLQNERELKRERRKQSNRESARRSRLRKQAETEELARKVESLNAENATLKSEINRLTESSEKMRVENATLRGKLKNAQLRQTQEITLNIIDSQRATPISTENLLSRVNNNSRF

SEQ ID NO: 2656 - protein, 403 aa, Glycine max
  unsure (1)..(403): unsure at all Xaa locations
MGNSEEEKSTKTEKPSSPVTVDQANQTNQTNIHVYPDWAAMQAYYGPRVTMPPYYNSAVASGHAPHPYMWGPPQPMMPPYGPPYAAIYPHGGVYTHPAVPIGPHTHSQGVPSSPAAGTPLSIETPPKSSGNTDQGLMKKLKEFDGLTSLRPAGLAMSIGNGHAESAERGGENRLSQXDGEGKTEIQGSPISKETAASNKMLGVVPASVAGTIVGHVVSSGMTTALELRNPSSVHSKTSAPQPCPVLPAEAWVQNERELKRERRKQSNRESARRSRLRKXQAETEELARKVESLNAENATLKSEINRLTESSEKMRVENATLRGKLKNAQLGQTQEITLKIIDSQRATXXVSTENLLSRVNNNSGSNDRTVEDEKXFCENKPNSGAKLHQLLDTSPKADAVAAG

SEQ ID NO: 2657 - protein, 307 aa, Glycine max
MKGSNNRFFTVALVAAWYSSNIGVLLLNKYLLSNYGFKYPIFLTMCHMTACSLLSYVAIAWMKVVPLQSIRSRVQFFKISALSLVFCVSVVFGNISLRYLPVSFNQAIGATTPFFTAVFAYLMTFKREAWLTYLTLVPVVTGVIIASGGEPSFHLFGFIICVAATAARALKSVLQGILLSSEGEKLNSMNLLLYMSPMAVVFLLPATLIMEENVVGITLALARDDSKIIWYLLFNSALAYFVNLTNFLVTKHTSALTLQVLGNAKGAVAVVVSILIFRNPVSVTGMMGYSLTVFGVILYSEAKKRSK

SEQ ID NO: 2658 - protein, 333 aa, Glycine max
MSSLITDLLRQTGGTAVIDGGLATELERHGADLNDPLWSAKCLFSFPHLIRQVHLDYLENGADIIITASYQATIQGFKAKGYSDEESEALLRSSVEIAREAREVYYKNCAGCRSGDGDDDGRILKQRPILVAASVGSYGAYLADGSEYSGDYGDAITVETLKDFHRRRVQILADSGADLLAFETVPNKLEAEAYAQLLEEEDIKIPAWFSFNSKDGVNVVSGDSLMECGSIAESCNKVVAVGINCTPPRFIHGLIVLLKKVTTKPIVIYPNSGETYDADLKEWVQNTGVTDEDFISYVNKWCELGASLVGGCCRTTPDTIRKIYRTLSSSQSI

SEQ ID NO: 2659 - protein, 68 aa, Glycine max
EKDAAVGHSKNNNDLAFFTYDEKRNLGYGTQKERLGKDSIKPFDACSLCLKSLIDPMSGQKGHLFCKE

SEQ ID NO: 2660 - protein, 304 aa, Glycine max
  unsure (1)..(304): unsure at all Xaa locations
MPQRHSKNNNDLAFFTYDEKRKLGYGTQKERLGKDSIKPFDACSLCLKSLIDPMSCQKGHLFCKECILQCLLSQKKDIQRKLAAHAAQQKQEKEEEEEKLKLQKAKELDAFDQQNHGAVPQYSDRNYSRDKNGFHGANSVKVTSYEEEALRTMKAFWLPSATPEASIKVDAPSNSTICPEGNEKLKLKTLFPVQFTEDTTEQKKXKALDKTYICPSCKVTLTNTMSLVALSTCGHVFCKKCADRFMAVDKVCLVCNKACKERNLVNLEKGGTGFAGHGDHLEARDFKHLGSGSGLGLVRPAMKT

SEQ ID NO: 2661 - protein, 55 aa, Glycine max
MPQRHSKNNNDLAFFTYDEKRKLGYGTQKARLGKDSIKPFDACSLCLKSLIDPMS

SEQ ID NO: 2662 - protein, 196 aa, Glycine max
MGSGKSKTVSSDVGYVPLDSGHARLRQLGYKQELNRHLSVISNFAFSFSIISVLTGVTTLYNTGLNYGGPVSFVYGWFIASGFTMIVALSMAEICSSYPTSGGLYYWSAKLAGPRWAPFASWITGWFNIVGQWAATTSVDYSLAQLIHVIILLTTGGKNGGGYEASIYVPIAVHGGMLLLHGMINRLPISLISFLG

SEQ ID NO: 2663 - protein, 530 aa, Glycine max
  unsure (1)..(530): unsure at all Xaa locations
LVHHYSWDLVKAKQSPRSGRKRATPHLYSGPARLLHLGYKQELKRHLSVISNFPFAFSIISVLTXGVTTLYNPGLNYGGPVSLVYGWFLASAFTMIVALSMAEICSSYPTSGGLYYWSAKLAGPRWAPFASWITGWFNIVGQWAVTTSVDYSLAQLIQVIILLSTGGKNGGGYEASKYVVIAFHGGILFLHGIINSLPISLLSFLGQLAAIWNVIGVFVLMIVIPSVATERASAKFVFTHFNTENGEGINSKPYIFLLGLLLSQYTLTGCDASAHMTEETKDADRNGPKGIISAVGISIVVGWGYILGITFAVTDILYLLSEDNDTGGYAIAEVFYQAFKKRYGHGTGGIFCLVIVALAIFFCGMSSVTSNSRMAYAFXSRDGAMPLSSLWHQVNKQEVPIYAVWLSVFKSFCMALTSLGSIVAFEAMVSIATIGLYIAYALPIFFRVTLAQKHFVHGPFNLGRYGVIVGWVAVLWVVFISILFSLPVSYPITIETLNYTPVAVGCLLILVVSYWLISGRRWFRGPITNI

SEQ ID NO: 2664 - protein, 290 aa, Glycine max
MGSDKILPSHVVANGHAPLDSGHARLKELGYKQELKRDLSVISNFAFSFSIISVLTGVTTLYNTGLNYGGPVSLVYGWFLASAFTMIVALSMAEICSSYPTSGGLYYWSAKLAGPRWAPFASWITGWFNIVGQWAVTTSVDYSLAQLIQVIILLSTGGKNGGGYEASKYVVIAFHGGILFLHGIINSLPISLLSFLGQLAAIWNVIGVFVLMIVIPSVATERASAKFVFTHFNAENGEGINSKPYIFLLGLLLSQYTLTGFDASAHMTEETKDADRNGPKGIICAVVMKF

SEQ ID NO: 2665 - protein, 476 aa, Glycine max; identical to SEQ ID NO: 648

SEQ ID NO: 2666 - protein, 170 aa, Glycine max
MADSDNDSGGAHNGGKGSEMSPREQDRFLPIANVSRIMKKALPANAKISKDAKETVQECVSEFISFHSPGGLAGECQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 2667 - protein, 188 aa, Glycine max
MADSDNDSGGAHNAGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPPTNATNSAYESPSYAAAPGGIMMHQGHVYGSAGFHQVAGGAIKGGPVYPGPGSNAGRPR

SEQ ID NO: 2668 - protein, 400 aa, Glycine max
MSFRSIILERKGFEVKFGYSMRSRSQSHSDAIAQDSLVVLDGLKQSCWANMPPELLRDVLMRIEASEDSWPAQKHVVACAGVCRSWREIMKEIVKSPQLSGKLTFPISLKQPGPRDSLLQCYIKRNRSNQTYYLFLGLNQASTDEGKFLLSARKCRRATHTDYIISLNCDDVSRGSSTYIGKLRSNFLGTKFTVYDAHPPIYGAKVTKSRSSRLVSLKQVSPRVPAGNYPIAHVSYDLNVLGSRGPRIMQCVMDAIPASAVEPGGVAPTQTQFLHSRIDTSPSIPFFRSKSTRMDNLPTVPLTCQNEGTLVLRNKSPRWHEHLQCWCLNFNGRVTVASVKNFQLVASPKNGVSEQAQENVILQFGKVGKDVFTMDYQYPISAFQAFAICLSSFDTKIACE

SEQ ID NO: 2669 - protein, 234 aa, Glycine max
MAAKIFCFLMLLGLSASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQQQLPFSQLSAAYPQQFLPFNQLTALNSPAYLQQQQLLPFSQLAGVSPATFLTQPQLLPFYQHAAPNAGTLLQLQQLLPFNQLALTNPTAFYQQPIIGGALF

SEQ ID NO: 2670 - protein, 151 aa, Glycine max
MTCSLKEKNAVERLKLEMSGKGAKGLITAKNPSSSKDKDKKKPISRSSRAGLQFPVGRIHRLLKSRVTAHGRVGATAAVYSAAILEYLTAEVLELAGNASKDLKVKRITPRHLQLAIRGDEELDTLIKGTIAGGGVIPHIHKSLINKSSKE

SEQ ID NO: 2671 - protein, 128 aa, Glycine max
MSGKGAKGLITAKDKDKKKPISRSSRAGLQFPVGRIHRLLKSRVTAHGRVGATAAVYSAAILEYLTAEVLELAGNASKDLKVKRITPRHLQLAIRGDEELDTLIKGTIAGGGVIPHIHKSLINKSSKE

SEQ ID NO: 2672 - protein, 341 aa, Glycine max
MVSEGILLGIGNPLLDISAVVDQDFFKKYDITSNNAILAEDKHTPMFEELVEKYNVEYIAGGATQNSIKVAQWMLQVPGATSYMGGIGKDKFGEEMKKNSRLAGVNVHYYEDETTPTGTCAVCIVGDDRSLVANLAAANCYKSDHLKRPENWALVEKAKYIYIAGFFLTVSPDSIQLVAEHAAANNKIFSMNLSAPFICEFFRDVQEKALPYTDFVFGYETEARTFSKVHGWETDNVEEIALKISQWPKASGTHKRITVITQGVDPVCVAEDGKVKKFPVQLLPKEKLVDANGTGDAFVGGFLSQLVQEKPIEECVRAGCYAANVIIQRSGCTYPEKPDFH

SEQ ID NO: 2673 - protein, 462 aa, Glycine max
MESSPSSSSSSMSSSSGSDTSGGGGGGAVTWFGMSFPFRSPLSLVMDYCAREDSAEPVIIIPRTRPRFQAHAESDAASASDSDENACNGAAEEVAIRIIGVGEQESGSSPSSSRGRGGELGGEEAVVGRSGMLSSRRRMAEERVPLVSLDDGIVGARDSSSSSSSSTYQRYDIQQVAKWIEQILPFSLLLLIVFIRQHLQGFFVTICISAVMFKSNEIVKKQTALKGDRKVSVLLGISFAFMLHVISIYWWYRNDDLLYPLAMLPPKTPPPFWHTIFIILVNDTLVRQAAMAFKCLLLIYYKNGRGHNFRRQGQMLTLVEYTLLLYRALLPTPVWYRFFLNKDYGSLFSSLTTGLYLTFKLTSVVEKVQCFVSALKALSKKEVHYGVHATTEQVNAAGDMCAICQEKMQAPILLSCKHMFCEECVSEWFERERTCPLCRALVKPADLRTFGDGSTSLFFQLF

SEQ ID NO: 2674 - protein, 447 aa, Glycine max
MQRWKWNRKKPPIFPLLVLILLFFIAFSTLHSEHTIQRIHENPDHVHNHQEVSSATFVKPNLSGHLKQAPEVLDRFSRCNSTVEYSGRKIAWLGDSRHSGHWSARPESCDVFSGKWVFDNVSHPLYNESDCPYMSDQLACHKHGRSDLGYQYWRWQPHNCNLKRWNVKEMWEKLRGKRLMFVGDSLNRGQWISMVCLLQSVIPADKRSMSPNAHLTIFRAEEYNATVEFLWAPLLAESNSDDPVNHRLDERIIRPDTVLRHASLWENADILVFNTYLWWRQGPVKLLWTHEENGACEELDGHGAMELAMGAWADWVSSKVDPLKKRVFFVTMSPTHLWSREWKPGSEGNCYGEKDPIDNEGYWGSGSDLPTMSTVEKILSNLSSKVSVINITQLSEYRKDGHPSIFRKFWEPLRPEQLSNPPSYSDCIHWCLPGVPDVWNELLFHFL

SEQ ID NO: 2675 - protein, 203 aa, Glycine max
MATTTLMKLAFMLLMNLVICSAESSIGRKSNPNPEEFVKSSCRATRYPVLCVKSLLAYASVIRRSDRQLATTALSVSISRSRSSAWLVKKMLKARGMKPREYRAVQDCVENIGDSVDRLRQSVTELGRTGEDFVWHMSNVQTWVSAALTDDSTCLDGFAGSAMNGNVKALIKDRIVHVAQVTSNALALVNRFASRHPSATQTP

SEQ ID NO: 2676 - protein, 281 aa, Glycine max
MGAPKQKWTAEEEQALKAGVVKHGVGKWRTILKDPEFSSVLYLRSNVDLKDKWRNLSVMANGWSSREKSRLSVRRVHQVPRQDENSMAITAVAPSDEEIVDVKPLQVSRDMVHIPGPKRSNLSLDKLIMEAITCLKENGGSNKTAIAAFIEDQYWALPGLKINRKYRIAPIAAYSDRRRNSSVLYLEGRQKASMKIDRDETNILTRSQIDLELEKIRSMTPQEAAAFAARAVAEAEAAIAEAEEAAKEAEAAEADAEAAQAFADATTKSAKGRKSPKRIHA

SEQ ID NO: 2677 - protein, 543 aa, Glycine max
MGENEEAMQRLHFLKQPLNMEQLSIPQFNPSQMRARQHHHQNQFDGGNSNKRAGIPPSHPHPILPISPYSQIPVSRQHNNISPTPTHTRSLSQPSFFSLDSLPPLSPSPFRDSSSTSVSEAADVSMEDRDVSAHALLPPSPFSRTLNNSNLPLPPRKAHRRSNSDIPFGFSTVLQSSPPLIPLRNPVSAKPAQLVKRETPWDRVVEHNTNTNNNNNVEGSGEKKSPEGEVVDDLFSAYMNLDSFDALNSSGTDDKNGGENRDDLDSRACGTKTNGGDSSDNEAESARDESGHGGSEKREGMKRSAGGEIAPTTRHYRSVSMDSFIGKLNFGDESPKLPPSPGQRGGLMSPAGGIDGNSAAFSLEFGNGEFSGPELKKIMANEKLAEIALTDPKRAKRILANRQSAARSKERKMRYISELEHKVQTLQTEATTLSAQLTLLQRDSAGLTNQNSELKFRLQSMEQQAKLRDALNEALTAEVQRLKIATAELSSDSHGSSCLIPQHSVNPLMFQQQPPFASQQNIHLQQQQHRQNGNANSNSDLKQ

SEQ ID NO: 2678 - protein, 617 aa, Glycine max
  unsure (1)..(617): unsure at all Xaa locations
MEWDSNSDLSGDEEEEGFVFNDGDDAGPLPFPFPVVENLLQTAPCGFVVTDAHEPDNPIIYVNTVFEIVTGYRAEDVLGRNCRFLQGRGSFSKSALQLLDSTVVSEIRRCLEVWIEVQDEWRNFSXEGSPLMNRLRLSPIYGDYESHTLVRGIRLFTKSFKDRGPVRGSMIKVSAKWSDRFRSVLSSLQTLPVVCRNVSRGVCGIFQLSDEVLSLKILAQLTPRDIASVSSVCRRLYELTKNEDLWRMVCQNAWGSETTHVLETVPGARRLGWGRLARELTTLEAAAWRKLTVGGAVEPSRCNFSACAVGNRVVLFARRRQNVQPMNDTFVLDLNSSNPEWQHVQVSSPPPGRWGHTLSCVNGSHLVVFGGCGRQGLLNDVFVLDLDAKPPTWREISGLAPPLPRSWHSSCTLDGTKLIVSGGCADSGVLLSDTFLLDLSMEKPVWREIPVAWTPPSRLGHTLSVYGGRKILMFGGLAKSGPLRFRSSDVFTMDLSEEEPCWRCVTGSGMPGAGNPGGIAPPPRLDHVAVSLPGGRILIFGGSVAGLHSASQLYILDPTDEKPTWRILNVPGCPPRFAWGHSTCVVGGTRAIVLGGQTGEEWMLSELHELSLASSAI

SEQ ID NO: 2679 - protein, 168 aa, Glycine max
MATATYPPPPPYYRLYKDYLQDPNSAPDPPPPIEGTYLCFGANYTTSDVLPTLEEQGVRQLYSKGPNVDFKKELRSLNGELQLHVLELADILIERPSQYARRVEEISTVFKNLHHLLNSLRPHQARATLIHILELQIQRRKQAVEDIKKRREEARRLLNESLATLDGH

SEQ ID NO: 2680 - protein, 542 aa, Glycine max
TLKTAAVAEAIVCISAFSITVVAEDPYRFFNWNVTYGDIYPLGVRQQGILINGQFPGPDIHSVTNDNLIINVFNSLDQPFLLSWNGVQQRRNSFEDGVLGTTCPIPPGGNFTYILQVKDQIGSFYYFPSLAFHKAAGGFGGIRILSRPRIPVPFDDPAGDYTVLIGDWYKLNHTDLKSQLDSGRKLPFPDGILINGRGSNGAYFNVEQGKTYRLRISNVGLENSLNLRIQNHKLKLVEVEGTHTLQTTYSSLDVHVGQSYSVLVTADQPAQDYYIVVSSRFTSTVLTTTGILRYSNSAGPVSGPPPGGPTIQIDWSLNQARSIRTNLTASGPRPNPQGSYHYGLINTTRTIILSGSPGIVNGKQRYAINSVSYVAPDTPLKLADYFKIPGVFRVGSISDRPTGGGIYLDTSVLQTDYRTFVEFVFQNDEDIIQSYHLDGYSFFVVGMDGGQWTPASRNTYNLRDAVSRCTTQVYPKSWTAIYIALDNVGMWNLRSEFWARQYLGQQFYMRVYTTSTSIRDEYPVPKNALLCGRASGRHTRPL

SEQ ID NO: 2681 - protein, 412 aa, Glycine max
  unsure (1)..(412): unsure at all Xaa locations
MSTSSRVLPTPLENKYMKPPNSLFSFRPLSDLTANSASSNSITKCWAGKMFSSPSKCPDDFPFSSVSQHDRQYQDPPFVSQTIGDSVSSEIHSMTFISHPQENEDLSWGPDPCQDILGFPENVSVQHDQVENNGCYINDDNVKRSDFGEWVDQLMSIDDSLHPSWSQLLADDNVAEPKPKXSQVPPQQHIPSGEVVGNSASTASQTKARMRWTPELHEAFVEAVNHLGGSEKATPKGVLNQMKVEGLTIYHVKSHLQKYRTARYKPEPSEGTSEKKVTPMEEMKSLDLKTSKGITEALRLQMELQKRLHEQLEIQRKLQIQIEDQGKRLQMMFEKQREMGDSKVNVSLDEPSAAAPSDTVETTNEERHKFESIPKAIPEEKESSTTKQIAGEAEEMIKEDEVAPPTKRVKSS

SEQ ID NO: 2682 - protein, 358 aa, Glycine max
  unsure (1)..(358): unsure at all Xaa locations
MDRDNKSPPPSSLYVKSSSSSFSHDDISAMPENPPKNRGHRRAHSEIITLPDDLSFDADLLPDDDNDLLSLYLQFDQLDSSSLPPPPPPPPPHNNINERSTRVRHQHSHSMDGSIHLEMLLSAASAADDVSGGIDTKKAMSADKLAELALVDPKRAKRIWANRQSAARSKERKMRYISELERKVQTLQTEXTSLSAQLTLLQRDTHGMTAENSELKLRLQTMEQQVHXLQDALNDALKEEIQHLKALTGQVMPNGGPVNFASFGGGQQFYPNNQAMHTLLAAQKFQQLQIHSQKQQQHQLQQQQQFQHQLQQQQQFHQQQQQLQLQQQLQQQQQQQQQQQQQQTAATGTVTSTNGGHE

SEQ ID NO: 2683 - protein, 385 aa, Glycine max
  unsure (1)..(385): unsure at all Xaa locations
MDNRDNKSPPPLPPSSSRYVKSEQQASLSASSSFSHDDISGMPENPPKNXGHRRAHSEIITLPDDLTFDVDLPDDNDLLSIYLQFDQLDSSPLPLPPPGSSNSIANNNNNNNNKNNNNNNERPTRVRHQHSLSMDGSIHPDMLLSATAAAADDVSGGGIDTKKAMSADKLAELALVDPKRAKRIWANRQSAARSKERKMRYISELERKVQTLQTEATSLSAQLTLLQRDTTGMTAENSELKLRLQTMEQQVHLQDALNDALKEEIQHLKALTGQVMPNGGPVNFASFGGGQQFYPNNQAMHTLLAAQKFQQLQIHSQKQHQLQQQQQFQQQQQFQQLQQLQLQQQQQLQLQQQQQQQQQQQQQQQQQQQQQQQLQLQQQQQQQEQ

SEQ ID NO: 2684 - protein, 297 aa, Glycine max
  unsure (1)..(297): unsure at all Xaa locations
RAVFSFFFTFFFSYKFEANVVISWRDYFLRVVPTALGTAMDVNLSNVSLVFISVTFATMCKSAAPIFLLLFAFAFRLETPSVKLFRIILITSETILYTVAXRARFCFLWFCYVGPPLIYILAIRVELKTKLXKEAYGLKNPLVLMSYVSPVMAAATALLSLALDPWDEFRENKYFDNSLHITRSCLLMLLGGTLAFFMVLTEYVLVSVTSAVTVTIAGVVKEAVTILVAVLYFHDQFTWLKGFGLLTIMVGVSLFNWYKYLKLQKGHADGSDVAEHSRDSAAKYVILEEMEEQEDGI

SEQ ID NO: 2685 - protein, 812 aa, Glycine max
MSTQPKLGRIPSIRDRVEDTLSAHRNELISLLSRYVAQGRGILQPHNLIDELDNIPGDDQAIVDLKNGPFGEIVKSAKEAIVLPPFVAIAVRPRPGVWEYVRVNVSELSVEQLSVSEYLSFKEELVDGKINENFVLELDFEPFNATFPRPTRSASIGNGVQFLNRHLSSIMFRNKDSLQPLLDFLRAHKYKGHALMLNDRIQTISKLQSALAKAEDYLSKLAHDTLYSEFEYVLQGMGFERGWGDTAERVLEMMHLLLDILQAPDPSTLETFLGRVPMVFNVAILSPHGYFGQANVLGLPDTGGQVVYILDQVRALENEMLLRIKKQGLDFTPRILIVTRLIPDAKGTTCNQRLERVSGTDHTHILRVPFRSESGTLRKWISRFDVWPYLETYAEDVASEIAAELQGYPDFIIGNYSDGNLVASLLAYKMGVTQCTIAHALEKTKYPDSDLYWKKFEDKYHFSCQFTADLIAMNNADFIITSTYQEIAGTKNTVGQYESHAGFTLPGLYRVVHGIDVFDPKFNIVSPGADMSIYFPYSEKQNRLTALHGSIEQLLFAPEQTDEYIGLLKDKSKPIIFSMARLDRVKNITGLVESFGKNSKLRELVNLVIVAGYIDVKKSSDREEIAEIEKMHELMKKYNLVGDFRWIAAQTNRARNGELYRYIADTQGAFVQPAFYEAFGLTVVEAMNCGLPTFATCHGGPAEIIEHGISGFHIDPYHPDQASQLLVEFFQKSKEDPSHWKKISDGGLQRIYERYTWKIYSERLMTLAGVYSFWKYVSKLERRETRRYLEMFYILKFRDLANSVPLAKDDAS

SEQ ID NO: 2686 - protein, 338 aa, Glycine max
NSARARADSARDVFQYINCEDGKMSGPPGDVANSLMDGYSKGNNEVRRRSRFLRRRGRVRRLKYTWKSAAYHSIRKRITERKDQPCRQYNPCGCQTACGKQCPCLQNGTCCEKYCGRPKSCKNRFRGCHCAKSQCRSRQCPCFAADRECDPDVCRNCWVSCGDGTLGIPSQRGDNYECRNMKLLLKQQQRVLLGRSDVSGWGAFLKNSVGKHEYLGEYTGELISHREADKRGKIYDRENSSFLFNLNDQFVLDAYRKGDKLKFANHSPDPNCYAKVIMVAGDHRVGIFAKERICAGEELFYDYRYEPDRAPAWARKPEASGSKKEDGAPSSGRAKKLA

SEQ ID NO: 2687 - protein, 96 aa, Glycine max
SARVNDQFVLDAYRKGDKLKFANHSPDPNCYAKVIMVAGDHRVGIFAKERICAGEELFYDYRYEPDRAPAWARKPEASGSKKEDGAPSSGRAKKLA

SEQ ID NO: 2688 - protein, 397 aa, Glycine max
  unsure (1)..(397): unsure at all Xaa locations
FSRQGLISGSAELRVQAVLGRGELIELLSFQPFTALATPITGPFIRIIGDRFPWQVKSAILSTLTTMIKKGGISLKPFLPQLQTTFVKCLQDSTRTVRSSAALALGKLSGLSTRVDPLVSDLLSSLQGSDGGVRDAILTALKGVLKHAGKNLSSAVRTRFYSILKXLIHDDDDRVRTYASSILGILTQYLEDVQLTELIQELSSLANSSSWPPRHGSILTISSLLHYNPATICSSSLFPTIVDCLRDTLKDEKFPLRETSTKALGRLLLYRSQVDPSDTLLYKDVLSLLVSSTHDDSSEVRRRALSAIKAVAKANPSAIMSLGTIVGPALAECMKDGNTPVRLAAERCALHAFQLTKGSENVQAAQKYITGLDARRLSKFPEYSDDSDDSDEDTSSS

SEQ ID NO: 2689 - protein, 253 aa, Glycine max
MALLFKDPSKISAYRDRRFPGTQEEFEHALLTSTTVYVGNMSFYTTEEQVYELFSRAGEIKKIIMGLDKNTKTPCGFCFVLYYSREDTEDVCKYISGTILDDRPIRVDFDWGFQDGRQWGRGRSGGQVRDEYRTDYDPGRGGYGKLVQKELEVQRQLVDYGTGSLGSFPPVIPTSYGRHGGGHGHGGSHRHGRDYYRKRHRDDDRHIHESSKRNSDHESRRNTDHESRPEKNPRFRESGDSDDDEEDDRKRRA

SEQ ID NO: 2690 - protein, 230 aa, Glycine max
MTSGFGESTRASAPSPSCSGNSSNDAGDFECNICFDLAQDPVITLCGHLFCWPCLYRWLHHHSHSQECPVCKALVQEEKLVPLYGRGKTQTDPRTKLYPGMEIPHRPSGQRPQTMPPPPPPEVNPFGSYGFGLMGGFIPMATARFGNFTLSTAFGGFIPSLLNIHFHGFQDATVYGTTSGYPFGFNGFHGGNARGFMQATGQVQRQEDNVLKNLLMLIGFLVLLTVIFVW

SEQ ID NO: 2691 - protein, 409 aa, Glycine max
MATEKLRGCANVFASSKPYLAMISLQFGYAGMNIITKVSLNQGMSHYVLVVYRHAFATAVIAPFAIIFERKGQPKITFPVFMQIFILALLGPVIDQNFYYAGLKLTSPTFSCAMSNMLPAMTFVMAVFCRMEKIEIKKVRCMAKIVGTLVTVAGAMLMTLYRGPIVEMVWAKHPHNKTNATTTTESFDKDWFLGCTFLIIATLAWASLFVLQAKAIQTYKNHQLSLTSLVCFIGTLQAIAVTFVVEHNPSVWRIGWDVSLLAAAYAGIVTSSISYYVQGLVIKMKGPVFATAFSPLMMIIVAIMGSFILAEQIYLGGVIGAILIVIGLYSVLWGKHKEQIESKVADEIPLPVKDAQIAVIAGPMIDATDNFTEEKYGQKGEANNNKLSSHIITMPIPELPTKANQERKT

SEQ ID NO: 2692 - protein, 232 aa, Glycine max
  unsure (1)..(232): unsure at all Xaa locations
MASGFGESTGRSPPSPSYFNNNNNNDAANFECNICFELAQDPIITLCGHLFCWPCLYKWLHFHSQSRECPVCKALVEEEKLVPLYGXRGKSSTDPRSKSIPGDNIPHRPAGQRPETAPPPETNHFHQHGFGFMGGLGGFAPPPMATTRFGNFALSAAFGGFIPSLFNFQLHGFHDAAMYGGGAGFPHGFANTFHGVHAHGFPLRTHQGQQDYYLKKLLLFVVLCVVLAFIWQ

SEQ ID NO: 2693 - protein, 388 aa, Glycine max
MSHQEQAFVSLLSQLALSFDGAVLGLALAYAAVRTLFKFTATSAALRKLHRAPSVSVSDLRSLLAEIPSDADGNSDGGNIVIVRGTVDAKSAVEGGTWKTLRPGVLVSRESGDKGVILQRTQTCIYNEWKGLFGWTSDLRAIFARSWRQQESTSLRKVPFLLTDVGRRPNAEYVVVNMDGSRHPLPLTTVYHKLQPITASPYTFLQALFGHEYPVGLLDEEKILPLGKDITAVGLCSLKNGIAEIKSCKYLPYFLSDLSKDQMIMDLSIKTKILFWGGIALGSMSVGVLGYAVLRNWIKWKRWKVQRQLQQQRQAVSDAEPQVDDEIEDVPDGQLCVICLMRRRRSVFIPCGHLVCCQGCAISVEREVAPKCPVCRQEIRDSVRTYES

SEQ ID NO: 2694 - protein, 387 aa, Glycine max
  unsure (1)..(387): unsure at all Xaa locations
MSHQEQALVSLLSQLALSLDGAVLGFXLAYAAVRTLFKFTATSSALRKLRRAPSLSVSDLRSLLAEIPSDGDGNSKGGIIVIVRGTVDAKSAVDGTWKTLRPGVLVSRESGDKGVILQRTQTCIYNEWKGLFGWTSDLRAIFARSWRQQESTSLRKVPFLLTDVGRRPNAEYVVVNMDGSRHPLPLTTVYHKLQPITASPYTFLQALFGHEYPVGLLDEEKILPLGKDITAVGLCSLKNGIAEIKSCKYLPYFLSDLSKDQMIMDLSIKTKILFWGGIALGSMSVGVLGYAVVRNWNKWKQWKQQRQLQQQRQAVSDVEPQMDDEIEDAPDGQLCVICLMRRRRSVFIPCGHLVCCQGCAISVEREVAPKCPVCRQEIRDSVRIYES

SEQ ID NO: 2695 - protein, 191 aa, Glycine max
  unsure (1)..(191): unsure at all Xaa locations
MFSRLIHPHEGQEDMQGGSNHAHLGDPCLVLTSDPKPRLRWTADLHERFVDAVTQLGGASKATPKAIMRTMNVKGLTLYHLKSHLQKYRLGKQSGKDSDEGCKDASYLQESPGTDNSSPKLPASDANEGHEVKEALRAQMEVQSKLHLLVENYEKHLQIRQDAERRYMGMLERACKMLADXFIGDVIIDRD

SEQ ID NO: 2696 - protein, 387 aa, Glycine max
MQKRREESDKIPVKRDSASSLPQPQSLVLFTSPFSPFPFLLPLSFAKWVIISFSHNTIFFTFSFFFASLRWGFKFHHRNRMFSRLIHPHEGQEDMQGGSNHAHLGDPCLVLTSDPKPRLRWTADLHERFVDAVTQLGGASKATPKAIMRTMNVKGLTLYHLKSHLQKYRLGKQSGKDSDEGLKDGMSASYLQESPGTDNSSPKLPASDANEGHEVKEALRAQMEVQSKLHLLVEAEKHLQIRQDAERRYMGMLERACKMLADQFIGDVIIDRDGQKFQGLENKTSRSPLVDHGGFFPAACTEVGGMHVSEVPPILQPQGAECSSESCLKSLESLGGLTLEGSPGGSKKRMLNLDSMVAPLIWSEANTRTQGIHLAQVNPPGMTRYGM

SEQ ID NO: 2697 - protein, 339 aa, Glycine max
MDHSADAHRTDLMTITRFVLNEQSKHPESRGDFTILLSHIVLGCKFVCSAVSKAGLAKLIGLAGETNVQASEQKKLDVLSNDVFIKALVSSGRTCILVSEEDEEATFVEASKRGKLYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 2698 - protein, 339 aa, Glycine max
MDHSADAQRTDLMTITRFVLNEQSKHPESRGDFSILLSHIVLGCKFVCSAVNKAGLAKLIGLAGETNVQGEEQKKLDVLSNDVFIKALISSGRTCILVSEEDEEATFVEPSKRGKYCVVFDPLDGSSNIDCGVSIGTIFGIYLIKEDHEPTVEDVLQPGKNMLAAGYCMYGSSCTLVLSTGSGVNGFTLDPSLGEFILTHPDIKIPKKGKIYSVNEGNAKNWDGPTTMYVENCKYPKDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYSADEK

SEQ ID NO: 2699 - protein, 541 aa, Glycine max
  unsure (1)..(541): unsure at all Xaa locations
MGSTSLLHLLLGVVLALLSVSLVEGEDAYKYYTWTVTYGILSPLGSPQQVVLIDGQFPGPQLDLVTNENVVLNLVNKLDEPFLLTWNGIKQRKNSWQDGVLGTNCPIPPNSNYTYKFQVKDQIGTYTYFPSTSLHKAAGGFGGLNVYHRSVIPVPYPYPDGDFTLLIGDWYKTNHKVLRESLDSGKSLAFPDGLLINGQAHTTINGDQGKTYMFRISNVGMSTSINFRIQGHPLKLVEIEGSHIVQNTYDTLDVHVGQSAAVLVTLNQPPKDYYIVASTRFSRKVLTXTAVLHYSNSNSPASGPLPSPPIYQYHWSVKQARTYRWNLTANAARPNPQGSYHYGKITPTKTIVLSNSAPLINGKLRYAVNXVSYVNSDTPLKLADYFNIPGIYSVDSIQTLPSESTPASIATSVVPTSLHDFIEVVFQNNENAMQSWHLDGYDFWVVGYGFGQWTPAKRRTYNLVDALTRHTTQVYPNAWTTILVSLDNQGMWNLRSAIWERQYLGQQLYLRVWTSERSLANEYDIPNNALLCGKAVGHNNP

SEQ ID NO: 2700 - protein, 525 aa, Glycine max
MDGYDGTVRLGAINLKHDRAADFDSATAAPDVSVSSPVTRQKAAAAKQFIENHYKNYLQGLQDRKDRRRALQRKVQESQVSAEEQEEMMRNLERRETEYMRLQRRKIGIDDFEQLTVIGKGAFGEVRLCRAKDTGEIFAMKKLKKSEMLSRGQVEHVRSERNLLAEVDSRCIVKLHYSFQDSDFLYLIMEYLPGGDIMTLLMREDILSEDVARFYIAESILAIHSIHQHNYVHRDIKPDNLILDKNGHLKLSDFGLCKPLDDKYSSILLENDDLTSQESTSETEGYSVSPWLMPKEQLQQWKRNRRALAYSTVGTLDYMAPEVLLKKGYGIECDWWSLGAIMYEMLIGYPPFCSDDPRMACRKIVNWKTCLKFPDEPKISAEAKDLICRLLCDVDSRLGTRGIEEIKAHPWFKGVQWDMLYESEAAYKPTVTGDLDTQNFEKFPEVDGPPSVTATVGPWRKMLTSKDNNFIGYTFKKSDILKSLESSDADIRVNGSSKTPSLITLLGRIDLQDTIIPESEQKPEA

SEQ ID NO: 2701 - protein, 214 aa, Glycine max
MRTQRLNHLLLSLFLFAAAFSSLHPTATAGDEGAPSAGDGDRDADFIRTSCNTTLYPEVCFTSLSRYANAVQQNPGHLARVAIAVSLSKVHRAASYVSNLTRDADYGGSTRAALALHDCFSNLGDAVDEIRGSLKQMRQIGSAGAGASSFLFQMSNVQTWLSAALTDEETCTDGFQDVADCPMKTGVCDRVSNVKKFTSNALALVNSYANKGMP

SEQ ID NO: 2702 - protein, 585 aa, Glycine max
SCLNVFTIFQEAPCSSVSSANKNSTSISVPLRNSCALREFIPSVKEVITRDETNESFVTDELENQKLEIDDGKHTQKTNDTCEVSKLENSGASELVQTEKTDGRNCALTIDGVPGNQNYPRHVPVHVVDGNLGTSTQNLSPDMVFQDSIFQPKGGVNRQPNLVTNSATSHISECQNNAARSSIHQSFPPSPPFAQDDYHSFLHMSSTFSSLIVSTLLQNPAAHAAASFAATFWPYANAETSADSPVCTPDFPSRQIGSPPSVTAIAAATVAAATAWWAAHGLLPLCGPLHTAFACPPASATTVPSMIIDESPQKTERGEIKPQNPPLQDQIPDPEHSEAQHSAPKSPAVSSSKSEDRGDANLDTSPKATNHEMNQAISENPDSNKMKGRKPVDRSSCGSNTTSSSEETELLEKDEKEKEEPKTPDANVLDTELSNRRSRSISNLTDSWKEVSEEGRLAFQALFSREVLPQSFSPTHHLINKDNQIDSIKDNELNTDYKDEDLESKKCSSICDGVQKNLLFVKDNNEEEGLLTIGLGPGKLKTRRTGFKPYKRCSVEANENRIGTACIQGEEKGPKRLRLNGEAST

SEQ ID NO: 2703 - protein, 337 aa, Glycine max
  unsure (1)..(337): unsure at all Xaa locations
LLSFGRPPPSLKLGDLLPPSDLVCSLSFDRDAEFNAKKIKXFECDSIINEDRDIHYPVVEMASRSKLSSICWNTYIKSQIASSNFEGVVQLWDVTRSQVISEMREHERRVWSIDFSSADPTMLASGSDDGSVKLWSINQAIPFLHLGVSVGVINTTIKTKANVFCVQFPLDSARFLAFGSADHRIYYYDLRNLKMPLCTLVGHNKTVSYIKFVDTVNLVSASTDNTLKLWDLSTCASRVIDSPIQSFTGHANVKNFVGLSVSDGYIATGSETNEVFIYHKAFPMPALSFKFQNTDPLSGNEVDDAVQFVSSVCWHGQSSSTLLAANSTGNVKILEMV

SEQ ID NO: 2704 - protein, 750 aa, Glycine max; identical to SEQ ID NO: 814

SEQ ID NO: 2705 - protein, 110 aa, Glycine max
SSSTSPSSPDPSQAAPESFEFHPSPSESYIEEFRSRTPTLRFDSVCCSKRLEHDCSVCLTQFEPESEINRLSCGHLFHKVCLEKWLDYWNITCPLCRTPLMPEDDTPCFQ

SEQ ID NO: 2706 - protein, 154 aa, Glycine max
MGLSSLPAPSEGVLCVLLVNTVLSISIFKGIVRTILHIVGIHLPSSSTSPSSPDPSQAAPESFELHLSPSESYIEEFRSRTPTLRFDSVCCSKRLEHDCSVCLTQFEPESEINRLSCGHLFHKVCLEKWLDYWNITCPLCRTPLMPEDDTPCFQ

SEQ ID NO: 2707 - protein, 597 aa, Glycine max
PEVLNDGVCTFSSNIYSLGVLLFELLCNIEPWEAHSTAMLDLCQRILPPKFLAENPKEAGFCLWLLHPEPSSRPNARMILESEVMRESEESNSVDDVGISDDEAETEQLLDFLILIKEAKKKREAKLEEELNLLNEDIKEVEKSYSFVTDSVFPLVQMNNPEVRGDNLYFQDSSGSDISRSIRRSFGDEERFMSNLNQLENSYFSMRFRVLPKEASSVSSNEKNVMESRWRLPQVENVNKESRRIQSSVGCVGSFFEGLCKFARYSKFEECGRLRNRDLLSSANVMCALSFDRDEDHIAAGGVSKKIKIFDLNAIASDSVDIQYPVIEMSNKSKLSCVCWNTYIKNHLASTDYDGAVQMWDADTGQPLSQYMEHQKRAWSVHFSLSDPKMFASGSDDCSVKLWSISERNSLGTIWKPANICCVQFSAYSTNLLFFGSADYKVYGYDLRHTRIPWCTLAGHGKAVSYVKFIDSEAVVSASTDNSLKLWDLNKTSSSGLSSDACAMTFKGHSNEKNFVGLSVLDGYIACGSESNEVYCYHKSLPVPIATHKFESIDHISGHLNSGDNNGQFVSSVCWRKKSNMLVAANSVGIVKLLQMV

SEQ ID NO: 2708 - protein, 136 aa, Glycine max; identical to SEQ ID NO: 1603

SEQ ID NO: 2709 - protein, 504 aa, Glycine max
MGSAEKEPLLTAEGTRSNSKHESSSHGQLERILSDDTLPFLNRVGPATWIELKLLFFLAAPAVIVYLINYLMSMSTQIFSGHLGNLELAAASLGNTGIQMFAYGLMLGMGSAVETLCGQAFGAQKYGMLGVYMQRSTILLSLAGVVLTVIYVFSEPMLIFLGESPRIASAAALFVYGLIPQIFAYAANFPIQKFLQAQSIVAPSAYISAATLVVHLGMSWVAVYEIGLGLLGASLVLSLSWWIMVIGQYVYIVKSERCRRTWQGFTWEAFSGLYGFFKLSAASAVMLCLETWYFQILVLLAGLLPNPELALDSLSICTTISGWVFMISVGFNAAASVRVSNELGARSPKSASFSVVVVTVISFIISVIAAPTRPPTRPVISYAFTGGEEVAAAVSDLCPLLALSLVLNGIQPVLSGVAVGCGWQAFVAYVNVGCYYGVGIPLGAVLGFYFQFGAKGIWLGMLGGTVMQTIILLWVTFRTDWTKEVEEAAKRLTKWEDKKEPLLN

SEQ ID NO: 2710 - protein, 182 aa, Glycine max
MASAEVEFRCFVGGLAWATDHDALEKAFSQFGEIVESKVINDRETGRSRGFGFVTFATEQAMRDAIEGMNGQNLDGRNITVNEAQSRGKGGGGGGGGYGGGGGGYGGGGGYSRGGGGYGGGGGRREGGYNRNGGGGGYGGGGGGYGGGGGYGGGGRDRGYGGDGGSRYSRGGGGSDGGSWRN

SEQ ID NO: 2711 - protein, 496 aa, Glycine max
MGGNNSKEDNNNWRQNSSVRSSSSASSWGSYPDPQSGYGHGGYAYEPQQPSYPTQQPYYAQPPPPPPNYGNEPQPHASGRVAGHRNEKRLDRKYSRITDNYNSIDEVTEALARAGLESSNLILGIDFTKSNEWTGKHSFNRKSLHHIGNGPNPYEQAISIIGKTLAAFDEDNLIPCFGFGDASTHDQDVFSFYPDERICNGFEEVLSRYREIVPIIRLAGPTSFAPIVEMAMTIVEQTGGQYHVLVIVADGQVTRSIDTEHGRLSPQEQSTVDAIVEASKFPLSIILVGVGDGPWDMMKEFDDNIPARVFDNFQFVNFTEIMSKNIPPSRKEAAFALAALMEIPSQYKAGLRLNLLGGRNANAPQRVALPTPSYGSASMGISKPYGSASFGASKPYGSASFDAPKPYGSASFSSSKPSHAASFEQSAPSYYDNTDPVGTAPPAPSSSYDNQLCPICLTNSKDMAFGCGHQTCCECGQDLQSCPICRSPINTRIKLY

SEQ ID NO: 2712 - protein, 483 aa, Glycine max
  unsure (1)..(483): unsure at all Xaa locations
MANAASGMAVHDDCKLRFLELSTKRTQPGIVLKIEKLLLQVIVEKLGEPAQGYEDFGDNNLVPSVNGNAQHMKSHRRQXASLVGSVAMGLLFSLFCVFGLIIIAIETRKRRKKKEAALEAYGDGNSHSGPANVSWKHTSTRAALALNLATFEKPLRKLTFADLLDATNGFHNDSLIGSGGFGDVYKAQLKDGSVVAIKKLIHVSGQGDREFTAEMETIGKIKHRNLVPLLGYCKVGEERLLVYEYMKYGSLEDVLHDQKKAGIKLNWAIRRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKRPTDSADFGDNNLVGWVKQHAKLKISDIFDPELMKEDPNLEMELLQHLKIAVSCLDDRPWRRPTMIQVMAMFKEIQAGSGIDSQSTIANDEEGFNAVEMVEMSIKEAPELSKH

SEQ ID NO: 2713 - protein, 134 aa, Glycine max
MVASTRGNSAGADSFGNNFSPIFSFSFHQWGKFVDETITSHKIVIFSKTYCPYCRRAKAVFKELNQVPHVVELDEREDGSKIQDIMVNIVGRRTVPQVFINGKHLGGSDDTVEAYESGHLHKLLGIEKKDHDDL

SEQ ID NO: 2714 - protein, 475 aa, Glycine max
MMALNISSPAEVKSIFFADSFKSNCLTAKFSGGFAFKRKERRAASGGRVYCSVQATPPPPAWPGRAVPEQGRKTWDGPKPISIVGSTGSIGTQTLDIVAENPDKFKVVALAAGSNVTLLADQVKRFKPQLVAVRNESLIAELEEALHDVEEKPEIIPGEQGIVEVARHPDAVSVVTGIVGCAGLKPTVAAIEAGKDIALANKETLIAGGPFVLPLAQKHNVKILPADSEHSAIFQCIQGLPEGALRRVILTASGGAFRDWPVDKLKDVKVADALKHPNWNMGKKITVDSATLFNKGLEVIEAHYLFGADYDHIEIVIHPQSIIHSMIETQDSSVLAQLGWPDMRLPILYTLSWPDRIYCSEVTWPRLDLCKLGSLTFKTPDNVKYPSMNLAFSAGRAGGTMTGVLSAANEKAVEMFIDEKISYLDIFKVVELTCEKHQNELVSSPSLEEIIHYDLWARKYAASLQDSSSFTPILA

SEQ ID NO: 2715 - protein, 416 aa, Glycine max
  unsure (1)..(416): unsure at all Xaa locations
MSLKSIVRELKEMRDGIGSMSRRGVESRRWNGRTKSHVAPDVTLTSLEPIQQGHWANLPPELLLDIIRRVEDSETTWPARAVVVYCGSVCKSWRAVTKEIVKTPEQCGRLTFPISLKQPGPRDSPIQCFIRRNRETSTYLLYIGLVPSENETDKLLLAAKKVRRATGTDFIISLVADDFSRSSNTYVGKLRSNFLGTKFTIYDSQPPHGAAIQPDSQPSRRFHSKQVSPRVPACNYVVSTIAYELNVLRARGPRRMHCTMNSIPVSAVQAGGNAPTPTFPEIIDEPFSXPSPALKXGKRPIKDLNIASLPEQLTVXSQSSTERLALKNKAPRWHEQLQCWCLNFKGRVTVASVKNFQLVSAVDPSHNVSAAEQEKVILQFGKIGKDIFTMDYRYPLSAFQAFAICLSSFDTKPACE

SEQ ID NO: 2716 - protein, 267 aa, Glycine max
MEGSVLERLDFGKMGYGCKHYRRRCRIRAPCCNELYFCRHCHNEATSMLSNPFDRHELVRQDVQHVVCSVCDTEQPVAQVCTNCGVRMGEYFCNICKFFDDDTGKKQFHCDDCGICRLGGRENYSHCSKCGCCYSNTLRDNHLCVENSMRHHCPICYEYLFDSLKDIAVMKCGHTMHSECYLEMLKRDKYCCPICSKSVMDMSRAWKRIDEEIEATVMPDDYRYRKVWILCNDCNDTTEVYFHILGQKCGHCSSYNTRAIAPPVLSQ

SEQ ID NO: 2717 - protein, 267 aa, Glycine max
MEGSILERLDFGKMGYGCKHYRRRCRIRAPCCNELYFCRHCHNEATSMLSNPFDRHELIRQDVQHVVCTVCDTEQPVAQVCTNCGVRMGEYFCSICKFFDDDTGKQQFHCDDCGICRIGGRENYFHCNKCGSCYSTSLRDNHMCVENSMRHHCPICYEYLFDSLKDTAVMKCGHTMHSECYLEMLKRDKYCCPICSKSVMDMSRAWKRIDEEIEATVMPDDYRYRKVWILCNDCNDTTEVYFHVLGQKCGHCSSYNTRAIAPPVLPQ

SEQ ID NO: 2718 - protein, 267 aa, Glycine max
MEGSVNERLDFGKMGYGCNHYRRRCRIRAPCCNEIYSCRHCHNEAASLLKNPFDRHELVRQDVKQVVCSVCDTEQPVAQVCTNCGVRMGEYFCNICKFFDDDTGKEQFHCDDCGICRVGGRENYFHCNKCGSCYSTSLRDNHLCVENSMRHHCPICYEYLFDSLKDTAVMKCGHTMHSECYLEMLKRDKYCCPICSKSVMDMSRAWKRIDEEIEATVMPDDYRYRKVWILCNDCNDTTEVYFHILGQKCGHCSSYNTRAIAPPVLSQ

SEQ ID NO: 2719 - protein, 575 aa, Glycine max
MGLKALFVWCIIWLGLAHLSLGGRVRHYKFDVEYMIRKPDCLEHVVMGINGQFPGPTIRAEVGDILDIALTNKLFTEGTVIHWHGIRQVGTPWADGTAAISQCAINPGETFHYRFTVDRPGTYFYHGHHGMQRSAGLYGSLIVDLPKGQNEPFHYDGEFNLLLSDLWHTSSHEQEVGLSSKPFKWIGEPQTLLINGKGQFNCSLASKFINTTLPQCQLKGGEECAPQILHVEPNKTYRIRIASTTALASLNLAISNHKLVVVEADGNYVSPFAVDDIDIYSGESYSVLLRTDQDPNKNYWLSIGVRGRRAPNTPQGLTILNYKPISASIFPISPPPITPIWNDFERSKAFTKKIIAKMGTPQPPKRSDRTIFLLNTQNLLDGFTKWAINNVSLTLPPTPYLGSIKFKINNAFDKTPPPVTFPQDYDIFNPPVNPNTTIGNGVYMFNLNEVVDVILQNANQLSGSGSEIHPWHLHGHDFWVLGYGEGKFKPSDEKKFNLTHAPLRNTAVIFPYGWTALRFKADNPGVWAFHCHIEPHLHMGMGVIFAEGVHKVGKIPRDALTCGLTGNKLVGNRHY

SEQ ID NO: 2720 - protein, 329 aa, Glycine max
MAEIEGSPGSSMHGVTGREQTFVASIASPIVPTDTTAKFALPVDSEHKAKIFKLFSMANPHMRTFHLSWISFFTCFVSTFAAAPLVPIIRDNLNLTKSDIGNAGVASVSGSIFSRLAMGAVCDLLGPRYGCAFLIMLSAPTVFCMSFVKDAAGLVRFLIGFSLATFVSCQYWMSTMFNSKIIGLAMLRAAHPRYGCAFLIMLSAPTVFCMSFVKDAAGYIMVRFLIGFSLATFVSCQYWMSTMFTSKIIGLANGTAAGWGNMGGGPTQLIMPLVYELIKKAGATPFTAWRIAFFVPEHPSNMNPLMHHVFLFSCTFNVRLIIIIMPLAP

SEQ ID NO: 2721 - protein, 530 aa, Glycine max
MAEIEGSPGSSMHGVTGREQTFVASVASPIVPTDTTAKFALPVDSEHKAKVFKLFSLANPHMRTFHLSWISFFTCFVSTFAAAPLVPIIRDNLNLTKSDIGNAGVASVSGSIFSRLAMGAVCDMLGPRYGCAFLIMLSAPTVFCMSFVKDAAGYIAVRFLIGFSLATFVSCQYWMSTMFNSKIIGLANGTAAGWGNMGGGATQLIMPLVYELIRRAGATPFTAWRIAFFVPGFMHVIMGILVLTLGQDLPDGNLGALRKKGDVAKDKFSKVLWYAITNYRTWIFALLYGYSMGVELTTDNVIAEYFYDRFNLKLHTAGIIAASFGMANLVARPFGGYASDVAARLFGMRGRLWTLWILQTLGGVFCIWLGRANSLPIAVLAMILFSIGAQAACGATFGIIPFISRRSLGIISGLTGAGGNFGSGLTQLVFFSTSKFSTATGLSLMGVMIVACTLPVSVVHFPQWGSMFLPPSKDVSKSTEEFYYTSEWNEEEKQKGLHQQSLKFAENSRSERGKRVASAPTPPNATPTHV

SEQ ID NO: 2722 - protein, 609 aa, Glycine max
ENKLYGEFLINAQGEDVVAGIRTPEDLEVMKTCMPEAYKELEENCEILEKHYKDMMDIEFTVQENRLWMLQCRSGKRTGKGAFKIAVDMVDEGLVDIRSAIKMVEPQHLDQLLHPQFEDPSTYKDKVIAIGLPASPGAAVGQVVFTADDAEEWHAQGKSVILVRNETSPEDVGGMHAATGILTARGGMTSHAAVVARGWGKCCVSGCSDILVNDAEKVFVVGDKVITEGEWVSLNGSTGEVILGKQPLSPPALSDDLETFMSWADEIRHLKVMANADTPEDAVTARQNGAQGIGLCRTEHMFFASDERIKAVRMMIMAVTPEQRKAALDLLLPYQRSDFEGIFRAMDGLPVTIRLLDPPLHEFLPEGDLEHIVSELTSETGMKEEEIFSRIEKLSEVNPMLGFRGCRLGISYPELTEMQARAIFQAAVSVSNHGITVLPEIMVPLIGTPQELRHQVNLIRNVADKVLSEMGSSLSYKVGTMIEVPRAALVADEIAKEAEFFSFGTNDLTQMTFGYSRDDVGKFLPIYLSSGILQHDPFEVLDQKGVGQLIKICTEKGRAARPNLKVGICGEHGGEPSSVAFFAEIGLDYVSCSPFRVPIARLAAAQVAV

SEQ ID NO: 2723 - protein, 427 aa, Glycine max
MASAMFRRNIITHYSKFASSLSSLPRHSSIYNPLSMSVSSFHSESVGGGGGLPSSMRGAVYWEPNKPLTIEEFHMPRPKAGEVLIKTKACGVCHSDLHVMKGEIPFTSPCVVGHEITGEVVEHGALTDSKTIERLPVGSRVVGAFIMPCGNCSYCSKGHDDLCEAFFAYNRAKGTLYDGETRLFFRNSGKPAYMYSMGGLAEYCVVPANGVSVLPDSLPYTESAILGCAVFTAYGAMAHAAQVRPGDSVAVIGTGGVGSSCLQIARAFGASDIIAVDVRDEKLQKAKTFGATHTVNSAKEDPIEKILEITGGKGVDVAVEALGKPQTFAQCTQSVKDGGKAVMIGLAQAGSLGEVDINRLVRRKIQVIGSYGGRARQDLPKLIRLAETGIFNLGHAVSRTYTFEEAGKAFQDLNEGKIVGRAVIEII

SEQ ID NO: 2724 - protein, 209 aa, Glycine max
MVRGKTQMRRIENATSRQVTFSKRRNGLLKKAFELSVLCDAEVALIIFSPRGKLYEFASSSMQDTIERYRRHNRSAQTVNRSDEQNMQHLKQETANLMKKIELLEASKRKLLGEGLGSCSLEELQQIEQQLERSVSNGRARKNQVYKGQIDQLKEKERALYAENARLCEQYGIQPQPATKDPKEIQPYAESSPSSEVETELFIGLPRSI

SEQ ID NO: 2725 - protein, 211 aa, Glycine max; identical to SEQ ID NO: 2059

SEQ ID NO: 2726 - protein, 363 aa, Glycine max
  unsure (1)..(363): unsure at all Xaa locations
MKETCCCASFSFGKAKPYLLTVGLQFGFAGAYIFSVASLNHGMNRYVFVVYRNAIAALALAPFALIFERKIRPKITLPVFLQIVALGFVEPVIDQGFTFLGMQYTSASFASAIMNAVPSVTFVLAVILRLERVNVKEVRSXAKVIGTLVSFSGALLMTXYNGPHIKLXFSPDTTHHQDGSHSPQVIKHWLSGTLFLLLGCVAWSSFFILQSITLKRYPAELSLSSLVCLSGALQASVVAIVATRHSGLVAWALGWDFRLYGPLYTGIVTSGITYYAQGLILQTRGPVFLTAFNPLCMVITSALGSFLFAEQLHLGSIIGAVIIALGLYSVVWGKGKDYSNPTPSSPTTKHTETPQLPITSSDI

SEQ ID NO: 2727 - protein, 341 aa, Glycine max
MGLEGKETPSFMRDFLDKCGGCAVIDGGFATELERHGADLNDELWSAKCLISSPHLVRRVHLDYLDAGANIILTASYQATIQGFEAKGFSREEGETMLRRSVEIAREAREIYYDRCTKDSSDFMRDERYRKRPILIAASVGSYGAYLADGSEYVGDYGDAVTVQTLKDFHRERVKILVEAGADLIAFETIPNKLEAQAYAELLEEEGIETPAWFSFSCKDESNVVSGDSIFECASIADSCRQVVAVGVNCTAPRFIHGLISFIKKATSKPVLVYPNSGETYIAESNQWVKSSGAAEHDFVSYIGKWRDAGASLFGGCCRTTPNTIRGIAEATYGKLKDKCI

SEQ ID NO: 2728 - protein, 603 aa, Glycine max
MVKHYRPPGKKKEGNAAKFVIRSQAIKQLQISLPLFRKLCILKGVTPREPKKKFKGTHQTYYHVKDVSFLHHEPLVEIHRAIRVHERKIKKAEAKKNHERANRLREKTPKPKIDRIIRQRYPRFVDALGELDDCLTMVHLFAALPASESKKIDVECVHKCRRLAHEWQAFVSRTHKLRKTFVSVKGIYYQAEVEGQPITWLTPHSLQQVVSDDVDITTMLNFLQLYEPLLSFVNFRLYHSINLKYPPILDPRLEALAADLYALSRYASANTRPSVLISEASQAESEQVETKQKEAETGNKTSELRLAQLQHQLPSNEPGALMHLVEEVTGEDEEDQDTKDCKKLFKNMKFFVSREVPRESMLFVIPAFGGIVSWEGEGAPFGESDQSISHQIVDREAQGHRFLSREYVQPQWVYDCVNARIILPTDNYLVGRTPPPHLSPFINYDEEGAYIPDYAKTIKHLQAAARKEILPLPGVGKDALEDPQNLLVEGIIDRAEANDAAQRKQKMMILEQQYRDDLKKELQGVTCTSAGSKETSTGVVQTGESTTSVQENVDHDDMSKVMMSRKRRELVEAIEISKERKEAQTDRIKQRKKKIDEAQRQRS

SEQ ID NO: 2729 - protein, 310 aa, Glycine max
  unsure (1)..(310): unsure at all Xaa locations
MGEVAVMHSEPLQFDCNDMKHITEKDVYNLLSNEEHILGEESSQSSNDKKINDLRERGYMKYGCQHYRRRCRIKAPCCDEIFDCRHCHNEAKNNINIDQKHRHDIPRHQVKQVICSLCETEQEVQQNCINCGVCMGKYFCGTCKLFDDDVSKQQYHCSGCGICRTGGCENFFHCHKGGWCYSTQLKNSHPCVEGAMHHDCPICFEYXLLESVNDVTGLLCGHTIHKSCLKEMREHFQYACPLCLKSVCDMSKVWEKFDLEIAATPMPEPYQNKMVWILCNDCGKSSHVQFHLVAQKCLNCKSYNTRETRG

SEQ ID NO: 2730 - protein, 194 aa, Glycine max
  unsure (1)..(194): unsure at all Xaa locations
GVLQEVWLDRVTGKVCMSISAKAMTINGIDDRRYWNWIPTEESXQIWWFEVDGEVTFPFPADIYTLSFRLHLGRFSKRLGRRVCNYEHTHGWDIKPVKFEFSTSDGQQASCECCLDESEIDDTYGNHKRGCWVDYKVGEFIVSGSEPTTQVRFSMKQIDCTHSKGGLCVHPVFIVPSHFRERKRRGILKYPCAE

SEQ ID NO: 2731 - protein, 201 aa, Glycine max
MGASLSSNGSSIGPGLGDIPESCVACVFLHLTPPEICNLARLNRAFRGAASSDSVWEAKLPRNYQDLLDLVPPPERHHRSLSKKDIFALLSRPLPFDHGHKEVWLDRVTGKVCMSISAKAMAITGIDDRRYWNWIPTEESRFHTVAFLQQIWWFEVDGEVSFPFPADIYTLSFRLHLGRFSKRLGRRVCNYDHTHGWDIKP

SEQ ID NO: 2732 - protein, 298 aa, Glycine max
MGASLSSNGSSIGPGLGDIPESCVACVFLHLTPPEICNLARLNRAFRGAASSDSVWEAKLPRNYQDLLDLVPPERHRSLSKKDIFALLSRPLPFDHGHKVGAALQEVWLDRVTGKVCMSISAKAMTINGIDDRRYWNWIPTEESRFHTVAFLQQIWWFEVDGEVTFPFPADIYTLSFRLHLGRFSKRLGRRVCNYEHTHGWDIKPVKFEFSTSDGQQASCECCLDESEINDTYGNHKRGCWVDYKVGEFIVSGSEPTTQVRFSMKQIDCTHSKGGLCVDSVFIVPNDLRERKRRGILK

SEQ ID NO: 2733 - protein, 258 aa, Glycine max
  unsure (1)..(258): unsure at all Xaa locations
IRHQLIFTAVLEDNCTSRTCAICLEDYCVGEKLRILPCCHKFHAACVDSWLTSWRTFCPVCKRDARSGLTDPPPSESTPLLSSTPASMASSVLSSARSSLASSSAIQIARTASMASSALPSARSSLASSSAIQIARAASQTPSVSRNHSIASTPYGGPSLRSSYHQSPSLSISRSSVDLRNASQRSLASHLNSPRSMGGPSLSSLNSRYMSPHIPSPSNASVSYMGSSQSSTNHLXPPYSESAASFSPFASTHSLPEC

SEQ ID NO: 2734 - protein, 510 aa, Glycine max
MFFNQKIVLFKSFALMGTSNLLLFFSLMSLCAMAASKVVLIGNNITLSFDDIEANFAPAVKGSGKYGVLYLAEPLDACAELTNKVEQLPNASSPFALVVRGGCSFEEKVRIAQKAGFKAVIVYDNEEGGILVAMAGNSAGIRIHAVFVSKASGEILKKYAGLTNVEIWLIPTFENSAWSIMAISFISLLAMSAVLATCFFVRKHRIRRERPRASLVREFHGMSSRLVKAMPSLVFTSVLEDNCTSRTCAICLEDYCVGEKLRILPCCHKFHAACVDSWLTSWRTFCPVCKRDARTGLTDPPPSESTPLLSSTPASMASSVLSSARSSLASSSAIQIARTASMASSALPSARSSLASSSAIQIARTASMASSALHSARSSLASSSAIQISRAASQTPSVSRNHSIASTPYVQPSLRSSYHQSPSLSISRSSVDLRNASQRSLASHLNSPCSMGYPSLSSLNSRYMSPHIPSPSNASVSYMGSSSHQQHPLRYSESAASFSPFASTHSLPEC

SEQ ID NO: 2735 - protein, 208 aa, Glycine max
  unsure (1)..(208): unsure at all Xaa locations
HSEKNKTIIPTWICNESERVQLWRTLCDACESAAAIVFCAADEAALCRACDEKVHMCNKLASRHVRVGLASPSDVPRCDICENXAPAFFYCETDGXSSLCLQCDMIVHVGGKRTHGRYLLFRQRVEFPGDKSSHAENPASQPLEPGEAKRGQNPLPKLKMGEKQQNHKMPMVPTPGPDADGHAKMESKMIDLNMKPNRIHEQASNNQC

SEQ ID NO: 2736 - protein, 693 aa, Glycine max
  unsure (1)..(693): unsure at all Xaa locations
MAVENQREDGGCDRFPVGMRVLAVDDDPICLKVLENLLRKCQYHVTTTNQAVEALTMLRENRNKFDLVISDVNMPDIDGFKLLELVGLEMDLPVIMLSAHGDTKLVMKGVTHGACDYLLKPVRIEELKNIWSXHVVRRKNFDSSGSEQGLPMRRRLPNFAGGENSADQHMQLVKKRXDQSDAEKERTEKNEENEDTSAQKNALLVXSVELHRKFVAAVNQLGLDKAVPKKILDLMNVEGLTRENVASHLQKYRLYLKKAAQQANMVAALGGSDSYLRMGSIDGYGDFCTSSGSGRITNTTLPSYASTGIFSRLNSPAALNMRAISSSALIRPVQSQNINCSLNTLGNIQPSVFPANHSSSLLQGIPTSIELNQSKQSNCTTGISQLSQVDSSGFTVASGFPDHRATVNGPNNSLPCVSNNHIMLQGNPQTHGPGAFSNQSSVRAASLCAESFDVGLCGSSNLLDHNRCNDNWQNAAQLSKFPANSLPLCEAFSNDQLPPTSINDSNSSTHIGNNSPVDFSSRMGISVPLEDTRNELRCQEGLIGNIVQPSSYTPRQRWEEHKLDYNQNMSCPFNSVNSHASSSGVTSSMGHVLNQNNTICSNRVDASSLVGQLNGASPSISRCTEVEKFSSDIRLKPNEAYILEQMKSQDGFMQNTFGTLDDIMGVMVKREQNESTLLDGEMGFDAYPVGSCN

SEQ ID NO: 2737 - protein, 166 aa, Glycine max
MALALGNIVALPLSNLKPSLKLSSSSSSCCITKLFPISRINVSPTSVLVRASSSSSFGSRLEDTIKKTVAENPVVVYSKTWCTYSSEVKILFKKLGVDPLVFELDEMGPQGPQLQKVLERITGQHTVPNVFIGGKHIGGCTDTLKLYRKGELEPLLSEANAKKTES

SEQ ID NO: 2738 - protein, 431 aa, Glycine max
MGLGNDEEEDNNNNNNNNKNNNDKVVDDGDAGGGKSFGSVSCSICLEVVADNGDRSWSKLQCGHQFHLDCIGSAFNIKGAMQCPNCRKIEKGQWLYANGCRSYPEFSMDEWTHDEDLYDLSYSEMSFGVHWCPFGNLARLPSSFEEGEFSSSAYHDVLGQHAIFAEHTAVSSASHPCPYIAYFGPIHPSSSNSGGTVSEASNFNHWNGSSVPSDMPTSYTFPAVDLHYHSWEHHSPPFSTASSRLVAADQPSVSPGSQRPARGGSDVPRSGSFMHPFLVGHSSAARVGSSVASSMIPPYPGSNARTRDRVQALQAYYQPQQPPNSTTMRTPIASGTRRSSSHNGSPQLAPITTSSDQSGGFFLIPSSSSGHNFQEENHHLPNHLHAWERPLPSLSLSHVDRAFRLCVPPGLQSGADPGYQVQQLSFEAWIG

SEQ ID NO: 2739 - protein, 433 aa, Glycine max
  unsure (1)..(433): unsure at all Xaa locations
MGLGNDEEEDNNNNDKVVDDGDVGGGKSFGSVSCSICLEVVAXNGDRSWSKLQCGHQFHLDCIGSAFNIKGAMXSAPNCRKIEKGQWXLYANGCRSYPEFSMDEWTHDEDLYDLSYSEMSFGVHWCPFGNLARLPSSFEXGEFSSSAYHDVLGHMPYXAEHTAVSSASHPCPYIAYFGPIHPSSSNSGGTVSEASNFNHWNGSSVPSDMPTSYTFPAVDLHYRSWEHHSPPFSTASSRLVAADQPSVSPGSQRPARGGSDVPRSGSFMHPFLVGHSSAARAGSSVASSMIPPYPGSNARARDRVQALQAYYQPQQPPNSTTMRTPIASGTRRSSSHNGPAQLAPMATSPDQGGGFFLIPSSSSGRNFQEENHHLPNHFHAWERDHLPSLSLNHVDRDSGWRAYHQATSRSDPATRSSSFRLRHGSDRMPSQNR

SEQ ID NO: 2740 - protein, 435 aa, Glycine max
MGLGNDEEEDNNNNNNNNKNNNDKVVDDGDAGGGKSFGSVSCSICLEVVADNGDRSWSKLQCGHQFHLDCIGSAFNIKGAMQCPNCRKIEKGQWLYANGCRSYPEFSMDEWTHDEDLYDLSYSEMSFGVHWCPFGNLARLPSSFEEGEFSSSAYHDVLGQHAIFAEHTAVSSASHPCPYIAYFGPIHPSSSNSGGTVSEASNFNHWNGSSVPSDMPTSYTFPAVDLHYHSWEHHSPPFSTASSRLVAADQPSVSPGSQRPARGGSDVPRSGSFMHPFLVGHRVGSSVASSMIPPYPGSNARTRDRVQALQAYYQPQQPPNSTTMRTPIASGTRRSSSHNGSPQLAPITTSSDQSGGFFLIPSSSSGHNFQEENHHLPNHFHAWERDHLPSLSLSHVDRDSGWRAYHQATSRSDPGTRSSSFRLRHGSDRTPSQNR

SEQ ID NO: 2741 - protein, 441 aa, Glycine max
  unsure (1)..(441): unsure at all Xaa locations
NAEQLIVGSHGCSSHRETASVTVVYASATVVSSDRRRLPTRRHRSHELHGSIPLLANRVAGPHWPPLPKRRLDRRYSRIADDYHSLDEVTTALSHAGLESSNLIVGIDFTKSNEWTGKRSFNRKSLHHIGSGQNPYEQAISIIGKTLSVFDEDNLIPCFGFGDASTHDQDVFSFHSDERFCNGFEEVLSRYRDIVPRLRLAGPTSFAPIIEMAMTIVEQSGGQYHVLLIIADGQVTRSVDTQHGQLSPQEEKTIGAIVKASGYPLSIVLVGVGDGPWDMMREFDDNIPARAFDNFQFVNFTEIMSKGIDSSRKETEFALSALMEIPSQYKATIDLGILGARRGHSPDRVPLPPPHYERASSSSTTSFRSNSFQHSTPTYMIMXNAESSSRSSYDNKVCPICLTNGKDMAFGCGHQTCCDCGENLECCPICRSTITTRIKLY

SEQ ID NO: 2742 - protein, 214 aa, Glycine max
MAGSEPVSAEGESMAVDAAPRKPRILLAASGSVAAVKFANLCHCFSEWADVRAVSSSGSLHFIDRASMPKDVILYTDEDEWSSWKKLSDSVLHIELRKWADIMVIAPLSANTLGKIAGGLCDNLLTCIVRAWDYSKPFFVAPAMNTLMWNNPFTERHFISIDELGIFLIPPVTKRLACGDYGNGAMAEPSTIYSTVRLFYESKAQQGRAVVTLR

SEQ ID NO: 2743 - protein, 212 aa, Glycine max
  unsure (1)..(212): unsure at all Xaa locations
MAGSEPVRAEGETMAVDAAPRKPRILLAASGSVAAVKFANLCHCFSEWADVRAVSTSASLHFIDRAAMPKDVILYTDDNEWSSWKKLGDSVLHIEXLRKWADIMVIAPLSANTLGKIAGGLCDNLLTCIVRAWDYSKPFFVAPAMNTFMWNNPFTERHLISIDELGISLIPPVTKRLACGDYGNGAMAEPSTIYSTVRLFYESKAQQGNGDI

SEQ ID NO: 2744 - protein, 142 aa, Glycine max
MAGSEPVSAEGESMAVDAAPRKPRILLAASGSVAAVKFANLCHCFSEWADVRAVSSSGSLHFIDRASMPKDVILYTDEDEWSSWKKLGDSVLHIELRRWAHILVIGPLSANTLCKIAGGCVTITFMVWSSLGLSMPILVRPP

SEQ ID NO: 2745 - protein, 218 aa, Glycine max
MTKKEIYAKLCLPNRFDGGTKEVWLDKCSGQVCLFMSSKSLKITGIDDRRYWNYIPTEESRFQSVAYLQQMWWVEVVGELEFEFPVGSYSLVFRLQLGKASKRLGRRVCNVDQVHGWDIKPVRFQLSTSDGQSSLSECYLRGPGEWVYYNVGDFVVEKPKEPINIKFSLAQIDCTHTKGGLCVDSAIICPTEFKERTQTKLANCYSLHSLTHTAVERR

SEQ ID NO: 2746 - protein, 355 aa, Glycine max
MENADIPENANEHCPGPQSESAGKSDACEGCPNQQICATAPKGPDPDLVAIAERMATVKHRILVLSGKGGVGKSTFSAQLAFALAARDFQVGLLDVDICGPSIPKMLGLEGQEIHQSNLGWSPVYVESNLGVMSIGFMLPNPDEAVIWRGPRKNALIKQFLKDVYWGELDFLIVDAPPGTSDEHISIVQFLDATGVDGAIIVTTPQQVSLIDVRKEVNFCKKVGVKVLGVVENMSGLCQPITDFKFMKLTDNGEQKDVTQWVWEYMREKAPEMLNLLACTEVFDSSGGGAVKMSNDMGVPFLGNVPLDPQLCKAAEEGSSCFAKKDCVVSAPALNKIIEQLIETNGWSMLVSNGV

SEQ ID NO: 2747 - protein, 355 aa, Glycine max; identical to SEQ ID NO: 2252

SEQ ID NO: 2748 - protein, 251 aa, Glycine max
MDAGYNPRTVEEVFRDFKGRRAALIKALTTDVEEFYQQCDPEKENLCLYGFPSEHWEVNLPAEEVPPELPEPALGINFARDGMQEKDWLSLVAVHSDAWLLAVAFYFGARFGFDKADRKRLFNMINDLPTIFEVVTGMAKKQGKEKSSVSNHSSTKSKSNSKRGSESKYTKAMQSKDEDDEGVGVEEEDEDEHGETLCGACGESYAADEFWICCDICEKWFHGKCVKITPARAEHIKQYKCPSCSNKRARP

SEQ ID NO: 2749 - protein, 434 aa, Glycine max
  unsure (1)..(434): unsure at all Xaa locations
MMALNISSPAEVKSIFFADYFKSNCITAKFTGGFAFKRKERGAASGGRSCCSVLAPPPPAWPGRAVPEQGSKTWDGPKPISIGGSTGSIGTQTLDIVAENPDKFKVVALAAGSNVTLLADQVKRFKPQLVAVRNESLIAELEEALHDVEEKPEIIPGEQGIVEVARHPDAVSVVTGIVGCAGLKPTVAAIEXGKDIALANKETLIVEVLLSFIFSAGHSLKAPPDXQLKDIKLADALKHPIWSLGRKITIDSATLFNKGLEVIEAHYLFGASYNNLNIIVIHPQSIIHSLVETQDSSVIAQLGIPDMRLPLLYTLSWPERIYCSEVTWPRLDLSKYGSLTFYAPDDKKFPSVNLCYAAGRAGGTMTGVLSAANEKAVEMFVEEKISYLDIFKVVELTCQEHQKELVASPSLEEIIHYDQWARQYAASLQKASSV

SEQ ID NO: 2750 - protein, 465 aa, Glycine max
MALNLPSPAQVKPLFFSSNNSTKLPGSFSLKRKDSDTTVERRVYCSAAAQSPPPAWPGTAIPEPSDFKTWDGQKPISVLGSTGSIGTQTLSIVAEFPERFKVVSLAAGSNITLLADQIKTFKPEVVGLRNESLIDELKEALADVDHKPEIIPGEQGVIEAARHPDATTVVTGIVGCAGLKPTVAAIEAGKDIALANKETMIAGAPFVLPLAHKHNIKILPADSEHSAIFQSIQGLPKGALRKILLTGSGGAFREWPAEKMKDIKLADALKHPIWSLGRKITIDSATLFNKGLEVIEAHYLFGASYDDIEIVIHPQSIIHSLVETQDSSVIAQLGIPDMRLPLLYTLSWPERIYCSEVTWPRLDLSKYGSLTFYAPDDKKFPSVNLCYAAGRAGGTMTGVLSAANEKAVEMFVEEKISYLDIFKVVELTCQEHQKELVASPSLEEIIHYDQWARQYAASLQKASSV

SEQ ID NO: 2751 - protein, 105 aa, Glycine max
RIIDHLGKHMNPGALLMLRSAHGARAFLYPVVEPCDFRGFEVLSVFHPSDEVINSVVIARKLYHSLEQGLVGSMILPNKCSEIQAFNPLNHGNMIEELAVEEQLL

SEQ ID NO: 2752 - protein, 321 aa, Glycine max
MVCEEELLIEKVCSIYEQISSLESLKPCKNVDMLFTKLVLTCIPPSPIEVTKLNKTVQDIRSHLIKLCGEAEGHLESHYSTILGSYDKPLNHLNIFPYYSNYLKLGHLEFTILSQHCTHVPTKVAFVGSGPLPLTSIVLASNHLPSTTFHNYDMDPSANSNAMRLVSSDPDLSKRMFFHTNDILEVSTALKEYEVVYLAALVGMDKEGKNRIIDHLGKHMNPGALLMLRSAHGARAFLYPVVEPCDLRGFEVLSVFHPSDEVVNSVVIARKLYHPVPMHSLDQQALVGSMILPNKCSEIQAFNPLNHGNMIEELAVEEQLS

SEQ ID NO: 2753 - protein, 398 aa, Glycine max
MACPAMANGNGSLKNLKLNDTKGKTITCKAAVVYGPGEPFVVENILVHPPQKMEVRIKILYTSICHTDLSAWRGVNEAQRAYPRIFGHEASGIVESVGEGVSEVEEGDIVVPIFNGECGECSMCKCEKTNLCERFGVDATKKVMEGDGTTRFSTVHGKPIFHFLNTSTFSEYTVVDSACVVKFVSTDHSLSIKNLTLLSCGVSTGVGAAWNTANVHSGSTVAVFGLGAVGLAVAEGARARGASKIIGVDINPDKFIKAMGVTNFINPKDEEKPVYERIREMTDGGVHYSFECTGNVDVLRDAFLSAHEGWGLTVVLGIHASPTLLPIHPMELFDGRNIVGSVFGGFKGRSHLPHFAKQCGQGVVKLDNFITHELPLEEIDKAFDLLITGKSLRCLLHF

SEQ ID NO: 2754 - protein, 375 aa, Glycine max
MGLGNDDDDGDTHKSFGSVPCSICLEAVTDNGDRSWAKLQCGHQFHLDCIGSAFNIKGAMQCPNCRKIEKGQWLYANGCRSYPEFSMDEWTHDEDLYDVSYSEMSFGVHWCPFGNLTRLPSSFEEGDFSSIAYHDVLGQHAIFAEHTAVSSASHPCPYIAYFGPIHPSTSNSGLTVSEASNFNHWNGPPVPGDMPTSYTFPAVDLHYHSWEHNSSHFSSANSRLGTSEQTSVSPGSQRPARGGSDVPRSGSFMHPFLVGHSSAARAGNSVASSMIPPYPGSNARARDRVQALQAYYQPQQPHNSTTIRTPVASSTRRSSSHSGPVQLAPVASPPDQSAGFVYIPSGSSGRNFQEETHLPSRFPCLGKRALALHWR

SEQ ID NO: 2755 - protein, 442 aa, Glycine max
MEEETSDAMNLDLNLGPGPEPETGPMSNEAVNLDDWIGEPLQRISEAVRRARQRWRWRHLPLPHPEFHAHFPTEATRHFQIPPEARNISVELNHFLVNSGNGSALQAGEGSVAAEERMEEVPKACDNVNGVAEDETSQKKEDVEKGSGNDGDFFDCNICLDLARDPVVTCCGHLFCWSCLYRWLHLHSDAKECPVCKGEVTLKSVTPIYGRANNVRGPEEDSALKIPPRPQAKRVESLRQTIQRNAFALPVEEMIRRLGSRIELTRDLVQPPEPDAARETAERTTSLLSRFLTARGIRREHQNLVAPPEDVMGLAQNNVNTSEAGDPRTRVQSHLLRRTQSHRATLSTLSSALTSAERLVEAYFRSNPLGRNQEQPPPPVDDRDSFSSIGAVINSESQLDTAVEIDSMVSLSTSSSRRRNDASRVSDVDSGDSRAPRRRRLN

SEQ ID NO: 2756 - protein, 372 aa, Glycine max
FGSRQNPAAHAAASFAATFWPYANAETSADSPVCTPDFPSRQIGSPPSVTAIAAATVAAATAWWAAHGLLPLCGPLHTAFACPPASATTVPSMIIDESPQKTERGEIKPQNPPLQDQIPDPEHSEAQHSAPKSPAVSSSKSEDRGDANLDTSPKATNHEMNQAISENPDSNKMKGRKPVDRSSCGSNTTSSSEETELLEKDEKEKEEPKTPDANVLDTELSNRRSRSISNLTDSWKEVSEEGRLAFQALFSREVLPQSFSPTHHLINKDNQIDSIKDNELNTDYKDEDLESKKCSSICDGVQKNLLFVKDNNEEEGLLTIGLGPGKLKTRRTGFKPYKRCSVEANENRIGTACIQGEEKGPKRLRLNGEAST

SEQ ID NO: 2757 - protein, 310 aa, Glycine max
MYSRLIHPHDGIVTQDDLQGAASNLSHAHKGDPCLVLTADPKPRLRWTQDLHERFVDAVTQLGGASKATPKAIMRTMNVKGLTLFHLKSHLQKYRLGKQSGKDVGEGCKDGSYLLESPGADNSSPKLPTSDTNEGYEIKEALRAQMEVQSKLHLQVEAEKHLQIRQDAERRYMAMLERACKMLADQFIGATVIDTDSQKFQGIGSKAPRGTLVDHVGFYPQACTEVGGMHASVVSPILQPQGADCFTESCLTSLESLGGLTLEGSPGGSKKRMLNLDSMVAPLIWSEANTRTQGIHLAKVNPSGMTRYGM

SEQ ID NO: 2758 - protein, 321 aa, Glycine max
  unsure (1)..(321): unsure at all Xaa locations
MYPRLIHPHDGIVTQDELQGGAASNLSHAHKGDPCLVLTADPKPRLRWTQDLHERFVDAVTQLGGASSSGCYLHXATPKAIMRTMNVKGLTLFHLKSHLQKYRLGKQSGKDVGEGCKDGSYLLESPGADNTSPKLPTPDTNEGYEIKEALRAQMEVQSKLHLQVEAEKHLQIRQDAERRYMAMLERACKMLADQFISATVIDTDSQKFQGIGSKAPRGTLVDPLGFYSLPSTEVAGVNVPEEEILPSLPPQRADCSTESCLTSHESSGGLALEGSPGEGKRRMLGMDSMAAPLIWSEAKMRTQAINVAQGNHPQGITRYGM

SEQ ID NO: 2759 - protein, 987 aa, Glycine max
MGGGGGGGSKMWHKKWWEKISGQGCKIHQQYYQYIGSKKVKRALWRKLLLTWVVGWFIVSLRIFCYMSSQGTEKRKETLASMCDERARMLQDQFNVSMNHIQAMSILISTFHHAKSPSAIDQKTFAKYTERTAFERPLTSGVAYAVRVLHSEREQFEKQQGWTIKRMDTLEQNPVHKDDYAPEALEPSPVQEEYAPVIFAQDTIAHVISVNVLSGKEDRENVLRARESGKGVLTAPFRLLKTNRLGVILTFAVYKRDLPSNTTPNERIQATDGYLGGVFDVESLVEKLLQQLASKQTVIVHVYDTTNRTHPIAMYGSNESGDFFYHVSTLNFGDPFRKHEMHCRFKQKPPWPWVAITTSIGILVIALLVGYIFHATVNRIAKVEDDYREMMELISLVRAADVAKSQFLATVSHEIRTPMNGVLGMLHMLMDTDLDVTQQEYVRTAQESGKALVSLINEVLDQAKIEFGKLELEAVLFDIRAILDDVLSLFSEKSQGKGVELAVYVSDHVPGLLIGDPGRFRQIITNLMGNSIKFTDKGHIFVTIHLVEEVVRSIEVDKESNSENTLSGSPVADSRRSWEGFKAFSQEGPLGSFSSPSNDLVNLIVSVEDTGEGIPLESQPLIFTPFMQVGSSISRKHGGTGIGLSISKCLVGLMNGEIGFVSIPKIGSTFTFTAVFTNGHRSSSECKIQQINNQPHSASSEFEGMTALIIDPRSVRAEVSGYHIQRLGIHVEMVSDLKQGLSTISNGNVVVNMVLIEQEVWDRDLGLSSHFVNNTRRIDHGVPPKLFILVNSSSSFKASVNLGVHNPTVITKPLRASMLAASLQRAMGVQNKGAPHRELQSLSLRHLLRGRKILIVDDNGVNRAVAAGALKKYGADVVCVSSGKDAISSLKPPHQFDACFMDIQMPEMDGFEATKRIREMEDSVNREVSMDDFENITNWHVPILAMTADVIQATHEECLRCGMDGYVSKPFEAEQLYREVSRFFQSS

SEQ ID NO: 2760 - protein, 671 aa, Glycine max
SNESGDFFYHVSTLNFGDPFRKHEMHCRFKQKPPWPWVAITTSIGILVIALLVGYIFHATVNRIAKVEDDYREMMELKKRARAADVAKSQFLATVSHEIRTPMNGVLGMLHMLMDTDLDVTQQEYVRTAQESGKALVSLINEVLDQAKIEFGKLELEAVLFDIRAILDDVLSLFSEKSQGKGVELAVYVSDHVPGLLIGDPGRFRQIITNLMGNSIKFTDKGHIFVTIHLVEEVVRSIEVDKESNSENTLSGSPVADSRRSWEGFKAFSQEGPLGSFSSPSNDLVNLIVSVEDTGEGIPLESQPLIFTPFMQVGSSISRKHGGTGIGLSISKCLVGLMNGEIGFVSIPKIGSTFTFTAVFTNGHRSSSECKIQQINNQPHSASSEFEGMTALIIDPRSVRAEVSGYHIQRLGIHVEMVSDLKQGLSTISNGNVVVNMVLIEQEVWDRDLGLSSHFVNNTRRIDHGVPPKLFILVNSSSSFKASVNLGVHNPTVITKPLRASMLAASLQRAMGVQNKGAPHRELQSLSLRHLLRGRKILIVDDNGVNRAVAAGALKKYGADVVCVSSGKDAISSLKPPHQFDACFMDIQMPEMDGFEATKRIREMEDSVNREVSMDDFENITNWHVPILAMTADVIQATHEECLRCGMDGYVSKPFEAEQLYREVSRFFQSS

SEQ ID NO: 2761 - protein, 462 aa, Glycine max
  unsure (1)..(462): unsure at all Xaa locations
MEAVCAFSVGTLHIPTAHETSNSFRKSIFLSNQVASPVSLVFLRGSSKSKLLTALSPPPLTESSNQPEAEPEFESHAEKFDWYSQWYPLMPICDLDKRKPHGKRVLGIDVVVWWDRNEGAWQVHDDACPHRLAPLSDGRIDQWGRLQCVYHGWCCXNGSDDXCQLIPQALPDGPPVHTSKKACVAAYPSTVQNDILWFWPNTDPQYKDIITRKRPPFIPEIDDPSYTKSMGNRDIPYGYEVLIENLMDPAHVPYAHYGLMRTPQPKVKADREGGRPLDMSIEKLDINGFSANQAWGKSKFMPPCIFYAYTPDQPASSGETKKSSAKKKMCLIFVCVPVSPGKSRLIWCFPRNFGLWMDKIVPRWIFHVGQNLILDSDLYLLHVEEHKLKDIGPNNWHKACFVPTKSDALVIGYRTWLRKYAGGQVDWRGKYSGALPPTPPREQLLDRYWSHVRLLLNMEVSI

SEQ ID NO: 2762 - protein, 176 aa, Glycine max
MPSGSRDPLVVGGVIGDVLDPFEYSIPMRVTYNNRDVSNGCEFKPSQVVNQPRVNIGGDDLRNFYTLIAVDPDAPSPSDPNLREYLHWLVTDIPATTGASFGHEVVTYESPRPMMGIHRLVFVLFRQLGRETVYAPGWRQNFNTKEFAELYNLGLPVAAVYFNIQRESGSGGRRLY

SEQ ID NO: 2763 - protein, 386 aa, Glycine max
  unsure (1)..(386): unsure at all Xaa locations
SFFNWFYFSINIGALXSSTFIVCIQENAVWGIGFCIPALFMALVMGSIFLGTPYYRFEKAWGSPITRMCQVVVASLXKPNLVVPEDSSLLYETATKSYSWLAMXNIFFGFNXRCLDRAAVVSDAESKSGDYSNQWRLCTVTQVEELKILIRMFPVWATGIVFAAVYAQMSTLFVEQGTMMNTNFGSFRIPPASLSSFDVISVIFWVPVYDRIIVPIARKFTGKERGFSELQRMGIGLFISVLCMSAAAIVEIVRLKVAKEHGLVDEPVPVPLNIFWQIPQYFLLGAAEVFTFVGQLEFFYDQSPDAMRSLCSALSLLTTSLGNYLSSFILTVVTYFTTQGGNPGWIPDNLNKGHLDYFFWLLAGLSFLNTFVYIVAAKRYKQKKSA

SEQ ID NO: 2764 - protein, 159 aa, Glycine max
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQVQPQSGYAFNARP

SEQ ID NO: 2765 - protein, 173 aa, Glycine max
MSDAPPSPTHESGGEQSPRGSSSGAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSATPDQVGLAGQNSQLVHQGSLNYIGLQVQPQHLVMPSMQSHE

SEQ ID NO: 2766 - protein, 174 aa, Glycine max
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQLVHQGSLNYIGLQVQPQHLVMPSMQSHE

SEQ ID NO: 2767 - protein, 521 aa, Glycine max
MEPLSSTKHNNNLSKPSSLHTEAPPPEASPLRKIMVVASIAAGVQFGWALQLSLLTPYVQLLGIPHTWAAFIWLCGPISGMLVQPIVGYHSDRCTSRFGRRRPFIAAGSLAVAIAVFLIGYAADLGHMFGDSLAKKTRPRAIAIFVVGFWILDVANNMLQGPCRALLADLCAGDHRKTRNANAFFSFFMAVGNVLGYAAGSYSGLHNVFPFTKTKACDVYCANLKSCFFLSIALLLTLSTIALTYVKEKTVSSEKTVRSSVEEDGSHGGMPCFGQLFGAFRELKRPMWILLLVTCLNWIAWFPFLLFDTDWMGREVYGGTVGEGKAYDRGVRAGALGLMLNSVVLGATSLGVEVLARGVGGVKRLWGIVNFLLAVCLAMTVLVTKMAQHSRQYTLLPNAHQEPLPPPAAVKAGALALFSLLGIPLAITYSIPFALASIFSSTSGAGQGLSLGVLNLAIVIPQMVVSVISGPWDALFGGGNLPAFVVGAVAAAASGILSIILLPSPPPDLAKAATAAGGGFH

SEQ ID NO: 2768 - protein, 120 aa, Glycine max
MLILNFSFLDSKAMLKMGIRGVTVSDVRGFGAQGGSKERQGGSEFSEDNFVAKVKMEIVVRKDQVEAVIDKIIEEARTGEIGDGKIFLIPVSDVIRIRTGERGEQAERMTGGRSDMLSAV

SEQ ID NO: 2769 - protein, 195 aa, Glycine max
MTAIAGTHVFGVVSFQLKQAEMPFACSCLIRKRIGDSPQRNVALRRRVNGTILPQIRAQNLPDYVPKSEFYKVEAILRPWRVPQVSAALLKMGIRGVTVSDVRGFGAQGGSKERQGGSEFSEDNFVAKVKMEVVVRKDQVEAVIDKIIEEARTGEIGDGKIFLIPISDVIRIRTGERGEQAARMTGGRSDMLSAV

SEQ ID NO: 2770 - protein, 112 aa, Glycine max
QIRAQNVLPDYVPKSEFYKVPPVRRPWRVPQVSSAMLKMGIRGVTVSDVKGFGSQGGSKERQGGSEFSEDNFVAKVKMEIVVRKDQVEAVIDKIIEEARTGEIGDGKIFCKT

SEQ ID NO: 2771 - protein, 163 aa, Glycine max
CSSEGSSRLVSELRNVLGLMRRGGNVRFEDVVILEHQSFLSRIADHQSFLSGIADVHDRHRDMRLDVDNMSYEELLALEERIGNVSTGLSEETLSKLLKQRKHSVEKGSETDAEPCCVCQEDYGDGNDIGTLDCGHDFHSSCIKQWLMQKNLCPICKTTGLAT

SEQ ID NO: 2772 - protein, 708 aa, Glycine max
MQGQRGTVGSMPETLEFDCGSASGNSTVDQQICWNNVNPAENQIPDYILSPGDMNSSYENSIINHEWQNLSGWSLGEPSSSNTPNEINNNEQKRELGWSSTITAGALAGPRLEERRLEPTNALSLDNVNTGPIYICSPNSHLMSQNLNLNAGLADSGSDDSQHLELPNLNKSSGSANECIPPNVGSGSFLLPSGNNAFLVEDTDGRPSCSLDTRRVSCKRKAVEGNNGQSSDAGSSSYSQHTDGSAWHTIPTQDNAGSSSRRSIPSEEVNARLGLGIGDEASENVSDSKTAGSSESFHRNFRLRLNPSNPANSVPPTAFSTGSMIRHSGVPPSSQVSQRLHFVDNSLNLRSAPPIDNVVPQSQPLVIHVPALPRNRQSFRWSSGSSSRNIHSSNSVICADRDQQDASSRRMSRNMLEHPVFVPATDLRNLVQNPTVRASSSSSENLSIPGNVASSSRTGSNPATNPSSATTFSRSNPPQHPRRLSEYVRRSLFSPSSDAIGSPSHNYSSLRSGLSTSEPRALSSGSGANPRSASWLERQGDSEFGIPYSLRTLAVASEGGSSRLVSELRNVLGLMRRGGNVRFEDVVILDHQSFLSGIADVRDRHRDMRLDVDNMSYEELLALEERIGNVSTGLSEETVLKHLKQRKHSAEKGPQIDAEPCCVCQEDYGDEDDIGTLDCGHDFHSSCIKQWLMHKNLCPICKTTGLAT

SEQ ID NO: 2773 - protein, 324 aa, Glycine max
MRAISHHLLVSLLDWRISTSRSLFSLRTIMSQSDHSSAFTTPRLVLKKVLAKSQHEGDGAVVRRGIGRSELKNLDPFLMLDHFSVSPPAGFPDHPHRGFETVTYMLEGGITHQDFAGHKGTIRKGDVQWMTAGRGIIHSEMPAEANNNKGLQLWINLSSRDKMMEPNYQELPSENIPRAEKDGVEVRVIAGEAMGVHSPVYTRTPTMYLVFCMMPGTQWHQRIPESWNAFVYTIEGEGVFGCPSSSPTVAHHVLVLSQGDGLSVWNNSSKPLRFVLIGGQPLNEPVVQYGPFVMNTQSEIEKTIEDYHYGRNGFEMSKYWMSQQ

SEQ ID NO: 2774 - protein, 333 aa, Glycine max; identical to SEQ ID NO: 930

SEQ ID NO: 2775 - protein, 223 aa, Glycine max
SPKCSCIRGHQVQAVTVHATNNYFVTASLDGSWCFYELSSGTCLTQVYDTSGSSEGYTSAAFHPDGLILGTGTTESLVKIWDVKSQANVARFDGHAGPVTAISFSENGYFLATAAHDGVKLWDLRKLKNFRNFAPYDSETPTSSVEFDHSGSYLAVAGSDIRIYQVANVKSEWNCIKTFPDLSGTGKNTCVKFGSDSKYIAVGSMDRNLRIFGLPGEDAPTES

SEQ ID NO: 2776 - protein, 525 aa, Glycine max
MNCSISGEVPEEPVVSRNSGLLFEKRLIERHISDYGKCPITGEPLTMDDIVPIKTGKIVKPRPVQAASIPGMLGMFQNEWDGLMLSNFALEQQLHTARQELSHALYQHDAACRVIARLKKERDEARSLLAQAERQFPVSAPNAITANAPVLSNGKRAAEDEDLAPGAKKIHPGISSSIISELTDCNAALSQQRKKRQIPPTLAPVEALEAYTQISSHPFHKTNKQGIISLDILYSKDLIATGGIDTNAVIFDRPSGQILSTLSGHSKKVTSVKFVAQGESFLTASADKTVRLWQGSDDGNYNCRHILKDHSAEVQAVTVHATNNYFVTASLDGSWCFYELSSGTCLTQVYDTSGSSEGYTSAAFHPDGLILGTGTTESLVKIWDVKSQANVARFDGHAGPVTAISFSENGYFLATAAHDGVKLWDLRKLKNFRNFAPYDSETPTSSVEFDHSGSYLAVAGSDIRIYQVANVKSEWNCIKTFPDLSGTGKNTCVKFGPDSKYIAVGSMDRNLRIFGLPGEDAPTES

SEQ ID NO: 2777 - protein, 550 aa, Glycine max
MGRVWTSMIALLLCLMTSSVRGEDPYIYYTWNVTYGTIAPLGVPQQGILINGQFPGPEINSTSNNNVVINVFNNLDEPLLFTWHGVQQRKNSWQDGTLGAQCPIAPGTNYTYRFQVKDQIGTYFYYPTTGLQRAVGGFGGLRIFSRLLIPVPYADPADEYWVLIGDWFGKSHTALKQTLDSGRSIGRPSGVHINGKNGGLEALYTMEPGKTYKYRICNVGLKEALNFRIQGHPMKLVETEGSHVVQNTYDSLDVHVGQCFTVLVTADQEPRDYFMVASTRFTKKVITATRVIRYSNGVGPASPLLPPAPHQGWAWSLNQFRSFRWNLTASAARPNPQGSYHYGQINITRTIKLVGTRSKIGGKLRYALNGVSHVDPETPLKLAEYYGVADKVFKYNLISDAPDAAIASRDPIIAPNVINATFRNFIEVILENPTKVTQSYNLDGYSFFAVAVEPGQWSPEKRKCYNLLDAVSRHTIQVFPKSWAAIMLTFDNAGMWNLRSEMAENRYLGQQLYVSVLSPNRSLRDEYNLPETQLVCGIVKDMPKPPPYSS

SEQ ID NO: 2778 - protein, 311 aa, Glycine max
MESSSIESSTVSSMTMMEEDEHPHHQFSSISKLHNSGPTTTSVHDLLECPVCTNSMYPPIHQCHNGHTLCSTCKTRVHNRCPTCRQELGDIRCLALEKIAESLELPCRYISLGCPEIFPYYSKLKHEAICNFRPYNCPYAGSDCSVVGDIPCLVAHLRDDHRVDMHSGCTFNHRYVKSNPMEVENATWMLTVFHCFGQYFCLHFEAFQLGMAPVYMAFLRFMGDEREARNYSYSLEVGGNGRKLTFEGSPRSIRDSHKKVRDSHDGLIIYRNMALFFSGGDRKELKLRVTGRIWKEQQNPEGGVCIPNLCS

SEQ ID NO: 2779 - protein, 636 aa, Glycine max
MMESCDCIDTQYPPDELLVKYQYISDVLIALAYFSIPVELIYFVQKSAFFPYRWVLMQFGAFIVLCGATHFINLWTFSPHSKSVAVVMTIAKVSCAIVSCATALMLVHIIPDLLSVKRRESILKNKAEELDREMGLILTQEETGRHVRMLTHEIRSTLDRHTILKTTLVELGRTLGLEECALWMPSRSGLNLQLSHTLTYHVQVGSTVQTNNPIVNEVFNSPRAMRIPPTCPLARIRPLVGRYVPPEVVAVRVPLLNLSNFQINDWPDMSAKSYAIMVLILPTDSVRKWRDHELELVDVVADQVAVALSHAAILEESMRARDQLLEQNVALDLARREAEMAIHARNDFLAVMNHEMRTPMHAIIALSSLLLETELTPEQRVMIETVLKSSNVLATLINDVLDLSRLEDGSLELEMGKFNLHGVLGEIVELIKPIASVKKLPITLILSPDLPTHAIGDEKRLTQTLLNVVGNAVKFTKEGYVSVRVSVAKPESSQDWRPPEFYPASSDGHFYIRVQVKDSGCGILPQDIPHLFTKFAQSRSGPARPSSGAGLGLAICKRFVNLMGGHIWIESEGLDKGSTATFIVKLGICGNPDPSDHQAANRSQAYSGSGGLARFKPFITDENDTGFSTRRNQRSF

SEQ ID NO: 2780 - protein, 220 aa, Glycine max
MIMIMMGSNPKPLVHLSLLLLVLFSSSTESLRFEIQSGHTKCISEDIKSNSMTVGKYQIVSPNEGQPLPDAHRFTVRVTSSYGNNYHYGDRVQTGQFAFAAVEAGDYMTCFWAVDHNPVETLTVDFDWKTGVAAKDWSNVAKKGQVDVMELELKKLQDTVSSIHEEMFYLREKEEEMQELNRTTSSRMFWLSLLSLFVCLSVAGMQIWHLKTFFEKKKLI

SEQ ID NO: 2781 - protein, 242 aa, Glycine max
MWNQPFGKTDLESGSRPLYPMMLESPELRWSFIRKVYSIIAIQLLVTIVVGAVVVTVRPISVFFATTGAGLALYIVLIFVPFITLCPLYYYSQKHPVNYLLLGVFTVSLGFVVGLSCAFTSEKVILEAVILTAVVVIGLTLYTFWAARRGHDFNFLGPFLFGAVLVLMVFALIQVLFPLGKLSVMIYGCLAAIIFCGYIIYDTDNLIKRYSYDEYIWASISLYLDIINLFLSLLTIFRAADS

SEQ ID NO: 2782 - protein, 108 aa, Glycine max
MGPNAAAAKQAEKLRIDGNTYFKKDRFGAAIDAYTEAITLCPNVPVYWTNRALCHLKRNDWERVEEDSRNAIQLDSNSVKAHYILWLALLQRQQSVTGITELTKPFDL

SEQ ID NO: 2783 - protein, 278 aa, Glycine max
MGPNAAAAKQAEKLRIDGNTYFKKDRFGAAIDAYTEAITLCPNVPVYWTNRALCHLKRNDWERVEEDSRKAIQLDSNSVKAHYMLGLALLQRQESAKGIKELEKALDLGRGANPKGYMVEEIWQELAKAKYLEWERSSSKRSWELQSLKEACESALKEKHFLDYSQMEGFVDDATTSHSEQLEALERVFNTAAEADIPTEVPDYLCCRITLDIFHDPVITPSGLTYERAVILEHLQKVGKFDPITREPLDPSQLVPNLAIKEAVEAFLDKHGWAYKID

SEQ ID NO: 2784 - protein, 116 aa, Glycine max
MMRLRWSVLVMVTFAVSLFWLGPLQVKASNSVSAFVQNAIYSNRIAVFSKSYCPYCLRAKRLLAELNEKPFVVELDLRDDGFQIQSVLLDLIGRRTGPQVFVNGQHIGGSDDLSAG

SEQ ID NO: 2785 - protein, 143 aa, Glycine max
MGREETHRAWRKRRMMRLRWSVLVMVTFAVSLFWLGPLQVKASNSVSAFVQNAIYSNRIAVFSKSYCPYCLRAKRLLAELNEKPFVVELDLRDDGFQIQSVLLDLIGRRTVPQVFVNGKHIGGSDDLSAAVQSGELQKLLSAS

SEQ ID NO: 2786 - protein, 133 aa, Glycine max
  unsure (1)..(133): unsure at all Xaa locations
MMRLRWSLVVTGTFAVLLFWIGSLQVQASKGGSAFXQNAIYSNRIAVFSKSYCPYCLRAKRLLAELNEKPXVVELDLRDDGYQIQSVLLDLIGRRTVPGVFGNGKHIGGSDDLEAGGQSGEWRKLVEARWSGC

SEQ ID NO: 2787 - protein, 68 aa, Glycine max
LLAELNEKPFVVELDLPDDGYQIQSVLLDLIGRRTVPQVFVNGKHIGGSDDLSAAVQSGELQKLLSAS

SEQ ID NO: 2788 - protein, 408 aa, Glycine max
  unsure (1)..(408): unsure at all Xaa locations
FTRPIGNYSDGNLVASLLAYKMGVTQCTIAHALEKTKYPDSDLYWKKFEDKYHFSCQFTADLIAMNNADFIITSTYQEIAGTHPXLKNTVGQYESHAGFTLPGLYRVVHGIDVFDPKFNIVSPGADMSIYFPYSEKQNRLTALHGSIEQLLFAPEQTDEYIGLLKDKSKPIIFSMARLDRVKNITGLVESFGKNSKLRELVNLVIVAGYIDVKKSSDREEIAEIEKMHELMKKYNLVGDFRWIAAQTNRARNGELYRYIADTQGAFVQPAFYEAFGLTVVEAMNCGLPTFATCHGGPAEIIEHGISGFHIDPYHPDQASQLLVEFFQKSKEDPSHWKKISDGGLQRIYERYTWKIYSERLMTLAGVYSFWKYVSKLERRETRRYLEMFYILKFRDLANSVPLAKDDAS

SEQ ID NO: 2789 - protein, 571 aa, Glycine max
SARDTAERVLEMMHLLLDILQAPDPSTLETFLGRVPMVFNVAILSPHGYFGQANVLGLPDTGGQVVYILDQVRALENEMLLRIKKQGLDFTPRILIVTRLIPDAKGTTCNQRLERVSGTDHTHILRVPFRSESGTLRKWISRFDVWPYLETYAEDVASEIAAELQGYPDFIIGNYSDGNLVASLLAYKMGVTQCTIAHALEKTKYPDSDLYWKKFEDKYHFSCQFTADLIAMNNADFIITSTYQEIAGTKNTVGQYESHAGFTLPGLYRVVHGIDVFDPKFNIVSPGADMSIYFPYSEKQNRLTALHGSIEQLLFAPEQTDEYIGLLKDKSKPIIFSMARLDRVKNITGLVESFGKNSKLRELVNLVIVAGYIDVKKSSDREEIAEIEKMHELMKKYNLVGDFRWIAAQTNRARNGELYRYIADTQGAFVQPAFYEAFGLTVVEAMNCGLPTFATCHGGPAEIIEHGISGFHIDPYHPDQASQLLVEFFQKSKEDPSHWKKISDGGLQRIYERYTWKIYSERLMTLAGVYSFWKYVSKLERRETRRYLEMFYILKFRDLANSVPLAKDDAS

SEQ ID NO: 2790 - protein, 313 aa, Glycine max
MESEDLVKQELEELQKQLGKKLKFEASISSLKSLLQRTYPSASPALRKSFYSVICRVATVLKTRYTAPGFWNAGLGLFEQAHLLVSEPSEKENLKACIAQAREHLHLEDNPSQALQPSDNQANRGYLFEGHLTVDPEPPQPQWLVQSNLLTTAATLFAAESSQAPAANETTQEDAANMLQDLLNRLEEVVPLMVDGGPVAPKAPPASKEVVANLPVITLTEEILANLGKDAECAICRENLVLNDKMQELPCKHTFHPPCLKPWLDEHNSCPICRHELQTDDHAYESWKEREKEAEEERKGAENAIRGGEYMYV

SEQ ID NO: 2791 - protein, 325 aa, Glycine max
MRAISHPLSLLNWRISTSRSLFSLRNTCTNTMSQSDNSSPFTTPRLVLKKVLAKSQHEGDGAVVRRGIGRSELKNLDPFLMLDHFSVSPPAGFPDHPHRGFETVTYMLEGGITHQDFAGLMGTLRAGDVQWMTAGRGIIHSEMPAEANNNKGLQLWINLSSRDKMIEPNYQELPSENIATAEKDGVEVRVIAGEAMGVHSPVYTRTPTMYLVFSMMPKTQWNQSIPESWNAFVYIIEGEGVFGSPTSSPTVPHHVLVLTQGDGLSVWNNSSKPLRFVLIGGQPLNEPVVQHGPFVMNTQSEIENTIEDYHYGRNGFEMSKYWMSQ

SEQ ID NO: 2792 - protein, 376 aa, Glycine max
MGQRKNDNNINQCSSSKEDADMNNNHLRFEEAVDESSNLDQSMCDIEESDDKTSADYYFDSYSHFGIHEEMLKDTVRTKTYQNVIYQNKFLFKNKVVLDVGAGTGILSLFCAKAGAEHVYAVECSHMADMAKEIVEANGYSNVVTVLKGKIEEIELPVAKVDIIISEWMGYFLLFENMLNSVLYARDKWLVDGGVVLPDKASLHLTAIEDADYKEDKIEFWNNVYGFDMSCIKKQAIMEPLVDTVDQNQIATNCQLLKTMDISQMAPGDASFAAPFKLVAERDDYIHALVAYFDVSFTKCHKLMGFSTGPRSRATHWKQTVLYLEDVLTVCEGEAIVGSMTVAPNKKNPRDVDIMLKYSLNGRRCNVSRVQYYKMR

SEQ ID NO: 2793 - protein, 95 aa, Glycine max
  unsure (1)..(95): unsure at all Xaa locations
SDDITSADYYFDSYSHFGIHEEMLKDSVRTKTYQNVIYQYRFLFKNKVTLDVGAGTEILLLFCAKARAEHVYAVECSYMAXMAKEIVSTNGYSNV

SEQ ID NO: 2794 - protein, 389 aa, Glycine max
MEDQNASSNGLGKVFHKVKPYLAMMSLQFGYSGMYIITMVSFKHGMSHWVLSVYRHIVATLIMAPFAFVLERKIRPKMTLPVFLRLAALGFLEPVLDQNLYNMGMKNTSTTFASATVNVMPAITFIMALICRLETVNLRKIPSVAKVVGTAVTVSGAMVMTLYKGPALQFIKGQAATHHESGNSTQPSEQNWVLGTVELIASCGGWASFFILQSFTLKMYPAELSVTAWICFLGIFEGAIATLIFERDMSVWSIGMDSRLLACVYSGVVCSGMAYYVQGVVTRERGPVFVTSFSPLCMIITAALGSIVLAEQVYMGSVIGAIIIVSGLYTVVWGKSKDKLNNKTNEGNSEGPELPIKDGTKSGSDIFDSIEINVPSGAGKNVLLPSART

SEQ ID NO: 2795 - protein, 136 aa, Glycine max
MAGKGGKGLVAGKTTAANKDKDKDKKRPVSRSSRAGIQFPVGRIHRQLKQRVQANGRVGATAAVYLASILEYLTAEVLELAGNASKDLKVKRITPRHLQLAIRGDEELDTLIKGTIAGGGVIPHIHKSLINKAAKE

SEQ ID NO: 2796 - protein, 136 aa, Glycine max; identical to SEQ ID NO: 2795

SEQ ID NO: 2797 - protein, 712 aa, Glycine max
  unsure (1)..(712): unsure at all Xaa locations
MDLSSLSSYRTVGVTPSDPRKSLPQWGLHFLSYTHRLNQIKKRSSGVYASLSERERGEYYSQRPPTPLLDTVNYPIHMKNLXLPIADELRSDVIFSVSRTGGHLGSSLGVVELTVALHYVFNAPQDKILWDVGHQSYPHKILTGRRDQMHTMRQTNGLSGFTKRSESEFDCFGTGHSSTTISAGLGMAVGRDLKGGKNNVVAVIGDGAMTAGQAYEAMNNAGYLDSDMIVILNDNKQVSLPTANLDGPIPPVGALSSALSRLQSNRPELEVAKSNTILMRNCSXDFWSLQIMQAAKVDEYARGMISGSGSSLFEELGLYYIGPVDGHNINDLVAILNEVKSTNTTGPVLIHVITEKGRGYPYAEKAADKYHGVTKFDPPTGKQFKSKATTRSYTTYFAEALIAEAEADKDVVAIHAAMGGGTGMNLFHRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAINDRPSCFRYPRGNGIGVQLPTGNKGTPLEIGKGRILIEGERVALLGYGSAVQNCLAAASLVEHHGLRVTVADARFCKPLDRSLIRSLAKSHEVLITVEEGSIGGFGSHVAQFMALDGLIDGKLKWRPIVLPDRYIDHGSPADQLSLAGLTPSHIAATVFNILGQTREALEVMS

SEQ ID NO: 2798 - protein, 707 aa, Glycine max
DLSALSSYRTLGKLLPLPSHSQWGLHFLAHAHPLHQMKKRPCGVYASLSESGEYYSHRPPTPLLDTVNYPIHMKNLSTKELKQLADELRSDVIFSFSRTGGHLGSSLGVVELTVALHYVFNAPQDKILWDVGHQSYPHKILTGRRDQMHTMRQTNGLSGFTKRSESEFDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGPMHELAAKVDEYARGMISGSGSSLFEELGLYYIGPVDGHNIDDLVAILNEVKSTKTTGPVLIHVITEKGRGYPYAEKAADKYHGVTKFDPPTGKQFKSKATTQSYTTYFAEALIAEAEADKDVVAIHAAMGGGTGMNLFHRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEADLFHMVATAAAINDRPSCFRYPRGNGIGVQLPTGNKGTPLEIGKGRILIEGERVALLGYGSAVQNCLAAASLVECHGLRLTVADARFCKPLDRSLIRSLAKSHEVLITVEEGSIGGFGSHVAQFMALDGLLDGKLKWRPIVLPDRYIDHGSPADQLSLAGLTPSHIAATVFNVLGQTREALEVMS

SEQ ID NO: 2799 - protein, 673 aa, Glycine max
IKKRSSGVYASLSERERGEYYSQRPPTPLLDTVNYPIHMKNLSTNELKQLADELRSDVIFSVSRTGGHLGSSLGVVELTVALHYVFNAPQDKILWDVGHQSYPHKILTGRRDKMHTMRQTNGLSGFTKRSESEFDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGPMHELAAKVDEYARGMISGSGSSLFEELGLYYIGPVDGHNINDLVAILNEVKSTNTTGPVLIHVITEKGRGYPYAEKAADKYHGVTKFDPPTGKQFKSKATTRSYTTYFAEALIAEAEADKDVVAIHAAMGGGTGMNLFHRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAINDRPSCFRYPRGNGIGVQLPTGNKGTPLEIGKGRILIEGERVALLGYGSAVQNCLAAASLVEHHGLRVTVADARFCKPLDRSLIRSLAKSHEVLITVEEGSIGGFGSHVAQFMALDGLIDGKLKWRPIVLPDRYIDHGSPADQLSLAGLTPSHIAATVFNILGQTREALEVMS

SEQ ID NO: 2800 - protein, 557 aa, Glycine max
MYSHWVRLMLLIACILPALVECRERHYKFHVVSKQTNRLCSSKSIVTINGKFPGPTLYAREDDTVLVKVINQVNHNVTIHWHGVRQLRTGWADGPAYVTQCPIQPGQTYVYNFTLTGQRGTLLYHAHVNWLRSTLYGALVILPKRGVPYPFPKPDDELVVVLGEWWKSDTEAVINEALKSGLAPNVSDAHTINGLPGTVTNCSTQDVYNLPVESGKTYLLRIVNAALNEELFFKIAGHKLTVVEVDATYVKPFKIETIVIAPGQTTNVLLNANQKSGKYLVAASPFMDAPVAVDNLTATATLHYTGTLAATPTILTTPPPKNATQIANNFISSLRGLNSKKYPVNVPLTVDHSLIFTVGLGINPCPSCKAANGSRVVAAINNVTFIMPTIALLQAHYFNIKGVFTTDFPANPPHVFNYSGPGPANLNTETGTKVYRLPFNATVQVVLQDTGIIAPENHPVHLHGFNFFVVGRGVGNFNPKIDPKNFNLVDPVERNTIGVPAGGWTAFRFRADNPGVWFMHCHLEVHTTWGLKMAFLVDNGKGPKQSVIPPPKDLPKC

SEQ ID NO: 2801 - protein, 169 aa, Glycine max
IGRYKIGQGGAWGVFASVSADGSVRVFDLRDKEHSTIIYESSEPDTPLVRLGWNKQDPRYMATIIMDSAKVVVLDIRFPTLPVVELQRHQASVNAIAWAPHSSCHICTAGDDSQALIWDLSSMGQPVEGGLDPILAYTAGAEIEQLQWSSSQPDWVAIAFSTKLQILRV

SEQ ID NO: 2802 - protein, 157 aa, Glycine max
  unsure (1)..(157): unsure at all Xaa locations
MGASSDPTQDGSDEQQKRSEIYTYEAPWHIYAMNWSVRRDKKYRLAIASLLEQYPNRVEIVQLDDSNGEIRSDPSLSFEHPYPPTKSIFIPDKDCHRPDLLATSFDFLRVWHISESSVELKSLLNGNKNSEYCXPLTSFDWNEAEPRRIGTFSIDTT

SEQ ID NO: 2803 - protein, 212 aa, Glycine max; identical to SEQ ID NO: 1815

SEQ ID NO: 2804 - protein, 229 aa, Glycine max
MGGCCCCCCSAKETVLSAPPAYYYYPRASEEHVPLSSHQGAASAFSGRLLVDTNLDTSSPDTYRPPPAPIPFNVTLGTTQTPPAAQEIRKPVAGDNHGTSAKLEELKESDCKVQTDLELDSAKGSEIELAKSGKPIDVVEEEDTCPICLEEYDAENPKLATNCDHHFHLACILEWMERSETCPCVRSGFPQSLPISHLPLDLCEDTLVNMTLKAILCLTQDLGFDPPIE

SEQ ID NO: 2805 - protein, 248 aa, Glycine max
MGMAAAESQFHVLAVDDSIIDRKLIERLLRTSSYQVTTVDSGSKALEFLGLRENDESNPSIPSVCPNNHQPQEVEVNLVITDYCMPGMTGYDLLKKIKESSSLRNIPVVIMSSENVPSRINRCLEEGAEEFFLKPVRLSDLNKLKPHMKKTKFKDQKQETVERFEDSEVQQQQSQQQIIIQNEHHQAPKLQVLQPESESESHPQPTIEQQQQILQQANNNNKRKTMEQGLSPETDRTRPRYSGIATVV

SEQ ID NO: 2806 - protein, 345 aa, Glycine max
MEESFVFQWSVIRSLLSILQWWAFNVTVIIVNKWIFQKLDFKFPLSVSCVHFICSSIGAYVVIKLLKLKPLITVDPEDRWRRIFPMSFVFCINIVLGNVSLRYIPVSFMQTIKSFTPATTVVLQWLVWRKYFDWRIWASLIPIVGGILLTSVTELSFNMFGFCAALFGCLATSTKTILAESLLHGYKFDSINTVYYMAPFATMILALPAMLLEGNGILEWLNTHPYPWSALIIIFSSGVLAFCLNFSIFYVIHSTTAVTFNVAGNLKVAVAVLVSWLIFRNPISYLNSVGCTVTLVGCTFYGYVRHKLSQQPQVPGTPRTPRTPRTPRSKMELLPLVNDKLEDKV

SEQ ID NO: 2807 - protein, 415 aa, Glycine max
MALRPFHFNSFSRDRLLFLLCSSLSHSHSYSSFPSPLRSPNFPQTFSLRRFAAAPLACPPPPPPPLDAMAQKIGKSTRRPGSSSKARVYADVNVVRPKEYWDYESLNVQWGEQDDYEVVRKVGRGKYSEVFEGVHCTDGEKCVIKILKPVKKKKIKREIKILQNLCGGPNIVQLLDIVRDQQSKTPSLIFEYVNNTDFKVLYPTLSDYEIRYYIYELLKALDYCHSQGIMHRDVKPHNVMIDHEQRKLRLIDWGLAEFYHPGKEYNVRVASRYFKGPELLVDLQDYDYSLDLWSLGCMFAGMIFRKEPFFYGHDNYDQLVKIAKVLGTDGLSAYLDKYRIELDPHLAALIGRHSRKPWAKFINVENHHMAVPEAVDFVDKLLRYDHQERPTAKEAMAHPYFNPVRNAESSRTRAH

SEQ ID NO: 2808 - protein, 145 aa, Glycine max
MPVPLAPYPTPPAPYTPPANGVQSQLVCSGCRNLLVFPVGATSVCCAVCNAVTAVPPPGTEMAQLVCGGCHTLLMYIRGATSVQCSCCHTVNLALEANQVAHVNCGNCRMLLAYQYGARSVKCAVCNFVTSVGATASTTEQKFST

SEQ ID NO: 2809 - protein, 145 aa, Glycine max; identical to SEQ ID NO: 2808

SEQ ID NO: 2810 - protein, 298 aa, Glycine max
FVCISLLSMPGPRENLLRCFIKRNRSTQTYYLFLSLTSTLAEDGKFLLAARKCRRPTCTDYIISLDADDMSKGSNSYVGKLRSNFLGTKFTIYDSQLPHTGAKIMKSRSTRLVNLKQVSPKVPTGNYPVAHISYELNVLGSRGPRRMHCVMDSIPAAAIEPGGVAPVQTEFSLNNIDMFPSFPFFRSKSNRVENSVSGPLVDQKDGMLVLKNKAPRWHEQLQCWCLNFHGRVTIASVKNFQLVASAENRPAGPEHDKIILQFGKVGKDLFTMDYRFPISAFQAFAICLSSFDTKIACE

SEQ ID NO: 2811 - protein, 389 aa, Glycine max
  unsure (1)..(389): unsure at all Xaa locations
MGLIRSMRSRSQRVVQEQEAAECVGVVVGDSMRQSCWANMPQELLREVLLRIEASEDTWPPRKSVVSCAGVCRSWRHITKDIVKTPELSSKITFPISVKQPGPRENLLRCFIKRNRSTQTYYLFLSLTSTLAEDGKFLLAARKCRRPTCTDYIISLDADDMSKGSNSYVGKLRSNFLGTKFTIYDSQLPHTGAKIMKSRSTRLVNLKQVSPKVPTGNYPVAHISYELNVLGSRGPRRMHCVMDSIPATAIEPGGVAPTQTEFSLNNIDMFPSFXFFRSKSNRAENSMSGPLVDQKDGMLVLKNKAPRWHEQLQCWCLNFHGRVTIASVKNFQLVASAENGPAGPEHDKIILQFGKVGKDLFTMDYRYPISAFQAFAICLSSFDTKIACE

SEQ ID NO: 2812 - protein, 274 aa, Glycine max
MSFVFRGTRADIENGFPGFIPERRALRVHATRPSNSNSLTFLVTVLLLFMILNSHQMSPNFLLWLVLGVFLMATMLRMYATCQQLQAQAQAHAAAASGILGHTELRLHMPPSIALASRGRLQGLRLQLALLDREFDDLDYETLRALDSDNVSTAPSMTEEEINALPVHKYKVSGPQCGGSSMQQASSSTPAEKKQDNSNAVGSMKASDDDLTCSVCLEQVNVGDVLRSLPCLHQFHANCIDPWLRQQGTCPVCKFRAGSGWSDNGHNDIIADMV

SEQ ID NO: 2813 - protein, 252 aa, Glycine max
MCFFLPLYCIKVPFTPYCLYVSVLLLFMILNSHQMSPNFLLWLVLGVFLMATMLRMYATCQQLQAQAQAHAAAASGILGHTELRLHMPPSIALASRGRLQGLRLQLALLDREFDDLDYETLRALDSDNVSTAPSMTEEEINALPVHKYKVSGPQCGGSSMQQASSSTPAEKKQDNSNAVGSMKASDDDLTCSVCLEQVNVGDVLRSLPCLHQFHANCIDPWLRQQGTCPVCKFRAGSGWSDNGHNDIIADMV

SEQ ID NO: 2814 - protein, 185 aa, Glycine max
MASEVIEYRCFVGGLAWATDSDALEKAFSHYGEIVESKVIIDRETGRSRGFGFVTFASEQAMKDAIEGMNGQNLDGRSITVNEAQSRGRGGGGGGYGGGGGYGGGGYSRGGGGYGGGGRREGGGGGYNRNGGGGGYGGGGGYGGGGGHGGGGGYGGGGRDRGYGGDGGSRYSRGGGASDGGSWRN

SEQ ID NO: 2815 - protein, 178 aa, Glycine max
  unsure (1)..(178): unsure at all Xaa locations
MASEVIEYRCFVGGLAWATDSDALEKAFSHYGXIDRETGRSRGFGFVTFASEQAMKDAIEGMNGQNLDGRSITVNEAQSRGRGGGGGGYGGGGGYGGGGYSRGGGGYGGGGRREGGGGGYNRNGGGGGYGGGGGYGGGGGHGGGGGYGGGGRDRGYGGDGGSRYSRGGGASDGGSWRN

SEQ ID NO: 2816 - protein, 161 aa, Glycine max; identical to SEQ ID NO: 2018

SEQ ID NO: 2817 - protein, 387 aa, Glycine max
  unsure (1)..(387): unsure at all Xaa locations
MTITRFVLKXQDSQPESRGDFSILXSHIVLGCKFFCSAVSKAGLAKLIGLAGETNVQGEEXKKLDVLSNDVFIKALMSSGRTCILVSEEDEEATIVESSKRGKYCVVFDPLDGSSNIDXGVSIGTIFGVYAIKEKNKENIDDESFFRLNYTLNGMFFFDSSLSRCSFYVGVATYCSRKTCLRVFSLAIFWGXHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 2818 - protein, 171 aa, Glycine max
MADGPASPGGGSHESGEHSPRSNVREQDRYLPIANISRIMKKALPANGKIAKDAKETVQECVSEFISFITSEASDKCQREKRKTINGDDLLWAMATLGFEDYIDPLKIYLTRYREMEGDTKGSAKGGDSSAKRDVQPSPNAQLAHQGSFSQNVTYPNSQGRHMMVPMQGPE

SEQ ID NO: 2819 - protein, 352 aa, Glycine max
MGEGERFQLGTVGALTLSVVSSVSIVICNKALMSSLHFIFATTLTSWHLLVTFCSLHVALKMRFFEHKPFEQKAVIGFGILNGISIGLLNLSLGFNSVGFYQMTKLAIIPCTVLLETIFLGKRFSKRIQFALSILLLGVGIATVTDLQLNALGSFLSFLAVITTCVAQIMTNTIQKKYKVSSTQLLYQSCPYQAATLLISGPYLDKLLTNQNVFGFNYTTQVTVFIILSCLISMSVNFSTFLVIGKTSPVTYQVLGHLKTCLVLAFGYILLRDPFSWRNILGILIAMIGMILYSYYCTLENQQKTARRLHRNHAQAREDESDPLMNVENGSAVVSSNVGQRQMSPVWSKSKD

SEQ ID NO: 2820 - protein, 327 aa, Glycine max
  unsure (1)..(327): unsure at all Xaa locations
MSTAGQVIKCRAAVAWEAGKPLSIETIEVAPPQKGEVRLKILFNSLCRTDVYWWDAKGQTPLFPRILGHEASGIVESVGKGVTHLKPGDHALPIFTGECGECTYCKSEESNLCELLRINTDRGVMLSDGKTRFSKNGQPIYHFVGTSTFSEYTVLHEGCVAKINPAAPLDKVAVVSCGFCTGFGATVSTXFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 2821 - protein, 381 aa, Glycine max
MCFCCQSLDCHFSAAVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAVVSCGFCTGFGATVNVAKPKPNNTVAVFGLGAVGLAACEGARVSGASRIIGVDLLTNRFEQAKQFGVTDFVNPKDHNKPVQEVIAEMTNGGVDRAIECTGSIQASISAFECTHDGWGTAVLVSVPKKDAEFKTHPMKFMEGRTLKGTFYGHYRPRTDIPGVVEKYLNKELELDKFITHSVPFSEINTAFDLMLKGEGIRCLICMEE

SEQ ID NO: 2822 - protein, 604 aa, Glycine max
  unsure (1)..(604): unsure at all Xaa locations
LLLKLFIAFLAWXVLVPVNATSTGLESAGLDNITSSDIDKLSISNVHSTSERFWAHILVAYAFTFWTCYILLXEYEKVASMRLQFLAAEKRRPDQFTNLVVHHLLLSLLKQXVESFNHHNNEIDKLSKEIAFERDNVSNDPKSIMPAAFVSFKTRWGAAVCAQTQQTRNPTMWLTEWAPEPRDIYWSNLAIPYVSLTVRRLIMAVAFFFLTFFFMIPIAIVQGLASIEGIHKRAPWLNPLIDIPFIKSFIQGFLPGIALKLFLIFLPTILMIMSKFEGFGSISSLERRSASRYYLFNFVNIFLGNILTGTAFEQLDSFIHQPANEYPITIGTAIPLKASFFITYIMVDGWAGIAAEVLMLKPLIIYHLKNFFLVKTEKDREEAMDPGSIGFNTGEPRIQLYFLLGLVYASVTPTVLPFIIVFFGLAYVVFRHQIINVYNQEYESGAAFWPDVHFRVIIALIVSQIVLMGLLTTKEAASSTPFLIVLPVLTIWFHIYCKGRFEPAFVRYPLQEAMMKDTLERATDPNFNLKAYLQNAYVHPVFKASLFDEDEEDEEVMSLKLETESVTVPTKRQSRRNTPLASRISGASSPSLPDHGIRNHNPEP

SEQ ID NO: 2823 - protein, 391 aa, Glycine max
MNVLALGRFLTSPLYKSSPLTPSPIQFTPIFLHPPKFQSLYSIHPFSLSMATCVDASTPLSRKPNGSQSDDHSFNYMKFCRPSFSDRVPCMPICKNRDTAFTRVEEFDTCVEDNDDIEVEVVEGVDLWLKIQEEARLDVDQEPILSSYYFSSILSHKSLESALANHLSTNLSSLSLPSSTLFDLFMGVLVDDGDDDIVGAVKDDLIAVKERDPACISYVHCLLNFKGFLACQAHRIAHKLWLQGRKVLALLIQNRVSEVFAVDIHPGAKIGRGILLDHATGLVVGETAVIGNNVSILHNVTLGGTGKASGDRHPKIGDGVLIGAGTCILGNIKIGDGAKIGACSVVLKEVPPRTTAVGNPARLVGGKDNPIKLDKMPSFTMDHTSWSDYVI

SEQ ID NO: 2824 - protein, 390 aa, Glycine max
  unsure (1)..(390): unsure at all Xaa locations
NFSSSQLLIEIEFKFEKAYLCHCTFTDLRLRASLSYFCVDLVSVKRLPFHHSPLFISFFYIDLKLKMESEKKSSAISDVGAWAMNVVSSVGIIMANKQLMSNNGYAFSFASSLTGFHFAVTALVGLVSNATGYSASKHVPMWELIWFSLVANMSITGMNFSLMLNSVGFYQISKLSMIPVVCVMEWILHNKHYSREVKMSVVVVVIGVGVCTVTDVKVNLKGFMCACIAVLSTSLQQISIGSLQKKYSIGSFELLSKTAPIQALFLLILGPFVDYYLSGKLITNYKMSSGAILFILLSCSLAVFCNVSQYLCIGRFSAVSFQVLGHMKTVCVLTXVGMVIYSWAVELEKQSNAKTLPHAKNSMTEEEIRLLRDGVEKSPLKDVELGEAQG

SEQ ID NO: 2825 - protein, 276 aa, Glycine max
  unsure (1)..(276): unsure at all Xaa locations
MDERSRNEASPQLLDLISNEREWQMNKRNEGKSSEERKLELRLGPPGEDWSLGGKMKNTEREESLLSLGCFSPNNGXFSPSSANTAVSQPNTSQKRTAPAPVVGWPPIRSFRKNLASSSSASKPPPESQAEQHNKVAGKKPVDNYANNKGLFVKINMDGVPIGRKVDLNAYDSYENLSSAVDELFRGLLAAQRDSSAGGVHNKQEEEKAITGLLDGSGEYTLVYEDNEGDRMLVGDVPWHMFVSTVKRLRVLKSSELSAFTLGSKQDKIPLDSAMK

SEQ ID NO: 2826 - protein, 614 aa, Glycine max
  unsure (1)..(614): unsure at all Xaa locations
MGVCTSKPQKPNPYALREAEAEADPSQNPKTTLSPAGADTPRRKDDVSTGKRSPFFPFYSPSPARFLKKSPAPAGGSRSASSTPRRFFRRPFPPPSPAKHIRAVLARRQGKKASATAAIPEEGEGGCGGXWIRGFGFSKEFTSRLEVGEEVGRGHFGYTCSAKFKKGELKGQQVAVKVIPKAKMTTAIAIEDVRREVKILRALNGHSNLIQFYDAFEDQDNVYIVMELCEGGXRLLDMILSRGGKYSEDDAKAVMVQILNXVVAFCHXLQGVGHRDLKPXENFLYAKKDESSELKAIDFGLSDFVRPDERLNDIVGSAYYVAPEVLHRSYGTEADVWSIGVIAYILLCGSRPFWARTESGIFRAVLKADPSFDETPWPSLSLEAKDFVKRILNKDPRKRISAAQALSHPWIRNCNNVKVPLDILIFKLMKTYMRSSSLRKAALRALSKTLTADELYYLREQFALLEPSKRGSISLENVXRALMKYATDAMKESRILDXLSSLNSLQYRRMDFEEFCAAALSVHQLEALDRWEQHARCAYELFDKDGNRAIVIEELVSELGLGPSIPVHVVLHDWIRHTDGKLSFLGFVKLLHGVSSPKPCKGSMKLKAKALWIC

SEQ ID NO: 2827 - protein, 245 aa, Glycine max
MAFLNKIGNLLKNSAVKHINQDFSASTPSLFQAIRSMSSAKLFVGGISYSTDDMSLRESFARYGEVIDVKVIMDRETGRSRGFGFVTFATSEDASSAIQGMDGQDLHGRRIRVNYATERSRPGFGGDGGYRGSGGSDGYNRGGNYGGGYNSGSDGYNRGGNYGSGNYNVTSSYSDGNAETSYTSGANAGNYQFNENSGGVFGSASGEFSSNQNDATGADNDEFIEPLEDNVRENNDEPTDYAQNR

SEQ ID NO: 2828 - protein, 245 aa, Glycine max
MAFLNKIGNLLKNSAVKHINQDFSASTPSLFQAIRSMSSAKLFVGGISYSTDDMSLRESFARYGEVIDVKVIMDRETGRSRGFGFVTFATSEDASSAIQGMDGQDLHGRRIRVNYATERSRPGFGGDGEYGSGGGGGYNGGGNYGSGGGYGSGSGYNRGGNYGSGGYNVTSSYSGGNAETSYTGGGNASNYQFNENSGGDFGSASGEFSSNQNDTAGADNDEFIEPLEDNVRENNDGPTDYAQNR

SEQ ID NO: 2829 - protein, 267 aa, Glycine max
MEGSVNERLDFGKMGYGCNHYRRRCRIRAPCCNEIYSCRHCHNDAASLLKNPFDRHELVRQDVKQVVCSVCDTEQPVAQVCTNCGVKMGEYFCNICKFFDDDVEKEQFHCDDCGICTVGGRYNCFHCKNCGSCYATALRSNHSYIDNSMQPHLPISYQYLFDSLKDVIVMKCGHTMHHECYLEMIKNDKYCCPICSKSVIDMSKTWKRIDEEIEATVMPEDYRNRKVWILCNDCNDTTEVYFHILGQKCGHCRSYNTRAVAPPVLPQ

SEQ ID NO: 2830 - protein, 256 aa, Glycine max
  unsure (1)..(256): unsure at all Xaa locations
MEGSVNERLDFGKMGYGCNHYRRRCRIRAPCCNEIYSCRHCHNDAASLLKNPFDRHELVRQXDVKQVVCSVCDTEQPVAQVCTNCGVKMGEYFCNICKFFDDDXEKEQFHCDDCGICRCGCXDTFFLRNNHLCVEKSMRHHCPICYEYLFDSLKDIVVMKCGHTMHNECYLEMIKSDKYCCPICSKSVMDMSRTWKRIDEEIEATVMPDDYRYRKVWILCNDXNDTTEVYFHFLGQKCGHCRSYNTRAIAPPVLPQ

SEQ ID NO: 2831 - protein, 546 aa, Glycine max
  unsure (1)..(546): unsure at all Xaa locations
GNSARGSVVSKLQTLSTSDHASVVSMNLFVALLCGCIVLGHLLEENRWMNESITALLIGVCTGIVILLFSGGKSSHILVFSEDLFFIYLLPPIIFNAGFQVKKKQFFVNFMTIMLFGAIGTLISCTIITLGATQIFKRLDVGPLELGDFLAIGAIFAATDSVCTLQVLNQDETPLLYSLVFGEGVVNDATSVVLFNAIQSFDLNQIDSSIAVHFLGNFLYLFIASTMLGVLTGLLSAYIIKKLYIGRHSTDREVALMMLMAYLSYMLAELCYLSGILTVFFCGIVMSHYTWHNVTESSRITTKHSFATLSFVAEIFIFLYVGMDALXACSIVLFDLFLFGRAAFVFPLSFLXLLGRAAFVFPLSFISNLAKKSPNEKISFRQQVIIWWAGLMRGAVSIALAYNQFTMSGHTSLRSNAIMITSTITVVLFSTVVFGLLTKPLIRLLLPHTPHHKESSITIITDPSTPSPKSVTIPLLGSAQESEVDIDGHDIHRPSSIRALLTTPTHTVHRLWRKFDDAFMRPVFGGRGFVPVEPGSPTERNGHQWR

SEQ ID NO: 2832 - protein, 546 aa, Glycine max
  unsure (1)..(546): unsure at all Xaa locations
GNSARGSVVSKLQTLSTSDHASVVSMNLFVALLCGCIVLGHLLEENRWMNESITALLIGVCTGVVILLFSGGKSSHILVFSEDLFFIYLLPPIIFNAGFQVKKKQFFVNFMTIMLFGAIGTLISCTIITLGATQIFKRLDVGPLELGDFLAIGAIFAATDSVCTLQVLNQDETPLLYSLVFGEGVVNDATSVVLFNAIQSFDLNQIDPSIAGHFLGNFLYLFIASTMLGVLTGLLSAYIIKKLYIGRHSTDREVALMMLMAYLSYMLAELSYLSGILTVFFCGIVMSHYTWHNVTESSRITTKHSFATLSFVAEIFIFLYVGMDALDIEKWKFVSDSPGTSVATSSVLLGLILLGRAAFVFPLSFISNLAKKSPNEKISFRQQVIIWWAGLMRGAVSIALAYNQFTMSGHTSLRSNAIMITSTITXVLFSTVVFGLLTKPLIRLLLPHTPHHKESSISITTDPSTPSPKSVTIPLLGSAQESEVDIDGHDIHRPSSIRALLTTPTHTVHRLWRKFDDAFMRPVFGGRGFVPVEPGSPTERNGHQWR

SEQ ID NO: 2833 - protein, 476 aa, Glycine max
  unsure (1)..(476): unsure at all Xaa locations
MATATLSPADADKLSNLKSSVAALSQISENEKNGFTSLVARYLSGEAQHVEWSKIETPTDEVVVPYDSLAPTPDGSXRVKNLLDKLVVLKLNGGLGTXTMGCTGPKSVIEVRDGLTFLDLIVVQIENLNSKYGSNVPLLLMNSFNTHDDTQKIVEKYKNSNIEIHTFNQSQYPRLVVDDFLPFPSKGQTGRDGXYPPGHGDVFPSLVNSGKLDVLLSQGKEYVFVANSDNLGAVVDLKILNHLIEHKNEYCMEVTPKTLADVKGGTLISYEGRVQLLEIAQVPDEHVSEFKSIEKFKIFNTNNLWVNLKAIKRLVEADALKMEIIPNPKEVDGVKVLQLETAAGAAIRFFDKAIGINVHRSRFLPVKATSDLLLVQSDLYTLQDGLVIRNQARANPENPSIELGPEFKKVSNFLSRFKSIPSIVELDSLKVAGDVWFGAGVILKGKASILAKPGVKLEIPDGAVIADKEINGPEDL

SEQ ID NO: 2834 - protein, 144 aa, Glycine max
  unsure (1)..(144): unsure at all Xaa locations
YGIQCRTTHQHILVSLCYFDSPVGESKKSGEVYRLXDVGGQRNERRKWIHLFEGVSAVIFCAAISEYDQTLFEDENRNRMTETKELFEWILKQPCFEKTSFMLFLNKFDIFEKKILKVPLNVCEWFKDYQPVSTGKQEIEHAYE

SEQ ID NO: 2835 - protein, 392 aa, Glycine max
MLSFVTENMGLLCSRNRRYNDADAEESAQTAEIERRIELETKAEKHIQKLLLLGAGESGKSTIFKQIKLLFQTGFDEAELKSYLPVIHANVYQTIKLLHDGSKEFAQNDVDSSKYVISNENKEIGEKLLEIGGRLDYPYLSKELARLLENLWKDPAIQETYARGSELQIPDCTDYFMENLQRLSDTNYVPTKEDVLYARVRTSGVVEIQFSPVGESKKSGEVYRLFDVGGQRNERRKWIHLFEGVSAVIFCAAISEYDQTLFEDENRNRMTETKELFEWILKQPCFEKTSFMLFLNKFDIFEKKILKVPLNVCEWFKDYQPVSTGKQEIEHAYEFVKKKFEESYFQSTAPDRVDRVFKIYRTTALDQKVVKKTFKLVDETLRRRNLLEAGLL

SEQ ID NO: 2836 - protein, 590 aa, Glycine max
MVPKPILVTTPPPATSAPSPLLNAVSPLKTEEKPQTQTLKTPTTTTQKAITKPSPSSSTTKTTPQQRVELKRKTNSWVPALMLNAFDDIINNFIDPPLKPSIDPRHVLSQNFAPVHELPPTECEVIEGSLPPSLDGAYIRNGPNPQFLPRGPYHLFDGDGMLHALRISHGKKPTLCSRYVKTYKYTMENDAGFPLIPNVFSGFNSLVASAARGSLSAARFLTGQFNPANGIGLANTSLAFFGNRLFALGESDLPYVVNVTPDGDIETLGRHDFDGKLTFSMTAHPKIDPDTAECFAFRYGPVPPFLTYFRFDGNGKKHEDVPIFSMLTPSFLHDFAITKKYAIFCDIQLGLNPLDMISGGSPVGSVASKVPRIGILPRDAKDESMMKWFEVPGFNIIHAINAWEEDEGRTVVLVAPNILSMEHALERMELVHAMVEKVRIELDTGIITRQPVSARNLDFAVINPAFVGKKNRFVYAAVGDPMPKISGVVKLDVSKGEERRDCTVGCRMYGEGCYGGEPFFVAREEGGEEDDGYLVSYVHDERKGESRFLVMDAKSPELDVVAAVRLPRRVPYGFHGLFVKESELRKVSLS

SEQ ID NO: 2837 - protein, 257 aa, Glycine max
  unsure (1)..(257): unsure at all Xaa locations
PTRPPTRPPTRPEEGDGSNFRISGPPKFFAGGESESSSSIGILPRDAKDESMMKWFEVPGFNIIHAINAWEEDEGRTVVLVAPNILSMEHALERMELVHAMVEKVRIELDTGIITRQPVSARNLDFAVINPAFVGKKNRFVYAAVGDPMPKISGVLERGRPRPVARRDCTVGCRMYGEGCYGGEPFFGAREEGGEEDDXYLVSYVHDERKAESRLLVMDAKSPELDVEAEARLPRRVPYGHHGLQRKDSELRKVTLS

SEQ ID NO: 2838 - protein, 277 aa, Glycine max
MALTLQRALSELLTLIAILSIFLVIPSFCFNPKKLYNASYYSPSSSDWSPAVATWYGPANGDGSEGGACGYGNAVGQPPFSSLISAGSPLIYDSGKGCGSCYEVKCTGNSACSGNPVKVVITDECAGCGSDAQYHFDLSGNAFGAMAISGQDENLRNAGKINIQHRRIECNYPGRSIAFHVDSGSNQEYFATLVEYEDGDGDLAKVELKEALDSGSWDSMQQSWGAVWKFDKGSPLRAPFSIKLTTLESGQTIVANNVIPAGWTPGQTYRSIVNFAT

SEQ ID NO: 2839 - protein, 306 aa, Glycine max; identical to SEQ ID NO: 934

SEQ ID NO: 2840 - protein, 248 aa, Glycine max
MGRGRVELKRIENKINRQVTFAKRRNGLLKKAYELSVLCDAEVALIIFSTRGKLYEFCSTNSMLKTLERYQKCSYGAVEVSKPGKELESSYREYLKLKARFESLQRTQRNLLGEDLGPLNTKDLEQLERQLDSSLKQVRSTKTQFMLDQLADLQNKEHMLVEANRSLTMKLEEINSRNQYRQTWEAGEQSMSYGTQNAHSQGFFQPLECNPTLQIGSDYRYNPEASEQQLAATTQAQQVNGFIPGWML

SEQ ID NO: 2841 - protein, 249 aa, Glycine max
MGRGRVELKRIENKINRQVTFAKRRNGLLKKAYELSVLCDAEVALIIFSTRGKLYEFCSTNSMLKTLERYQKCSYGAVEVSKPGKELEQSSYREYLKLKARFESLQRTQRNLLGEDLGPLNTKDLEQLERQLDSSLKQVRSTKTQFMLDQLADLQNKEHMLVEANRSLTMKLEEINSRNQYRQTWEAGEQSMSYGTQNAHSQGFFQPLECNPTLQIGSDYRYNPEASEQQLAATTQAQQVNGFIPGWML

SEQ ID NO: 2842 - protein, 254 aa, Glycine max; identical to SEQ ID NO: 2605

SEQ ID NO: 2843 - protein, 739 aa, Glycine max
MESCNCIDPQVPADDLLMKYQYISDFFIALAYFSIPLELIYFVKKSAVFPYRWVLVQFGAFIVLCGATHLINLWTFRIHSRTVAVVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVINQVFSSNRAVKISPNCPVARLRPYAGKYMPGAVVAVRVPLLHLSNFQIYDWPEVSTRSYALMVLMLPSDSARQWHVHELELVEVVADQVAVALSHAAILEESMRARDQLIEQNVALDLARREAETAIRARNDFLAVMNHEMRTPMHAVIALSSLLQETDLTAEQRLMVETILKSSNLLATLINDVLDLSRLEDGSLQLEAATFNLHSLFREVLNLIKPVASVKKLSLTSHVASDLPMYAIGDEKRLMQTILNVVGNAVKFSKEGCISITAFVAKPESFRDARIPDFLPVPSDNHFYLRVQVKDSGSGINPQDIPKLFTKFAQNQSLTRNPAGSGLGLAICRRFVNLMEGHIWVESEGIGKGCTVTFIVKLGIPDRSNEFKLPFVPKVPGNHGSTNFAGLKVLVMDDNGVSRTVTKGLLMHLGCDVTTASSSEECLRVVSLEHEVVFMDVCTGLDGYELAVRIHEKFTKHQDRPLIVALTGNTKKVTKENCMRVGMDGLILKPVSVDKMRGVLSELLERRVLFESV

SEQ ID NO: 2844 - protein, 511 aa, Glycine max
MEAPSPTKPNDPTKPSNTSTTLSLEAGPAQASPLRKMFAVASIAAGIQFGWALQLSLLTPYVQLLGVPHAAASFIWLCGPISGLVVQPIVGYYSDHCTSRFGRRRPFILGGALAVAVAVFLIGYAADIGYAAGDDISKTTRPRAVGVFVIGFWILDVANNMLQGPCRAFLADLAAGDQRKTRIANGFFSFFMAVGNVLGYAAGSYKGLHKMFPFTETKACDVFCANLKSCFFFSILLLLFLATVALLYVKDKQVEARALDDATQPSCFFQLFGALKELKRPMWMLMLVTAVNWVGWFPYFLFDTDWMGREVYGGQVGEDAYANGVRVGSLGLMVNAVVLGFMSLAVEPLGKMVGGVKRLWAIVNFILAIGFGMTVVITKVAEHQRKMNPAAVGHPSEGVVVGSMVFFGVLGVPLAITFSVPFALASIYCSASGAGQGLSLGVLNLAIVVPQMVVSTLSGPWDALFGGGNLPAFMVGAAAAALSAIMAIVLLPTPKPADEAKASSMMAGGFH

SEQ ID NO: 2845 - protein, 673 aa, Glycine max
  unsure (1)..(673): unsure at all Xaa locations
ICALADRCDQKGLSVNERLGRIAETLEKMMESCTQKDTQQMVGSPDVAKVSNSSMTEESDVPSPKLSDWSRRGSEDMLDCFPEADNSVFMDDLKGLPLMSCKTRFGPKSDQGMTTSSAGSMTPRSPLMTPRTSQIDLLLAGKGAYSEHDDLPQMNELADIARCVANAPLDDDRTTSYLLSCLDDLRVVVDRRKFDALTVETFGTRIEKLIREKYLQLTEMVDVEKIDTESTVDDDLLEDDVVRSLRTSPIHSSRDRTSIDDFEIIKPISRGAFGRVFLAKKRTTGDLFAIKVLKKADMIRKNAVESILAERDILITVRXPFVVRFFYSFTCRENLYLVMEYLNGGDLYSLLRNLGCLDEEVARVYIAEVVLALEYLHSLHVVHRDLKPDNLLIAHDGHIKLTDFGLSKVGLINSTDDLSGPAVNGTSLLEEDETDVFTSEDQRERRKKRSAVGTPDYLAPEILLGTGHGFTADWWSVGVILFELLVGIPPFNAEHPQTIFDNILNRKIPWPAVPEEMSPQAQDLIDRLLTEDPNQRLGSKGASEVKQHVFFKDINWDTLARQKAAFVPASESALDTSYFTSRYSWNTSDGLVYPASDDEDSSDADSLSGSSSCLSNRQDEVGDECWGLTEFDSGTSVNYSFSNFSFKNLSQLASINYDLTKGWKDDPPTNSSA

SEQ ID NO: 2846 - protein, 680 aa, Glycine max
  unsure (1)..(680): unsure at all Xaa locations
ICALADRCDQKGLSVNERLGRMAETLEKMMESCTQKDTQQMAGSPDVAKVSNSSMTEESDVPSPKLSDWSRLPCLXWDRGSEDMLDCFPEADNSVFMDDLKGLPLMSCKTRFGPKSDQGMTTSSAGSMTPRSPLMTPRTSQIDLLLAGKGAYSEHDDLPQMNELADIARCVANAPLDDDRTTSYLLSCLDDLRVVVDRRKFDALTVETFGTRIEKLIREKYLQLTEMVDVEKIDTESTVDDDILEDDVVRSLRTSPIHSSRDRTSIDDFEIIKPISRGAFGRVFLAKKRTTGDLFAIKVLKKADMIRKNAVESILAERDILITVRNPFVVRFFYSFTCRENLYLVMEYLNGGDLYSLLRNLGCLDEEVARVYIAEVVLALEYLHSLRVVHRDLKPDNLLIAHDGHIKLTDFGLSKVGLINSTDDLSGPAVNGTSLLEEDETDVFTSADQRERREKRSAVGTPDYLAPEILLGTGHGFTADWWSVGVILFELLVGIPPFNAEHPQIIFDNILNRKIPWPAVPEEMSPEALDLIDRLLTEDPNQRLGSKGASEVKQHVFFKDINWDTLARQKAAFVPASESALDTSYFTSRYSWNTSDGFVYPASDVEDSSDADSLSGSSSCLSNRQDEVGDECGGLTEFDSGTSVNYSFSNFSFKNLSQLASINYDLTKGWKDDPATNSSA

SEQ ID NO: 2847 - protein, 344 aa, Glycine max
  unsure (1)..(344): unsure at all Xaa locations
QYLEDRLCIQFQLLCCRCQRSSQCPMCWQPISLKDPTSQELLEAVERERNFRFNPSRNATIFHHPTLGDFELQHLPVGASDADLEERIIQHLAAAAAMGRARHIARREGQRNRSSAQGRPHFLVFSTNPNSPPMAPASSSPSQRGDDEPIPTIAVANLSPTPATGEESSQLTLVPPIQAEQVSASGSGSTALATDHQGSSYNNRRSPNQSSPSSQDRAGXSELQSFSESLKSKLNAVSTRYKESISKSTRGWKERWFSRNNTMSDLGSEVRREVNAGIATVSRMMERLETSDNNRSNSNSAPSNIEDGSVQEYNGQTLTPGNEGDGLLRDNNTKASCAAGSSSN

SEQ ID NO: 2848 - protein, 380 aa, Glycine max
  unsure (1)..(380): unsure at all Xaa locations
MEVPEMEGKTESHMTSAAAFVEGGVQEACDDACSICLEDFCKSDPATVTNCKHEFHLQCILEWCQRSSQCPMCWXQPISLRDTTSQELLEAVELERSLRDTPSRNAAIFHHPXFDFELQHLPMGVNEADIEERIIQHLTAAAAMRRSXHLSRREGHRTRPSAHGRPHFLVYSTQPSAPPSAAGGGSEPAAIPVGSPSTPLTFDGNEQSSLQQIPHVQTQSSSLTSASTVSTTNLQGVHSDDRSFASHSFPASQDRAQPSEQSFSDSLRSRFNAVSMRYKDSISKGTRGWKERLFSPNSSMSELGSEVRRELNAKIASVSRLMERLETRENNSAAGTSLSNHLVNRSIAETSNQSNVEARGENSLHGNNTPTTFSASSDSK

SEQ ID NO: 2849 - protein, 364 aa, Glycine max
SSLHWVQEACDDACSICLEDFCKSDPATVTNCKHEFHLQCILEWCQRSSQCPMCWQPISLRDTTSQELLEAVELERSLRDTPSRNAAIFHHPALGDFELQHLPMAMNEADIEERIIQHLTAAAAMRRSHHLGQREGHRTRSSAHGRPHFLVYSTQPSAPPFAAGGESEPAAIPVGIPSTPLTFDGNEQSSPQQIPYFQTRGSSLTSGSTVATTNLQGVHSNDRRFASHSFPASQDRAQPSEQSFSDSLRSRFNAVSTRYKESISKGTRGWKERLFSPNSSMSELGSEVKRELNAKIASVSRLMERLETTRENNRAAGTSLSNPNHLVNCSIAETSNQNNVEARGENSLRDNSTPTTFSASSDSK

SEQ ID NO: 2850 - protein, 192 aa, Glycine max
MESTVTFETDLNLKATELRLGLPGTEEIVEKPLPASARITNKRPLSETSEECASKGSSAPHVETEAAPPAKAKIVGWPPIRSYRKNSLQENDGAGIYVKVSMDGAPYLRKIDLKVYGGYTQLLKALENMFKLTIGEYSEKEGYKGSDYAPTYEDKDGDWMLVGDVPWDMFVTSCKRLRIMKGSEARGLGCAV

SEQ ID NO: 2851 - protein, 371 aa, Glycine max
MGKKKKRVSSKVWCYYCDREFDDEKILVQHQKAKHFKCHVCHKKLSTAGGMAIHVLQVHKESVTKVPNAKPGRESTDIEIYGMQGIPPDILAAHYGEEEDDVPSKAAKVDIPPTQLVGGMIPPPLGTGYPPRPTLPTMPPMYNPAVPVPPNAWMVPPRPQPWFSQPPAVSVPPAAPYTQQPLFPVQNVRPPLPATAPALQTQITPPGLPTSAPVPVSQPLFPVVGNNHTTTQSSTFSAPPLPSSVPSVTPVMSTNVPVDTHLSSNSSVTSSYQAIGVPGGAASNSHSYASGPNTGGPSIGPPPVIANKAPAPQPATNEVYLVWDDEAMSMEERRMSLPKYQVHDESSQMSSIDAAIDKRILESRLAGRMAF

SEQ ID NO: 2852 - protein, 371 aa, Glycine max
MGKKKKRVSSKVWCYYCDREFDDEKILVQHQKAKHFKCHVCHKKLSTAGGMAIHVLQVHKESVTKVPNAKPGRESTDIEIYGMQGIPPDILAAHYGEEEDDVPSKAAKVDIPPTQLVGGMIPPPLGTGYPSRPALPTMPPVYNPAVPVPPNAWVVPPRPQPWFSQPPVVSVPPAAPYTQQPLFPVQNVRPPLPATAPALQTQITPPGLPTSAPVPVSQPLFPVVGNNHTTTQSSAFSAPPLPSSVPSVTPVMSTNVPVDTHLSSNSSVTSSYQAIGVPGGAASNSHSYASGPNTGGPSIGPPPVIANKAPAPQPATNEVYLVWDDEAMSMEERRMSLPKYQVHDESSQMSSIDAAIDKRILESRLAGRMAF

SEQ ID NO: 2853 - protein, 549 aa, Glycine max
MRPCKCKCNVLSALILLVTFLFIASSVHCEDPYRYLTWKVTYGDIYPLGVKQQGILINGQFPGPQIDAVTNDNLIINVYNYLREPFLISWNGLQHRRNSWQDGVYGTNCPIPPGRNLTYAIQVKDQIGSYFYFPSLGMHKAAGAFGGIRIWSRPQIPVPFPSPAGDITILAGDWFKLDHRRLRRLLENGHNLPFPDGLLINGRGWNGNTFTVDQGKTYRFRISNVGLTTSINFRIQGHSLKLVEVEGSHTLQNTYSSLDVHLGQSYSVLVTADQPVKDYYMVVSTRFTRRILTTTSVLHYSYSKTGVSGPVPPGPTLDIASSVYQARTIRWNLTASGPRPNPQGSYHYGLIKPSRTIMLANSAPYINGKQRYAVNGVSYNEPDTPLKLADYFNIPGVFYVGSIPTYPNGGNNAYLQTSVMGANFHELVEIVFQNWEDSVQSWHIDGYSFFVVGYGSGQWTADSRVQYNLRDTVARCTTQVYPRSWTAIYMALDNVGMWNIRSENWGRQYLGQQLYLRVYTPSKSWRDEYPVPKNALLCGRASGRRTRPF

SEQ ID NO: 2854 - protein, 549 aa, Glycine max
MRPCKCKCNVLSALILLVTFLFIASSVHCEDPYRYLTWKVTYGDIYPLGVKQQGILINGQFPGPQIDAVTNDNLIINVYNYLREPFLISWNGLQHRRNSWQDGVYGTNCPIPPGRNLTYAIQVKDQIGSYFYFPSLGMHKAAGAFGGIRIWSRPQIPVPFPSPAGDFTILAGDWFKLDHRRLRRLLENGHNLPFPDGLLINGRGWNGNTFTVDQGKTYRFRISNVGLTTSINFRIQGHSLKLVEVEGSHTLQNTYSSLDVHLGQSYSVLVTADQPVKDYYMVVSTRFTRRILTTTSVLHYSYSKTGVSGPVPPGPTLDIASSVYQARTIRWNLTASGPRPNPQGSYHYGLIKPSRTIMLANSAPYINGKQRYAVNGVSYNEPDTPLKLADYFNIPGVFYVGSIPTYPNGGNNAYLQTSVMGANFHEFVEIVFQNWEDSVQSWHIDGYSFFVVGFGSGQWTADSRVHYNLRDTVARCTTQVYPRSWTAIYMSLDNVGMWNIRSENWGRQYLGQQLYLRVYTPSKSWRDEYPVPKNALLCGRASGRRTRPF

SEQ ID NO: 2855 - protein, 374 aa, Glycine max
  unsure (1)..(374): unsure at all Xaa locations
MGTSANAVAGGRGGAPVPKDVDYANYFCTYAFLYHQKEMLSDRVRMDAYFDAIFQNKRHFAGKTVLDVGTGSGILAIWSAQAGARKVYAVEATKMSEHARALVKANNLQDVVEVIEGSMEEITLPEKVDVIISEWMGYFLLRESMFDSVINARDRWLKPTGVMYPSHARMWMAPIRTGIVDHKLGDYESTMDDWHHFVDETKTYYGVDMSTLTRPFSEEQRKYYLQTSLWNNLHPHQVVGTAGIIKEIDCLTAXVADIEKVRSDFSMSITVDNTKLCGFGGWFDVHFRGRSEDPAEQEIELTTAPSVNYGTHWGQQVFLLHPPMHLSEGDDLRVSFLMSRSKENHRLMEVELGCEIHQHSGKLLAPFKNKYYIE

SEQ ID NO: 2856 - protein, 744 aa, Glycine max
MSMSERKTIDLDQGWDFMQKGILKLKNILEGLPEPQFSSEDYMMLYTTIYNMCTQKPPHDYSQQLYDKYRESFEEYIVSTVLPSLREKHDEFMLRELVKRWANHKIMVRWLSRFFHYLDRYFIARRSLPPLNEVGLTCFRDLVYKELNGKVRDAVISLIDQEREGEQIDRALLKNVLDIFVEIGMGQMDHYENDFEAAMLKDTSAYYSRKASNWILEDSCPDYMLKAEECLKREKDRVAHYLHSSSEPKLLEKVQHELLSVYANQLLEKEHSGCHALLRDDKVEDLSRMFRLFSKIPRGLDPVSSIFKQHVTAEGMALVKLAEDAVSTKKAEKKDIVGLQEQVFVRKVIELHDKYLAYVNDCFQNHTLFHKALKEAFEIFCNKGVAGSSSAELLATFCDNILKKGGSEKLSDEAIEETLEKVVKLLAYISDKDLFAEFYRKKLARRLLFDKSANDDHERSILTKLKQQCGGQFTSKMEGMVTDLTLAKENQTSFEEYLTNNPNADPGIDLTVTVLTTGFWPSYKSFDLNLPAEMVRCVEVFKEFYQTKTKHRKLTWIYSLGTCNISGKFDPKTVELIVTTYQASALLLFNSSDRLSYSEIMTQLNLSDDDVIRLLHSLSCAKYKILNKEPNTKTISSTDYFEFNSKFTDKMRRIKIPLPPVDEKKKVIEDVDKDRRYAIDASIVRIMKSRKVLSYQQLVMECVEQLGRMFKPDVKAIKKRIEDLISRDYLERDKDNANLFRYLA

SEQ ID NO: 2857 - protein, 353 aa, Glycine max
MSMSERKTIDLEQGWDFMLKGITKLKNILEGLPEPQFSSEDYMMLYTTIYNMCTQKPPHDYSQQLYDKYKESFEEYIVSTVLPSLREKHDEFMLRELVKRWANHKIMVRWLSRFFHYLDRYFIARRSLPPLNEVGLTCFRDLIYKELNGKVRDAVISLIDQEREGEQIDRALLKNVLDIFVEIGMGQMDHYENDFEAAMLKDTSSYYSRKASNWILEDSCPDYMLKAEECLKREKDRVAHYLHSSSEPKLLEKVQHELLSVYANQLLEKEHSGCHALLRDDKVEDLSRMFRLFSKIPRGLDPVSNIFKQHVTTEGMALVKQAEDAASNKKAEKKEIVGLQEQVFVRKVIELHD

SEQ ID NO: 2858 - protein, 185 aa, Glycine max
MDAYSSGEEVVVKTRKPYTITKQRERWTEEEHNRFLEALKLHGRAWQRIEEHIGTKTAVHIRSHAQKFFTKLEKEALCKGVPIGKALDLDIPPPRPKRKPNNPYPRKTRIGTTSLHSGAKDGKLNLVESSHVNQALDLKKEPLPEKHDLDEGLTTVKENKDENHAKVFTLLQEVPCSSVSSANES

SEQ ID NO: 2859 - protein, 749 aa, Glycine max
MDAYSSGEEVVVKTRKPYTITKQRERWTEEEHNRFLEALKLHGRAWQRIEEHIGTKTAVQIRSHAQKFFTKLEKEALVKGVPIGQALDIDIPPPRPKRKPNNPYPRKTRIGTTSLHSGAKDGKLNLVESSHVNQALDLKKEPLPEKHDLDEGLTTVKENKDENHAKVFTLLQEVPCSSVSSANESSITMSVPLGNPCAFKEITPSVKEVIARDEKTESFVTVEPENGKLEINDGKQTNGTSKDSRLEDSDALHMKLVQNEKPDGLDCELTIDGMQGNQNYPRHVTVHVVDGNLGTNTQNPSQDMLFRDSMFQPIGGVNGQRNVFTNTAPSNTSESQNNTARSSVHQSFLPYPPFTQHNQDDYQSFLHMSSTFSNLIVSTLMQNPAAHAAASFAATFWPYANPETSANSPRCSQGGFTNRQIGSPPCVAAIAAATVAAATAWWAAHGLLPLCAPLHTSFACPASVTTVPSMNTGEAPALKAEQEKTTLQNPPLQDQMLDPEYSEAQQAQHSASKSPAAILSDSESGDAKLNTSSKVTDHETNKTISEHLDSNKTKGRKPVDRSSCGSNTASSSDVETDALEKGEKGKEEPEIPDANQLAIEFSNRRRSVSNLTDSWKEVSEEGRLAFQALFSREVLPQSFSPPHALKNTDHQMDNANDNKQNIDDKDEDLDGKKCSSNYEAMQKNLLFVENNEGLLTIGLGQGKLKTHRTGFKPYKRCSMEAKENRVGASSNQGEEQGCKRIRLEGETST

SEQ ID NO: 2860 - protein, 236 aa, Glycine max
  unsure (1)..(236): unsure at all Xaa locations
SVTSVMEAEPDKYKMINFEETELRLGLPLSGNETTLKNTCSTGKRVFSDTSVDLKLNLSSTSNNAPPPXAKPPAKAQVVGWPPXRSFRKNIVNNVQRSNNNDGEKAATSSSNNVNMGAAFVKVSMDGAPYLRKVDLKMYKSHQELLDALAKMCSSFTIDKCSSQGMTDFMNEGKLIDLLNGSDYVPTCEDKDGDWMLVGDVPWEILVESCKRLRIMKGSAAIGLAPRAVQKCKNRS

SEQ ID NO: 2861 - protein, 263 aa, Glycine max
TQLIKHTRTITYLYLNITSLMEAERDKYKMINFEETELRLGLPLSGNETLKTTCSTGKRVFSDTAVDLKLNLSSTSNSASSDLTKEKNITAAAPPANDPAKPPAKAQVVGWPPVRSFRKNIVQRSNNNEGEKAATSSSNNVNTGAAFVKVSMDGAPYLRKVDLKLYKSYQELLDALAKMFSSFTIDKCGSQGMKDFMNESKLIDLLNGSDYVPTYEDKDADWMLVGDVPWEMFVESCKRLRIMKGSEAIGLAPRAVEKCKNRS

SEQ ID NO: 2862 - protein, 103 aa, Glycine max; identical to SEQ ID NO: 683

SEQ ID NO: 2863 - protein, 103 aa, Glycine max; identical to SEQ ID NO: 683

SEQ ID NO: 2864 - protein, 378 aa, Glycine max
MSLRKVFRSRKFSKSFKEVLPAEGAAVEGGVAGTVEEAANGNNNGWSSMLPEILGEIVRRVDAAEEQWPNRQNVVACACVCKRWRDITREVVRVPSHTGKITFPSCLKQPGPRDVPHQCLIKRNQKTSTFYLYLALTPSFTDKGKFLLAARRYRCGTHTEYIISLDADDLSQGSNAYVGKLSSDFLGTNFTIYDSQPPHSGAKPSSGRASRRFASKQISPQVPAGNFEVGQVSYKFNLLKSRGPRRMVCSLKCPVTPVSPTSGSSDSTPVNGHKMHDKEQAASGYTILKNKAPRWHEHLQCWCLNFHGRVTVASVKNFQLVATVDQSQPGGKGDEETVLLQFGKVGDDTFTMDYRQPLSAFQAFAICLTSFGTKLACE

SEQ ID NO: 2865 - protein, 304 aa, Glycine max
MCGGAIIADFIPRRGGRRLTASELWPNSFGKDGDFDFDYSHIADQQRSTLKMSPPPKASEQVENKPVKRQRKNLYRGIRQRPWGKWAAEIRDPRKGVRVWLGTFNTAEEAARAYDREARKIRGKKAKVNFPNEDDEYSIQARHPIPPLPFTPQTQNPPLYQQQYRCDLNIAPKNLNFEFGYDLNHAGAFPSHVDAVNADSVVVSGDENSGLASGSEGAYSTTEFMGSSQNGNGYLGVTAMEKNEKETEVIEAQEEKNKVQELSEELMAYENYMKFYRIPYYDGQSTAPPNNVQESLVGDLWSFD

SEQ ID NO: 2866 - protein, 565 aa, Glycine max
MIATETIVPSTKLKIKFSTKRMEVESGPKYEFGQKVSHTDENRSFNLNGKSSALNSNKRGPPTSIEGQKEKRQRIDRKGSMQCATILKSLMSHTYSWVFSKPVDPIALSIPDYFTIISHPMDLGTIKSKLEKNIYSGTEEFAADVRLTFSNAMKYNPPSNDVHLMAKELSKIFDRKWKDLGRKWKCEDEHDKSESETIKETGRKSLDMLSRHRDSLPKKTQVSEHKGMPKIRSLATKDARVEPSKLSQIPCKLIEKDMHKGNKGNHDVEQPAGSLKACSSVCFVTSKCRICGDTTCHCVIPSNSIQVSSDISSEGSEGGDVITRGADSLRQNCPTKCTSPIEKKSDPDSDGAVSSLDSEHVCPSSQHVTPTTDASSGEVWSTPVLPVQLSPKKALRAAMLKSRFADTILKAQQKTLLDHGDKGNPQKMQQEKERLERIQREERARIEAQIKIAEAAARMRAEEESRQRREKEREAARAAIEKMKRTVDIEHNVEIIKELESLSGCTLSYKAVGCRNGYKVALETLDKPQFENPLERLGLFIKEDFTADEDEEVLNGGFEEGEIFN

SEQ ID NO: 2867 - protein, 324 aa, Glycine max
MHKGNKGNHDVEQPAGSLKACSSVCFVTSKCRICGDTTCHCVIPSNSIQVSSDISSEGSEGGDVITRGADSLRQNCPTKCTSPIEKKSDPDSDGAVSSLDSEHVCPSSQHVTPTTDASSGEVWSTPVLPVQLSPKKALRAAMLKSRFADTILKAQQKTLLDHGDKGNPQKMQQEKERLERIQREERARIEAQIKIAEAAARMRAEEESRQRREKEREAARAAIEKMKRTVDIEHNVEIIKELESLSGCTLSYKAVGCRNGYKVALETLDKPQFENPLERLGLFIKEDFTADEDEEVLNGGFEEGEIFNCMKVYSVLPALTVYIL

SEQ ID NO: 2868 - protein, 486 aa, Glycine max
  unsure (1)..(486): unsure at all Xaa locations
MIATETIVPSTKLKIKFSTKRMEVESGPKYEFGQKVSHTDENRSFNLNGKSSALNSNKRGPPTSIEGQKEKRQRIDRKGSMQCATILKSLMSHTYSWVFSKPVDPIALSIPDYFTIISHPMDLGTIKSKLEKNIYSGTEEFAADVRLTFSNAMKYNPPSNDVHLMAKELSKIFDRKWKDLGRKWKCEDEHDKSESETIKETGRKSLDMLSRHRDSLPKKTQVSEHKGMHKIRSLATKDARVETPKLSQIPCKLIEKDLHKGSKGNHDVEQPAGSLKSYFSVRFVTSKCRICGNIICHCENPSNSTQVSSDISSEGSEGRDLIARGADSLRQDCRTKCTSPMEKKSDLDSDGAVSSLDSEHVCPSSQHVTPTTDASSGEVWSMPVLPVQLSPKKALRAAILKSRFADTILKAQQKTLLDHGDKGNPQKMQQEKERLERIQREERARIEAQIXTAEAAARMRAEEESRQRREKEREAARAARKDEKNR

SEQ ID NO: 2869 - protein, 211 aa, Glycine max
FAIVQVIYQEIDNSMGKYEKELNLEATELRLGLPGSDEPGKRSIVRSNKRSSTEASEEECISKGNMNSNGSDITSDDQDNLVPPAKAQVVGWPPVRSYRKNTLQQKKEEQGEGSGMYVKVSMAGAPYLRKIDLNVYKSYPELLKALGNMFKCTFGEYSEREGYNGSEYAPTYEDKDGDWMLVGDVPWNMFVSSCKRLRIMKASEAKGLGCF

SEQ ID NO: 2870 - protein, 1060 aa, Glycine max
  unsure (1)..(1060): unsure at all Xaa locations
MAGNDWLNSYLEAILDVGPGLDDAKSSLLLRERGRFSPTRYFVQEVIGFDETDLYRSWVRASSTRSPQERNTRLENMCWRIWNLARQKKQLESETALRVNKRRLERERGRREATADMSEDLSEGEKGDPLSDLSAHGGVGDFNRSRLPRISSADAMETWANSQKGKKLYIVLISIHGLIRGENMELGRDSDTGGQVKYVVELARALGSMPGVYRVDLLTRQVSAPDVDWSYGEPTEMLSPRDTDDFGDDTGESSGSYIVRIPFGPRDKYIPKELLWPYIPEFVDGALNHIIQMSKSLGEQIGSGHAVWXPVAIHGHYADAGDSAALLSGALNVPMLFTGHSLGRDKLEQLLKQGRLSKDEINTTYKIMRRIEAEELALDGSEIVITSTRQEIEEQWRLYDGFDPVLERKLRARIRRNVSCYGRFMPRMATIPPGMEFHHIVPHDGDIEGEPEGNLDHPAPQDPPIWSEIMRFFTNPRKPMILALARPDPKKNITTLVKAFGECRPLQELANLTLIMGNRDGIDEMSSTNASVLLSVLKLIDKYDLYGQVAYPKHHKQYDVPDIYRLAAKTKGVFINPAFIEPFGLTLIEAAAHGLPIVATKNGGPVDIHRVLDNGLLVDPHDQQSIADALLKLVSNKQLWAKCRQNGLKNIHLFSWPEHCKTYLSKIATCKPRHPQWQRSEDGGESSESDSPGDSLRDLQDLSLNLKFSLDGEKSEGSGNDNSLNSDGNAADRGAKLENAVLSWSKGISKDTRRGGATEKSDQNPNAGKFPPLRRRKHLFVIAVDCDTTSSLLETIKAIFESAGKDRAESTVGFILSTSLTISEIQSFLISGGLSPIDFDAYICNSGSDLYYPSLNPGDRPFVVDLYYHSHIEYRWGGEGLRKTLVRWADSITDKKGDNDEQIVSPAEQLSTDYCYAFKVRKPGMAPPVKELRKLLRIQALRCHPIYCQNGTRLNVIPVLASRSQALRYLYVRWGFELSKMVVFVGECGDTDYEGLLGGLHKSAILKGVGSSAISQLHNNRSYPLSDVTPLDSPNIVEATEGSSGADIQALIEKVGYLNG

SEQ ID NO: 2871 - protein, 742 aa, Glycine max
FGSSSATLLSGALNVPMLFTGHSLGRDKLEQLLKQGRLSKDEINTTYKIMRRIEAEELALDGSEIVITSTKQEIEEQWRLYDGFDPVLERKLRARIRRNVSCYGRFMPRMATIPPGMEFHHIVPHDGDIEGEPEGNLDHPAPQDPPIWSEIMRFFTNPRKPMILALARPDPKKNITTLVKAFGECRPLRELANLTLIMGNRDGIDEMSSTNASVLLSVLKLIDKYDLYGQVAYPKHHKQYDVPDIYRLAAKTKGVFINPAFIEPFGLTLIEAAAHGLPIVATKNGGPVDIHRVLDNGLLIDPHDQQSIADALLKLVSNKQLWAKCRQNGLKNIHLFSWPEHCKTYLSKIATCKPRHPQWQRSEDGGESSESDSPGDSLRDLQDLSLNLKFSLDGEKSEGSGNDNSLNSDGNAADRGAKLENAVLSWSKGISKDIRKGGAIEKTDQNPNAGKFPPLRRRKHLFVIAVDCDTTSGLLETIKAIFESAGKDKAEGTVGFILSTSLTISEIQSFLISGGLSPIDFDAYICNSGSDLYYPSLNPGERPFVVDLYYHSHIEYRWGGEGLRKTLVRWADSTTDKKGDNDEQIVSPAEQLSTDYCYAFKVRKPGMAPPVKELRKLLRIQALRCHPIYCQNGTRLNVIPVLASRSQALRYLYVRWGFELSKMVVFVGECGDTDYEGLLGGLHRSVILKGVGSSAISQLHNNRSYPLSDVMPLDSPNIIEATEGTRGADIQALIEKVGYLTG

SEQ ID NO: 2872 - protein, 320 aa, Glycine max
MASIAGSNCVALRTANFGASGNRKIGQIRQWSPILTNLRPVSGLRHRSNTPFSSSGVRAQVATLEEAGTGATQKVESPVAVVTGASRGIGKAIALSLGKAGCKVLVNYARSSKEAEEVSKEIEEFGGQALTFGGDVSNEDDVESMIKTAVDAWGTVDVLINNAGITRDGLLMRMKKSQWQDVIDLNLTGVFLCTQAAAKIMMKKKKGRIVNIASVVGLVGNVGQANYSAAKAGVIGLTKTVAKEYASRNITVNAVAPGFIASDMTAKLGQDIEKKILETIPLGRYGQPEEVAGLVEFLALNQAASYITGQVFTIDGGMVM

SEQ ID NO: 2873 - protein, 485 aa, Glycine max
MNDAFQKSYWIEHTTDLSVESMMLDSNASDLDKEERPEVLSLLPPYEGKSVVELGAGIGRFTVELAKKAGQLLAVDFIESAIKKNESINGHHKNVKFMCADVTSPNLYISEGSVDLIFSNWLLMYLSDKEVENLAARMIKWLKVGGYVFFRESCFHQSGDSKRKYNPTHYREPRFYTKVFKECHISDDTRNSFELSLVGCKCIGAYVRNKKNQNQICWLWKKVRSQDDRGFQRFLDSVEYNHKDILLYESVFGQGFVSTGGLETTKEFVAKLGLKPGQKVLDVGCGTGGGDIYMAENFDVEVVGIDLSINVISLAIERAIGLKCSVEFECADCTKKTYPENTFDVIYSRDTLLHIKDKPPLFRSFYKWLKRGGTLIITDYCKSEGSPSLGYAEYIKKGGYHIHDMKTYCQMLENAGFDDVVAEDRTNLFMKTLQQELNALESKKDDFIDEFSEEDYNGITERWKAKQMRGADGEQIWGLFVAKKE

SEQ ID NO: 2874 - protein, 351 aa, Glycine max
MTMTWARFDSWKQQYYTTSGVVVGYAVCSSLLAIINKYAITKFNYPGLLTALQYLTSALGVYVFGKLGFLHHDPFTLPTAKKFFPAALVFYLAIFTNTNLLRHANVDTFIVFRSLTPLLVALADTVFRSQPCPSNLTFLSLLVILAGAFGYVATDSAFTLTAYSWAFAYLITITTEMVYIKHMVMSLGLNTWGFVFYNNLLSLMMAPFFSFVTGENVEIIAAVRSGGLFDPAAFYAVSLSCLFGLLISFFGFAARRAVSATAFTVTGVVNKFLTVAINVLIWDKHASPIGLVCLFFTIVGGILYQQSVTGLGSAPAQPKQLDTESNKGGGEDDDDGDLTGESDGLIKATSI

SEQ ID NO: 2875 - protein, 334 aa, Glycine max
MAVDLMTTGCSRNDNINSFTTKAEENAVQEAASGLESIEKLIRLLSQTQTQTRHQINNNSSNEIAIAMDCKVVADVAVSKFKKVISLLGRTRTGHARFRRAPLPNQNQHTQPPSEPPVFHATPLHQIPPPSLHQIPKTERNLNDSSSSKTIHFSYPSAATSFISSLTGDGAADNKQPSSSPPAAAATTTPFQITSLSHVSSAGKPPLSTSSFKRKCSSENLGSGKCGSSSSRCHCSKKSRKMRLKRVVRVPAISLKMADIPPDDYSWRKYGQKPIKGSPHPRGYYKCSSVRGCPARKHVERALDDPAMLVVTYEGEHNHTLSAADATNLILESS

SEQ ID NO: 2876 - protein, 332 aa, Glycine max
MAVDLMTTGYTRNDNISSFTTKAEENAVQEAASGLESVEKLIRLLSQTQAQAQAHHQFNNNNSSSNEIAIAMDCKAVADVAVSKFQKVISLLGRTRTGHARFRRAPLPNQHQHTQPPSEPPVLHATPLHQIPPPSLHQIPKTEKHLNDSSSKTLHFSYPSAVTSFVSSLTGDAADNKQPSPAATTTTSHFQITSLSHVSSAGKPPLSSSSFKRKCSSENLGSGKCGSSSSRCHCSKKRKMRLKRVVRVPAISLKMADIPPDDYSWRKYGQKPIKGSPHPRGYYKCSSVRGCPARKHVERALDDPAMLVVTYEGEHNHTVSAADATNLILESS

SEQ ID NO: 2877 - protein, 558 aa, Glycine max
MGNTCRGSLKGKYIQGFSQPEDHSKRSTTHSDPSSTKQQDDNDNNNNNNNNNNNNNNNNNNLPFNAKREAIMRRGLDNQAYYVLGHKTPNIRDLYTLGRKLGQGQFGTTYLCTENSTSIEYACKSISKRKLISKEDVEDVRREIQIMHHLAGHKNIVTIKGAYEDPLYVHIVMELCSGGELFDRIIQRGHYTERKAAELTKIIVGVVEACHSLGVMHRDLKPENFLLVNKDDDFSLKAIDFGLSVFFKPGQVFTDVVGSPYYVAPEVLLKHYGPEADVWTAGVILYILLSGVPPFWAETQQGIFDAVLKGHIDFDSDPWPLISDSGKDLIRKMLCSQPSERLTAHQVLCHPWICENGVAPDRSLDPAVLSRLKQFSAMNKLKKMALRVIAESLSEEEIAGLREMFQAMDTDNSGAITFDELKAGLRRYGSTLKDIEIRDLMEAADVDKSGTIDYGEFIAATFHLNKLEREEHLIAAFQYFDKDGSGYITVDELQQACAEHNMTDAFLEDIIREVDQDNDGRIDYGEFAAMMQKGNAGIGRRTMRNSLNLSMRDAPSAQ

SEQ ID NO: 2878 - protein, 559 aa, Glycine max
  unsure (1)..(559): unsure at all Xaa locations
MGNTCRGSLKGKYIQGLSQPEDHSKRSTTHSDPSSTKQQADNDNNNNNNNNNNNNNNNNNNLPFNAKRESIMRRGLDNQAYYVLGHKTPNIRDLYTLGRKLGQGQFGTTYLCTENSTSIEYACKSISKRKLISKEDVEDVRREIQIMHHLAGHKNIVTIKGAYEDPLYVHIVMELCSGGELFDRIIQRGHYTERKAAELTKIIVGVVEACHSLGVMHRDLKPENFLLVNKDDDFSLKAIDFGLSVFFKPGQVFTDVVGSPYYVAPEVLLKHYGPEADVWTAGVILYILLSGVPPFWAETQQGIFDAVLKGHIDFDSDPWPLISDSGKDLIRKMLCSQPSERLTAHQVLCHPWICENGVAPDRSLDPAVLSRLKQFSAMNKLKKMALRVIAESLSEEEIAGLXREMFQAMDTDNSGAITFDELKAGLRRYGSTLKDIEIRDLMEAADVDKSGTIDYGEFIAATFHLNKLEREEHLIAAFQYFDKDGSGYITVDELQQACAEHNMTDAFLEDIIREVDQDNDGRIDYGEFAAMMQKGNAGIGRRTMRNSLNLSMRDAPSAQ

SEQ ID NO: 2879 - protein, 563 aa, Glycine max; identical to SEQ ID NO: 785

SEQ ID NO: 2880 - protein, 221 aa, Glycine max
  unsure (1)..(221): unsure at all Xaa locations
MGRGRVELKRIENKINRQVTFAKRRNGLLKKAYELSVLCDAEVALIIFSNRGKQYEFCSGSSMLKTLERYQKCNYGAPEDNVATKEALELSSQQEYLRLKARYEALQRSQRNLMGEDLGPLSSKELESLERQLDSSLKQIRSIRTQFMLDQLSDLQRKEHFLGESDRDLRQRLEEFQINPLQLNPSAEDMGYGRHXRYHPDPVSVVTEGPSMNNYMAGWLP

SEQ ID NO: 2881 - protein, 294 aa, Glycine max
MSEALEEVVPSMKGGCEEEGLNLKATELRLGLPGCESPEREGVFKSVVVSGAKRGFSDAIDGNWNGGGSEKDAAALFSPTSRGAVSVSVSAAKSLTLTATDCTNQPTALGASVLKETVPRSPKPLHENKPQISAPAAKAQVVGWPPIRSFRKNSMASQPQKNDAAADAEAKSGCLYVKVSMEGAPYLRKVDLNSFTTYKDLSLALEKMFSCFTLSQCGSYGVSSRENLSESRLMDLLHGSEYVLTYEDKDGDWMLVGDVPWEMFTESCKRLRIMKSSEAIGLAPRAMEKCKSRY

SEQ ID NO: 2882 - protein, 234 aa, Glycine max; identical to SEQ ID NO: 2079

SEQ ID NO: 2883 - protein, 259 aa, Glycine max; identical to SEQ ID NO: 2021

SEQ ID NO: 2884 - protein, 259 aa, Glycine max
MSAEKERETQVYLAKLAEQAERYEEMVECMKKVAKLDLDLTVEERNLLSVGYKNVIGARRASWRIMSSIEQKEESKGNEHNVKLIKSYCQKVEEELSKICGDILTIIDQHLIPSSASAEASVFYYKMKGDYFRYLAEFKTDQERKEAAEQSLKGYEAASATANTDLPSTHPIRLGLALNFSVFYYEIMNSPERACHLAKQAFDEAIAELDTLSEESYKDSTLIMQLLRDNLTLWTSDLPEDGGEDSIKAEETKPSEPEH

SEQ ID NO: 2885 - protein, 147 aa, Glycine max; identical to SEQ ID NO: 1775

SEQ ID NO: 2886 - protein, 209 aa, Glycine max
  unsure (1)..(209): unsure at all Xaa locations
MYKERERVGVSVSASKSEDRKRINDVLDKHLERSSPSTSRPITSASKNSNLQVEESETESEESDVSGSDGDDTSWISWFCNLRGNEFFCEVDDDYIQDDFNLCGLSSQVPYYDYALDLILDVESSHGDMFTEEQNELIESAAEMLYGXLIHARYVLTSKGMAAMLDKYKNYDFGRCPRLYCSGQPCLPAGQSDIPRPSTVKLLPPVKLT

SEQ ID NO: 2887 - protein, 375 aa, Glycine max
MSKTSEIITCKAAICWGIGKPVTVEEIQVDPPKATEVRVKMLCASICSTDISSTKGFPHTNFPIALGHEGVGIIESVGDQVTNLKEGDVVIPTYIGECQECENCVSEKTNLCMTYPVRWTGLMPDNTSRMSIRGERIYHIFSCATWSEYMVSDANYVLKVDPTIDRAHASFISCGFSTGFGAAWKEAKVESGSTVAVFGLGAVGLGAVIGSKMQGASRIIGIDTNENKRAKGEAFGITDFINPGDSNKSASELVKELSGGMGADYSFECTGVSTLLSESLEATKIGTGKAIVIGVGIEITLPLGLFAILLGRTLKGSVFGGLRAISDLSILADKGHKKEFPLQELFTHEVTLADINKAFELLKQPNCVKVVINMP

SEQ ID NO: 2888 - protein, 434 aa, Glycine max
MVLSWTRRNVFRRAKKEKEQSQLLEVEVVIPNHFRCPVSLELMTDPVTLSTGITYDRVSIEKWIEGENRTCPVTNQVLTTFDLIPNHAIRMMIQDWCVQNSSYGIERIPTPRIPISSYEVSDTCTRILSACQRGDDERCQELVGKIKVWSRESERNKRCIVGAGAGAVLAYAFDCFSSNSIDKHVVVLEEVLEVMTWMIPFGEEGVSKLSSRASLNSLVWFLEGKDLASRQSAALLLKEVCVQELAKVGNVVEALVKMLREPIGSSTSTKACLATIFNLVSLAANREGIAQRFVELGLVSLLLEAIVDGEKGVCEKALGVLDCICDCEKGKEVVKSNALALPLVVKKLLRVSPLASGFAVSILRKICDKREEGILVEALQVGLFQKLLVLLQVGCDESTKENATRLLKLLNGYRNKAECTDSSSLDFKHLKKPF

SEQ ID NO: 2889 - protein, 107 aa, Glycine max
MALPKAKEIVSSNSVVVFSKTYCPFCVDVKKLFGDLGANYKAIELDTESDGKELQAALVEWTDQRTVPNVFIGGNHIGGCDSTTALHTQGKLVPLLISAGAVAKSTA

SEQ ID NO: 2890 - protein, 483 aa, Glycine max; identical to SEQ ID NO: 861

SEQ ID NO: 2891 - protein, 201 aa, Glycine max
  unsure (1)..(201): unsure at all Xaa locations
TSPYSILFCICFQAPKVTFKKPXGSVSVSGHKFVGCPMPCGVQITRLEYVNALARDVEYLASRDATIMGSRNGHAPIFLWYTLNRKGYRGFQKEVQKCLRNAHYFKGRLVEAGIGAMLNELSSTVVFERPHDEEFIRKWQLACKGNIAHVVVMPNITIEKLDDFLNELLEKRATWFQDGKDQPYCISSDVGEKNCLCALHK

SEQ ID NO: 2892 - protein, 238 aa, Glycine max
MKIQCDVCERAPATVICCADEAALCAKCDVEVHAANKLASKHQRLLLQCLSSKLPRCDICQDKPAFIFCVEDRALFCQDCDEPIHSAGSLSANHQRFLATGIRVASSSNCTKDNEKSHLEPPTRNAQQVSAKIPPQQVPSFTSSWAVDDLLELTAFESPEKESLQFGELEWLTDVGIFGEQFAQEALAAAEVPQLPVTHNSSSVASYRTSKSYMSHKKPRIEVLNDDDDEYFTVPDLG

SEQ ID NO: 2893 - protein, 239 aa, Glycine max
MKIQCDVCERAPATVICCADEAALCAKCDVEVHAANKLASKHQRLLLQCLSSKLPTCDICQDKPAFIFCVEDRALFCQDCDEPIHSAGSLSANHQRFLATGIRVASSSNCTKDNEKSHSEPPNRNAQQVSAKIPPQQVPSFTSSWAVDDLLELTGFESPEKKESLQFGELEWLTDVGIFGEQFAQEALAAAEVPQLPVTHNSSSVASYRTSKSYMSHKKPRIEVLNDDDDEYFTVPDLG

SEQ ID NO: 2894 - protein, 247 aa, Glycine max
  unsure (1)..(247): unsure at all Xaa locations
IESSKQACTRGSRDVCERAPATVICCADEAALCAKCDVEVHAANKLASKHQRLLLQCLSSKLPTCDICQDKPAFIFCVEDRALFCQDCDEPIHSAGSLSANHQRFLATGIRVASSSNCTKDNEKSHSEPPNRNAQQVSAKIPPQQVPSFTSSWAVDDLLELTAFESPEKKESLQFGELEWLTDVGIFGEQFAQEALAAAEVPQLPVTHNSSSVASYKTSKSYMSHKKPRIEVXDDDDDEYFTVPDLG

SEQ ID NO: 2895 - protein, 154 aa, Glycine max
  unsure (1)..(154): unsure at all Xaa locations
MEEACEFRSWAELIPDALGVIFTNLSLQERVTVIPRVCKSWANAVTGPYCWQEIDIKDWSNRCQPDQLDRLLEMLITRSCGTLRKLSVSGLQTESIFTFIAENACSLHTLRLPRSSMNDSIVEQIAGRLSMISFLXVSYCIKIGPYALEMIGKN

SEQ ID NO: 2896 - protein, 162 aa, Glycine max
MEEACEFRSWAELIPDALGVIFTNLSLQERVTVIPRVCKSWANAVTGPYCWQEIDIKDWSNRCQPDQLDRLLEMLITRSSGSLRKLSVSGLQTESIFTFIAENACSLHTLRLPRSSMNDSIVEQIAGRLSMISFLDVSYCIKIRPYALEMIGKNCKLLERVV

SEQ ID NO: 2897 - protein, 318 aa, Glycine max
  unsure (1)..(318): unsure at all Xaa locations
ACEFLSWAELIPDALGVIFTNLSLLERVTXIPRVCKSWANAVTGPYCWQEIDIKDWSNRCQPDQLDRLLEMLITRSCGTLRKLSVSGLQTESIFTFIAENACSLHTLRLPRSSMNDSIVEQIAGRLSMISFLDVSYCIKIGPYALEMIGKNCKLLEGLCRNMHPLDTAEKPHQDDEAYAIASTMPKLKHLEMAYHLISTSGVLQILANCPKLEFLDQRGCWGVTLDHMFLKQKFPKLKVLGPLVLDTYESDGWDDFSDVSDSSEYLAWDFVAGGMGEYYVDDSDSYDGMWDDEARLDELQFGFYEGIEDAGMYWPPSP

SEQ ID NO: 2898 - protein, 309 aa, Glycine max
MAATMNFYNETSQQVQSDPFRGELMEVLEPFMKTCPSSTPSILSSDSPSPSPLNFPSSSLLSPHPNFYTHTPPPSYLLQSQQSLIGFEQPPSSLLGLNHLSPSQISQIQAQIEAQQSQNQNPHSLNFLGPKPVPMKHVGGPPKPTKLYRGVRQRHWGKWVAEIRLPKNRTRLWLGTFDTAEEAALAYDKAAYRLRGDFARLNFPSLKGSCPGEEYKPVHSAVDAKLDAICANLAEMQKQGKTEKGARSAKKSKQGPNQEAKPEPQASAESEGSADSSPLSDLTFDVTEPQWEHFNLQKFPSYEIDWDSL

SEQ ID NO: 2899 - protein, 311 aa, Glycine max
MAATMNFYNETSQQVQSDPFRGELMEVLEPFMKTCPSSTPSILSSDSPSPSSYSPLLPPHPSFSTYTPSAYLFQNQQPLIGFEQQPSSLLGLNHLSTSQISQIQAQAQAQNSLSLNFLGPKPVPMKHVGGPAKPTKLYRGVRQRHWGKWVAEIRLPKNRTRLWLGTFDTAEEAALAYDKAAYRLRGDLARLNFPNLKGSCPGEEYKPMQAAVDAKLDAICANLAEMQKQGKNEKGARSGKKSKQGPNLEAKPEPEASGSGAAALSPESEGSADSSALSDLTFDVTEPQWEDASAHFNLQKFPSYEIDWDSL

SEQ ID NO: 2900 - protein, 253 aa, Glycine max
  unsure (1)..(253): unsure at all Xaa locations
GVSVSASKSEDRKRINDVLAKHLERSSPSTSRPINTASKNPNFQLEESKSESEESDVSGSDGDDTSWISWFCNLRGNEFFCXGDGDYKNDNFTLCGLSIHVPSLDNTLDLILFVESSHGDMFTEEQNGLIESAAEMLYGMIHARYVLTSKGMAAMLDKYKSYDFGRCPRVYCSGQPCLPVGQSDIPRSSTVKIYCPRCEDLYYPRSKYQGNIDGAYFGTTFPHLFLMTYGQLKPQKPAQGYVPRVFGFKVHKP

SEQ ID NO: 2901 - protein, 287 aa, Glycine max
LCTESRGGVGSKSEVTSVDRKRINDVLDKQLERSSPSTSRAAGAINGKDRSSSSLLAAAKDSRSASVTAPISKNSNASDEESETDSEESDVSGSDGDDTSWISWFCNLRGNEFFCEVDDDYIQDDFNLCGLSSQVPYYDYALDLILDVESSHGDMFTEEQNELIESAAEMLYGLIHARYILTSKGMAAMLDKYKNYDFGRCPRVYCSGQPCIPVGQSDIPRSSTVKIYCPRCEDIYYPRSKYQGNIDGAYFGTTFPHLFLMTYGQLKPQKPSQSYVPRVFGFKLHKP

SEQ ID NO: 2902 - protein, 481 aa, Glycine max
MQTFSLAQHQVKARFLYEDTLHLKTNSRVVNQGVHFVHMKKQVQGPIPNACLSESSRGARWSLNGMTALVTGGTRGIGHAIVNDLAAFGAAVHTCSRNQTELKKCLQEWQTQGFQATGSVNNVGTNFRKPTVEYSAEEYSELMTVNLDSGYHLCQLVYPLLKASVKGSIVFISSVAGVVSLGTGSVYAACKGYSYSAGMLLGACLGHSLPFQKYIESKRFIILFQNQKFVEDILSRTPLKSIAEAEEVSSLDKHAIVSDLAAFGAAVHTCSRTQTELNKCLQEWQSLGFQREKLIEEVTSILNGKLNIYVNNVGTNFRKPTIEYTAEEYSQLMTVNLDSSFHLCQLAYPLLKASENGSIVFISSVAGVVSLGTGAVYAASKAAINQLTKNLACEWAKDNIRSNCVVPWATRTPLVEHLLRDQKFVDDIMSRTPIKRIAEPEEVSSLVTFLCLPAASYITGQVICVDGGLTVNGFQPSMRIT

SEQ ID NO: 2903 - protein, 427 aa, Glycine max
MSFRSIVRDVRDSFGSLSRRSFDVRLTGHHRGKSQGSVQDLHDQPLVIQNSRWASLPPELLFDIIRRLEESENTWPARNGLIACAAVCQSWRNMCKDIVKSPEFCGKLTFPVSLKQPGPRDGIIQCFIKRDKSNLTYHLFLCLSPALLVENGKFLLSAKRTRRTTYTEYVISMDADNISRSSNTYIGKLRSNFLGTRFIICDTQPPYSSAHICPPMTGKTSRRFYSKKVSPKVPSGSYNIAQVTYELNVLGTRGPRKMHCVMHSIPASALDAGGTVPGQPELLPRPLEDSFRSISFSKSLDRSIEFSSSRFSEIGESIIEDDDGKMRPLVLKNKPPRWHEQLQCWCLNFRGRVTVASVKNFQLIAATQPPAGAPTPSQPAPPEHDKIILQFGKVGKDMFTMDYRYPLSAFQAFAICLSSFDTKLACE

SEQ ID NO: 2904 - protein, 388 aa, Glycine max
MADSGSASSSRMWCSIPERVQLHAAMLALQFGYAGFHVVSRAALNMGISKLVFPVYRNIIAFLLLLPFAYFLEKKERPAITLNFLLQFFLLALVGITANQGFYLLGLDNTSPTFASAIQNSVPAITFLMAVILRIEQVRLNRKDGIAKVAGTIFCVAGATVITLYKGPTIYSPSPPLQSESSVVVEFGTLSSLGDAKGKNWTLGCLYLIGHCLSWSAWLVLQAPVLKKYPARLSVTSYTCFFGLIQFLVIALIVERDAQAWIFQSGGEVFTILYAGVVASGIAFAVQIWCIDRGGPVFVAVYQPVQTLVVAIMASLALGEEFYLGGIIGAVLIVVGLYFVLWGKSEERKFAKEHAAITSTPEHSGIRSSSHAKTLLTQPLLPSSTENV

SEQ ID NO: 2905 - protein, 389 aa, Glycine max
MADSASASASSSRMWCSIPERFQLHAAMLALQFGYAGFHVVSRAALNMGISKLVFPVYRNIIAFLLLVPFAYFLEKKERPAITLNFLLQFFLLALVGITANQGFYLLGLDNTSPTFASAIQNSVPAITFLMAVILRIEQVRLNRKDGISKVAGTIFCVAGATVITLYKGPTIYSPTPPLHSERPAVVDFGTLSLGDAKGKNWTLGCLYLIGHCLSWSAWLVLQAPVLKKYPARLSVTSYTCFFGLIQFLVIALIVERDAQAWIFQSGGEVFTILYAGVVASGIAFAVQIWCIDRGGPVFVAVYQPVQTLVVAIMASIALGEEFYLGGIIGAVLIVVGLYFVLWGKSEERKFAKEHAAITSTPEHSGIRSSSHAKTSLTQPLLPSSTENV

SEQ ID NO: 2906 - protein, 290 aa, Glycine max
  unsure (1)..(290): unsure at all Xaa locations
PTRPPTRPIFDRFIIITFNEKKWAEASIGSKSSRWSLQGMTALVTGGSKGIGYAIVEELAQLGATVHTCARNEAELNESLNEWNTKGYRVTGSVCDVASRAERQDLIARVSNEFNGKLXNILVNNVGTNVPKHTLDVTEEDFSFLINTNLESAYHLSQLAHPLLKASEAANIIFISSIAGVLSIGIGSTYGATKGAMNQLTKNLACEWAKDNIRTNCVAPGPIKTPLGDKHFKNEKLLNAFISQTPLGRIGEAEEVSSLVAFLCLPAASYITGQTICVDGGLTVNGLYIN

SEQ ID NO: 2907 - protein, 269 aa, Glycine max; identical to SEQ ID NO: 701

SEQ ID NO: 2908 - protein, 522 aa, Glycine max
GCEKTTEGRGFCLVIILATHIVFVGKIFHQQHTAMAGSNILSHSPSLPKTYSHSLNQNALSQKLFFLPLKFKATTKPRALRAVLSQNAVKTSVEDTKNAHFQHCFTKSEDGYLYCEGLKVHDIMESVERRPFYLYSKPQITRNVEAYKDALEGLNSIIGYAIKANNNLKILEHLRHLGCGAVLVSGNELKLALRAGFDPTRCIFNGNGKILEDLVLAAQEGVFVNIDSEFDLENIVEAAKRAGKKVNVLLRINPDVDPQVHPYVATGNKNSKFGIRNEKLQCFLDAVKEHPNELKLVGAHCHLGSTITKVDIFRDAATIMINYIDQIRDQGFEVDYLNIGGGLGIDYYHSGAILPTPRDLIDTVRDLVISRGLNLIIEPGRSLIANTCCLVNRVTGVKTNGSKNFIVIDGSMAELIRPSLYDAYQHIELVSPAPSNAETETFDVVGPVCESADFLGKGRELPTPAKGTGLVVHDAGAYCMSMASTYNLKMRPPEYWVEDDGSVSKIRHGETFEDHIRFFEGL

SEQ ID NO: 2909 - protein, 488 aa, Glycine max
MAGSHLLSHSPSLPKTYNYSLNQNPLSQNLFFPPLKFKSTTKPRVLRAVLSQNAAKTAVEDTKNAHFQHCFTKSEDGYLYCEGLKVHDIMESVERRPFYLYSKPQITRNVEAYKDALEGLSSIIGYAIKANNNLKILEHLRHLGCGAVLVSGNELRLALRAGFDPTRCIFNGNGKILEDLVLAAQEGVFVNIDSEFDLENITEAAKRAGKKVNVLLRINPDVDPQVHPYVATGNKNSKFGIRNEKLQWFLDAVKELPNELKLVGAHCHLGSTITKVDIFRDAATIMINYIDQIRDQGFEVDYLNIGGGLGIDYYHSGAILPTPRDLIDTVRDLVISRGLSLIIEPGRSLIANTCCLVNRVTGVKSNGSKNFIVIDGSMAELIRPSLYDAYQHIELVSPAPSNAETTTFDVVGPVCESADFLGKGRELPTPAKGTGLVVHDAGAYCMSMASTYNLKMRPPEYWVEDDGSVSKIRHGETFEDHIRFFEGL

SEQ ID NO: 2910 - protein, 624 aa, Glycine max
MDAIVQTRGLLSLPTNPKTRVSHHLHLSHGLKHRFLSLKPKPLSTPSLSAAAAVKFHPFGPKPQNLFICRAEAAAAADGPAQPAFGEPEVAEKPKLLGIEITTLKKIIPLGLMFFCILFNYTILRDTKDVLVVTAKGSSAEIIPFLKTWVNLPMAVGFMLLYTKLANVLSKQALFYSVILPFIAFFGAFGFVLYPLSNYIHPEAFADKLLNILGPRFLGPLAIMRIWSFCLFYVMAELWGSVVISVLFWGFANQITTIEEAKRFYPLFGLGANVALIFSGRTVKYFSNLRQNLGPGVDGWAISLKAMMSIVVGMGFAICFLYWWVNNYVPLPTRSKKKKEKPKMGTMESLKFLVSSKYIRDLATLVVAYGISINLVEVTWKSKLKAQFPSPNEYSSFMGDFSTATGIATFTMMLVSQFIFDKYGWGVAAIITPTVLLLTGVGFFSLILFGGPLAPGLASLGMTPLLAAVYVGALQNIFSKSAKYSLFDPCKEMAYIPLDEDTKVKGKAAIDVVCNPLGKSGGALIQQFMILTFGSLANSTPYLGGILLLIVSAWLAAAKSLDTQFTALRKEEELEKEMERAATVKIPVVAESEGGNGSLTAGSPLNPSSGDSSSSPSEASTPHN

SEQ ID NO: 2911 - protein, 344 aa, Glycine max
  unsure (1)..(344): unsure at all Xaa locations
MCKCKYYRYTRIKYAQEAPPALLLRFLLVCTLVALRAPVAQPPIVRIPPNHLTETTNTVITIVHQRHRTQISGSTRPAMSKARVYTDVNVLRPKEYWDYESLTVQWGDQDDYEVVRKVGRGKYSEVFEGINVNSNERCIIKILKPVKKKKIKREIKILQNLCGGPNIVKLLDIVRDQHSKTPSLIFEYVNSTDFKVLYPTLTDYDIRYYIYRPLKVTXSFNLSWYTLTGALCPLHNVYIGVSLSWTRLISILHLVHVYRHLLMHHGNYFTFAQICVKDPFLLLECFSFELQAIDYCHSQGIMHRDVKPHNVMIDHELRKLRLIDWGLAEFYHPGKEYNVRVASR

SEQ ID NO: 2912 - protein, 333 aa, Glycine max
MSKARVYTDVNVLRPKEYSDYESLTLQWGDQDDYEVVRKVGRGKYSEVFEGINVNSNERCIIKILKPVKKKKIKREIKILQNICGGPNIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDELNAYLNKYHLELDPQLDALVGRHSRKPWSKFINADNQHLVSPEAIDFLDKLLRYDHQDRLTAREAMAHPYFSQVRAAESSRMRTQ

SEQ ID NO: 2913 - protein, 147 aa, Glycine max
  unsure (1)..(147): unsure at all Xaa locations
FAQICVKDPFLLLECFSFELQAIDYCHSQGIMHRDVKPHNVMIDHXLRKLRLIDWGLAEFYHPGKEXNXRXXSRXFXGPELLVDLQDYDYSLDMWSLGCXLAGMIFRKEPFFYGHDNHDQLVKIAKVLGTDELNAYLNKYHLELDPN

SEQ ID NO: 2914 - protein, 333 aa, Glycine max
MSKARVYTDVNVLRPKEYWDYESLTVQWGDQDDYEVVRKVGRGKYSEVFEGINVNSNERCVIKILKPVKKKKIKREIKILQNLCGGPNIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDELNAYLNKYHLELDPQLDALVGRHSRKPWSKFINADNQHLVSPEAIDFLDKLLRYDHQDRLTAREAMAHPYFSQVRAAESSRMRTQ

SEQ ID NO: 2915 - protein, 513 aa, Glycine max
  unsure (1)..(513): unsure at all Xaa locations
WEGLFEAITGYGLGGSSMALFGRVGGGIYTKXAADVGADLVGKVERNIPEDDPRNPAVIADNVGDNVXYPLLISSMGIIVCLITTLFATDFFEIKAVKEIEPALKKQLIISTVLMTVGIAIISWIALPTSFTIFNFGAQKEVKSWQLFLCVGVGLWAGLIIGFVTAYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGXKGFAIGSAALVSLALFGAFVSRAGILTVDVLTPKVFIGLIVGAMLPYWFSAMTMKSVGSAALKMVEEVRRQFNTIPGLMEGHAKPDYATCVKISTDASIKEMIPPGAXLVMLTPLIVGIFFGVETLSGVLAGALVSGVQIAISASNTGGAXWDNAKKYIEAGASEHARTLGPXKGSEPHKAAVIGDTIGDPLKDTSGPSLNILIKLMAVESLVFAPFFATHGGLLFKIF

SEQ ID NO: 2916 - protein, 768 aa, Glycine max
MGAALLSELATEIVVPACAVIGIVFSLVQWFLVSRVKLTPDRNGTTSSPRNNKNGYGDFLIEEEEGINDHSVVVKCAEIQNAISEGATSFLFTEYQYVGIFMVAFAILIFLFLGSVEGFSTKSQPCTYDKSKLCKPALATALFSTVSFLLGAITSVLSGFLGMKIATYANARTTLEARKGVGKAFITAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTAMLYPLLISSMGIIVCLITTLFATDFFEIKAVKEIEPALKKQLIISTVLMTVGIAIISWIALPTSFTIFNFGAQKEVKSWQLFLCVGVGLWAGLIIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRAGISTVDVLTPKVFIGLIVGAMLPYWFSAMTMKSVGSAALKMVEEVRRQFNTIPGLMEGHAKPDYATCVKISTDASIKEMIPPGALVMLTPLIVGIFFGVETLSGVLAGALVSGVQIAISASNTGGAWDNAKKYIEAGASEHARTLGPKGSEPHKAAVIGDTIGDPLKDTSGPSLNILIKLMAVESLVFAPFFATHGGLLFKIF

SEQ ID NO: 2917 - protein, 768 aa, Glycine max
  unsure (1)..(768): unsure at all Xaa locations
MGAALLSELATEIVVPVXAVIGIVFSLVQWFLVSRVKLTPDRNGTTSXPRNNKNGYGDFLIEEEEGINDHSVVVKCAEIQNAISEGATSFLFTEYQYVGIFMVAFAILIFLFLGSVEGFSTKSQPCTYDKSKLCKPALATALFSTVSFLLGAITSVLSGFLGMKIATYANARTTLEARKGVGKAFITAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTAMLYPLLISSMGIIVCLITTLFATDFFEIKAVKEIEPALKKQLIISTVLMTVGIAIISWIALPTSFTIFNFGAQKEVKSWQLFLCVGVGLWAGLIIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRAGILTVDVLTPKVFIGLIVGAMLPYWFSAMTMKSVGSAALKMVEEVRRQFNTIPGLMEGHAKPDYATCVKISTDASIKEMIPPGALVMLTPLIVGIFFGVETLSGVLAGALVSGVQIAISASNTGGAWDNAKKYIEAGASEHARTLGPKGSEPHKAAVIGDTIGDPLKDTSGPSLNILIKLMAVESLVFAPFFATHGGLLFKIF

SEQ ID NO: 2918 - protein, 155 aa, Glycine max; identical to SEQ ID NO: 1633

SEQ ID NO: 2919 - protein, 198 aa, Glycine max
MDVGQMQRQWIDYTKSLFLEGFLDGQFLQLQQLQDENNPDFVVEVVSLFFEDSERLLKDLTFALDQNGVDFKKVDAHVHQLKGSSSSIGAQRVKNACIAFRNFCEEQNTDACLRCLQQVKQEYCIVKNKLETMFRLEQQIVAAGGSIPWVTERVYYDPRLLKIILYLIKSMVNVWVFIKIEVFHPMYLFLHQKALHNL

SEQ ID NO: 2920 - protein, 172 aa, Glycine max
MASADVEFRCFVGGLAWVTGNDALEKAFSIYGDIVESKVINDRETGRSRGFGFVTFASEQSMKDAIAGMNGQDLDGRNITVNEAQTRASRGGGGGGGFGSGGGYNRGSGGYGGGGGGGGYGGRREGGYNRNGGGGGGGYGGGRDRGYGGDGGSRYSSRWGRRWIRWKLEKLG

SEQ ID NO: 2921 - protein, 121 aa, Glycine max
MGGSSSSSSSSSKDAQDLFRALWSAYASTPTNLKIIDLYVIYAVFTALIQVVYMALVGSFPFNSFLSGVLSCVGTAVLAVCLRIQVNKDNKEFKDLAPERAFADFVLCNLVLHLVIMNFLG

SEQ ID NO: 2922 - protein, 113 aa, Glycine max
MAPRSSSKDAQDLFRALWSAYAATPTNLKIIDLYVIYAVFTAFIQVVYMALVGSFPFNSFLSGVLSCVGTAVLAVCLKIQVNKENKEFKDLAPERAFADFVLCNLVLHLVIMN

SEQ ID NO: 2923 - protein, 116 aa, Glycine max
MAPRSSSKDAQDLFRALWSAYAATPTNLKIIDLYVIYAVFTAFIQVVYMALVGSFPFNSFLSGVLSCVGTAVLAVCLRIQVNKENKEFKDLAPERAFADFVLCNLVLHLVIMNFLG

SEQ ID NO: 2924 - protein, 526 aa, Glycine max
VTKMTEGKLVEAAEAHKTLQDFDPPKKRKRNKYAFACAMLASMTSILLGYDIGVMSGAAIYIKRDLKVSDEQIEILLGIINLYSLIGSCLAGRTSDWIGRRYTIVFAGAIFFVGALLMGFSPNYSFLMFGRFVAGIGIGYALMIAPVYTAEVSPASSRGFLTSFPEVFINGGILIGYISNYAFSKLTLKVGWRMMLGVGAIPSVLLTVGVLAMPESPRWLVMRGRLGEARKVLNKTSDSKEEAQLRLAEIKQAAGIPESCNDDVVQVNKQSNGEGVWKELFLYPTPAIRHIVIAALGIHFFQQASGVDAVVLYSPRIFEKAGITNDTHKLLATVAVGFVKTVFILAATFTLDRVGRRPLLLSSVGGMVLSLLTLAISLTVIDHSERKLMWAVGSSIAMVLAYVATFSIGAGPITWVYSSEIFPLRLRAQGAAAGVAVNRTTSAVVSMTFLSLTRAITIGGAFFLYCGIATVGWIFFYTVLPETRGKTLEDMEGSFGTFRSKSNASKAVENENGQVAQVQLGTNVQT

SEQ ID NO: 2925 - protein, 360 aa, Glycine max
MLGVIRHKSIRPAFSAIRHFSSAAKEITVRDALNSALDEEMSADPKVFLMGEEVGEYQGAYKISKGLLDKYGPERVLDTPITEAGFAGIGVGAAYYGLRPVVEFMTFNFSMQAIDHIINSAAKSNYMSAGQISVPIVFRGPNGAAAGVGAQHSQCYASWYGSCPGLKVLSPYSSEDARGLLKAAIRDPDPVVFLENELLYGESFPVSAEVLDSSFCLPIGKAKIEREGKDVTITAYSKMVGYALKAAETLAKEGISAEVINLRSIRPLDRSTINASVRKTNRLVTVEEGFPQHGVGAEICTSVIEESFGYLDAPVERIAGADVPMPYAANLERMAVPQVEDIVRAAKRACYRSVPLAASA

SEQ ID NO: 2926 - protein, 361 aa, Glycine max
  unsure (1)..(361): unsure at all Xaa locations
MLGVIRHKSIRHAFSAIRHLSSAAKEITVREALNSALDEEMSADPKVFLMGEEVGEYQGAYKISKGLLEKFGPERVLDTPITEAGFAGIGVGAAYYGLRPVVEFMTFNFSMQAIDHXINSAAKSNYMXAGQISVPIVFRGPNGAAAXVGAQHSQCYASWYXAHAPGLKVLSPYSSEDARGLLKAAIRDPDPVVFLENELLYGESFPVSAEVLDSSFCLPIGKAKIEREGKDVTITAYSKMVGYALKAAETLAKEGISAEVINLRSIRPLDRSTINTSVRKTNRLVTVEEGFPQHGVGAEICTSVIEESFGYLDAPVERIAGADVPMPYAANLERMAVPQVEDIVRAAKRTCYRSVPLAASA

SEQ ID NO: 2927 - protein, 360 aa, Glycine max
MLGVIRHKSIRPAFSAIRHLSSAAKEITVREALNSALDEEMSADPKVFLMGEEVGEYQGAYKISKGLLDKYGPERVLDTPITEAGFTGIGVGAAYYGLRPVVEFMTFNFSMQAIDHIINSAAKSNYMSAGQISVPIVFRGPNGAAAGVGAQHSQCYASLYGSCPGLKVLSPYSSEDARGLLKAAIRDPDPVVFLENELLYGESFPVSAEVLDSSFCLPIGKAKIEREGKDVTITAYSKMVGYALKAAETLAKEGISAEVINLRSIRPLDRSTINASVRKTNRLVTVEEGFPQHGVGAEICTSVIEESFGYLDAPVERIAGADVPMPYAANLERMAVPQVEDIVRAAKRACYRSVPLAASA

SEQ ID NO: 2928 - protein, 521 aa, Glycine max
  unsure (1)..(521): unsure at all Xaa locations
MRRTGLLHLLCLVIALVSVQAEDAYKYYTWTVTYGTISPLGSPQQVILINGQFPGPRLDLVTNENVILNLINKLDEPFLLTWNGIKQRKNSWQDGVLGTNCPIPPNSNYTYKFQAKDQIGTYTYFPSTQLHKAAGGFGALNVYHRSVIPIPYPNPDGDFTLLVGDWYKTNHKTLRQTLESGKPLAFPDGLLINGQAHSTFTGNPGKTYMFRISNVGFSTSINFRIQGHTLKLVEVEGSHTVQNLYDSLDVHVGQSVAVLVTLNQPPKDYYIVASTRFTETPLTTTAVLHYANSFSSALGPVPAPPVDKYDFDWSMKQARTYRWNLTANAARPNPQGSFHYGKITPTKVIKLANSAPLINGKLRYAVNSVSYVNPDTPLKLADYFNIPGIFSVNLLQNSPSNGPGYIGTSVLQTSLHDFIEVIFQNNENTMQSWHLDGYDFWVIGHGFGQWTDASRKTYNLVDALXRHTTQVYPKSWTTILVSLDNQGMWNLRSAIWERQYLGQQFYLRVWDAHITGICKDF

SEQ ID NO: 2929 - protein, 298 aa, Glycine max
DMDRIKGPWSPEEDEALQKLVEKHGPRNWSLISKSIPGRSGKSCRLRWCNQLSPQVEHRAFTAEEDDTIIRAHARFGNKWATIARLLHGRTDNAIKNHWNSTLKRKCSSTMIDDNTQPLKRSVSAGAAIPVSTGLYMNPPTPGSPSGSDVSESSLPVASSSHVFRPVPRTVKVLPPVETTSSSNDPPTSLSLSLPGVGVVDSSEVSNRTTEPIHFTPPMPHRSNTMPLLPMMTSVSATVMAPFNFSAEFRSVMQEMIRKEVRSYIELHNQNGMCFQAAVNDGFRNASVKRIGISRVDS

SEQ ID NO: 2930 - protein, 313 aa, Glycine max
MNTRKDMDRIKGPWSPEEDEALQKLVEKHGPRNWSLISKSIPGRSGKSCRLRWCNQLSPQVEHRAFTHEEDDTIIRAHARFGNKWATIARLLHGRTDNAIKNHWNSTLKRKCTSTMIDDDNTPPLKRSLSAGAAIPVSTGLYMNPPTPGSPSGSDVSESSVLVASSSHVFRPVPRTGAVLPPVETTTTLSSNDPPTSLSLSLPGVDSSEVSNRTTEPIHAAPPPPPQPQPQPQPLNTIPLLPMMTVPSVSPTGMAPFNFSAEFLAVMQEMIRKEVRSYMELHNQKNGMCFQAAVNDGFRNASVKRIGISRVDS

SEQ ID NO: 2931 - protein, 267 aa, Glycine max; identical to SEQ ID NO: 1199

SEQ ID NO: 2932 - protein, 527 aa, Glycine max
MIIPASVLSLFTPPCFGMARDHPCSLRCIARLGYFLPLGMAIQMSSFVFVSLTILFCFSSLEKSFAFQTTKEDTESNNLHQYTHLVHLSSLLPSSSCSSSAKGPKRKASLEVVHKHGPCSQLNNHDGKAKSTTPHSEILNQDKERVKYINSRISKNLGQDSSVSELDSVTLPAKSGSLIGSGNYFVVVGLGTPKRDLSLIFDTGSDLTWTQCEPCARSCYKQQDAIFDPSKSTSYSNITCTSTLCTQLSTATGNEPGCSASTKACIYGIQYGDSSFSVGYFSRERLSVTATDIVDNFLFGCGQNNQGLFGGSAGLIGLGRHPISFVQQTAAVYRKIFSYCLPATSSSTGRLSFGTTTTSYVKYTPFSTISRGSSFYGLDITGISVGGAKLPVSSSTFSTGGAIIDSGTVITRLPPTAYTALRSAFRQGMSKYPSAGELSILDTCYDLSGYEVFSIPKIDFSFAGGVTVQLPPQGILYVASAKQVCLAFAANGDDSDVTIYGNVQQKTIEVVYDVGGGRIGFGAGGCK

SEQ ID NO: 2933 - protein, 336 aa, Glycine max
MGRQPCCDKVGLKKGPWTAEEDKKLINFILTNGQCCWRAVPKLAGLLRCGKSCRLRWTNYLRPDLKRGLLSEYEEKMVIDLHAQLGNRWSKIASHLPGRTDNEIKNHWNTHIKKKLKKMGIDPVTHKPLSNKTEQTQAQPDEQQTHQPLQEQQEEPIPVEKDTKFEPEKEQNKEPEKPESSIESLTITEEAKEEDQIMTPLFDSWELMNEFCTDEVPIIESNEILVPSAPSSTSPTTTTTTSSSTSTSASSNSNSSNFLEDLLLPDFEWSDDYNDTNFDNNNNSSMALWDDDFIRSWNLLINDDDGDGDRKQVFEAPINQYPRVIMDSDSWAYGLF

SEQ ID NO: 2934 - protein, 583 aa, Glycine max
  unsure (1)..(583): unsure at all Xaa locations
MEAKIAKALDRVALNLKRKRGXRYAAHLSGASQPMLGHWSSFTSPTSRAVKRMRLGGYRNRLTNAGPHIGRSLARRFLNYKKSGRLERLMFYENGSWLDFPKDVVDLVKKDLEIKRAAVEIESHGYHLLFDFLRLHKMDLKTGLQQPIALIDEAGCCFFPEIYAASDEEPYNLSKQEGGKSPDSYASNEIKLHLEVEINGVDQSRLSECSGESNALVKGIQIDTKENCCQYDVEVEDSINKKDCGNVGEDIQQHQDISLDAYTESVYGKLDLNSVQKMFLKGMCSFGSTDSDIVEIYHCSGASMQARWELFQKQAEITKKNHGEANIRYAWLASSKGELSTMMNYGLSHYGLSGSKCTYGIGVHLAAVTCPDASVRYCDVDENGVRHLALCRVIMGNMEILRPGTDQFHPSSCEYDNGVDAIECPQYYVVWNMNMNTHIYPEFVVSFKVSSDAEGHFCGSEGKNVSGVNTACDGPHGLLNSESSTVDNGKAPSMVSSTPKVPKSPWMPFPVLLDAIRDQVPPTGMDVIKTYYEQFRSKHISRDDFVKMLRLIVGDGLLRTTITNLQYKIPSGGELKDSIKKED

SEQ ID NO: 2935 - protein, 258 aa, Glycine max
  unsure (1)..(258): unsure at all Xaa locations
MAAEAELPEYLKCPISLEIMSDPVILSSGHTFDRSSIQRWLDAGHRTCPITKLPLPEHSSLIPNHALRSLISNYAPINPLINSSNSHPQTLISTLTSPSSPLPSKLHALHHLTRLSHSDSLFRRRLFNSPALVPALLTFLQHISAADLRHRALSLLLHLSLXDDAKVGLVAEGLLSPLISLLLSSAAPSDCRALAATLLTXASAVLHVNKGTIGAFPGSINGLVXILRDGKGRERKEAATALYALCSFPDNRRKAVEC

SEQ ID NO: 2936 - protein, 134 aa, Glycine max
KKKTVTALVLIALATISLQSSASASSVGKFVDETITSHKIVIFSKTYCPYCRRAKAVFKELSQVPHVVELHEREDGSKIQDIMVNIVGRRTVPQVFINGKHLGGSDDTVEACESGHLHKLLGIEKKDHDDHDDL

SEQ ID NO: 2937 - protein, 498 aa, Glycine max
RYEALNIAGFLDTNLIIISPDNEQVSLPTATIDGPAPPVGALSRALARLNTSSKFHQLRDLAKGITKQIGSRAYEFTSKLDSYLRGMVGGAGACLFEELGLFYIGPVDGHDIEDLVHILKSVKGMPTLGPVLIHVITEKGKGYHPAEVAPDKMHGVVKFDPKSGKQLKSKASTRSYTQYFAESLTAEAEVDEKIVAIHAAMGGGTGLNLFQKRFPERCFDVGIAEQHAVTFAAGLAAEGLKPFCAIYSSFLQRGYDQVAHDVDLQKLPVRFALDRAGLVGADGPTHCGAFDTTFMACLPNMVVMAPSDETELMHMIATAAAIDDRPSCFRYPRGNGIGTILPPNNKGTPLEVGKGRVLKEGSRVALVGYGTMVQSCMEAAKVLEAHGISTTVVDARFCKPLDGDLMRRLAREHEILITVEEGSIGGFGSHVSHFLGLNGLLDGNLKWRALTLPDRYINHGSQTDQIQMAGLSSNHIAVTALSLTNVHWDSRLLLSLQI

SEQ ID NO: 2938 - protein, 308 aa, Glycine max
MGEVAVMHSEPLQFECNDINVNMTEKEVYPPESNVEHLPGEESSQSTDHKNINDLQERGYMEYGCQHYRRRCRIRAPCCNEIFDCRHCHNEAKNDINIDQKHRHDIPRHQVKQVICSLCGTEQEVQQNCINCGVCMGKYFCGTCKLFDDDISKQQYHCCGCGICRTGGSENFFHCYKCGCCYSTLLKNSHPCVEGAMHHDCPVCFEYLFESRNDVTVMPCGHTIHKSCLNEMREHFQYACPLCSKSVCDMSKVWEKFDLEIAATRMPEQYQNKMVWILCNDCGKTSHVQFHFVAQKCPNCKSYNTRQT

SEQ ID NO: 2939 - protein, 308 aa, Glycine max
MGEVAVMHSEPLQFECNDISVNMTEKEVYPPESNVERLPGEESSQSTDHKNINDLQERGYMEYGCQHYRRRCRIRAPCCNEIFDCRHCHNEAKNDINIDQKHRHDIPRHQVKQVICSLCGTEQEVQQNCINCGVCMGKYFCGTCKLFDDDISKQQYHCSGCGICRTGGSENFFHCYKCGCCYSTLLKNSHPCVEGAMHHDCPVCFEYLFESRNDVTVMPCGHTIHKSCLNEMREHFQYSCPLCLKSVCDMSKVWEKFDIEIAATPMPEQYQNKMVWILCNDCGKTSHVQFHFVAQKCPNCKSYNTRQT

SEQ ID NO: 2940 - protein, 387 aa, Glycine max
  unsure (1)..(387): unsure at all Xaa locations
METGIACYTRGPFLPSVSSKHSPPSISPSFGLRSLKSSSLFGESLRVASKSTIKVSKTKNTSLVTRCEIGDSLEEFLTKATPDKGLIRLLVSMGEALRTISFKVKTASCGGTQCVNTFGDEQLAVDLLANQLLFEALXYSHFCKYACSEXXPELLDMXGSVEGGFSVAFDPLDGSSIVDTNFTVGTIFGVWPGDKLTGITGRDQVAAAMGVLGPRTTYVLALKDFPGTHEFLLLDEGKWQHVKETTEIGEGKLFSPGNLRATSDNPDYAKLIDYYVNEKYTLRYTGGMVPDVNQIIVKEKGIFTNVSSPSAKAKLRLLFEVAPLGFLIEKAGGYSSDGHQSVLDKVISNIDDRTQVAYGSKNEIIRFEETLYGKSRLKGGVAVGAAA

SEQ ID NO: 2941 - protein, 390 aa, Glycine max
SGDSNLISFISMATQGQVITCKAAVAWEPNKPLTVQDVQVAPPQAGEVRVQILFTALCHTDAYTWGGKDPEGLFPCILGHEAAGIVESVGEGVTNVQPGDHVIPCYQAECGECKTCKSGKTNLCGKVRSATGVGVMLNDGKSRFSINGKPIYHFMGTSTFSQYTVVHDVSVAKIDPKAPLEKVCLLGCGVSTGLGAVWNTAKVESGSIVAIFGLGTVGLAVAEGAKTAGASRVIGIDIDSKKFDVAKNFGVTEFINPNEHDKPIQQVIIDRTDGGVDYSFECIGNVSVMRAALECCHKGWGTSVIVGVAASGQEISTRPFQLVSGRVWKGTAFGGFKSRSQVPWLVDKYLKKEIKVDEYITHTLTLSEINKAFDLLHEGGCLRCVLSTQE

SEQ ID NO: 2942 - protein, 391 aa, Glycine max
LCSALISFIFISMATQGQVITCKAAVAWEPNKPLTVQDVQVAPPQAGEVRVQILFTALCHTDAYTWGGKDPEGLFPCILGHEAAGIVESVGEGVTNVQPGDHVIPCYQAECGECKTCKSGKTNLCGKVRSATGVGVMLNDGKSRFSINGKPIYHFMGTSTFSQYTVVHDVSVAKIDPVAPLEKVCLLGCGVSTGLGAVWNTAKVESGSIVAIFGLGTVGLAVAEGAKTAGASRVIGIDIDSNRIDIAKNLGVTEFINPNEHEKPVQQVIVELTDGGVDYSFECIGNVLVMRSALECCHKGWGTSVIVGVAASGQEICTRPFQLVTGRVWKGTAFGGFKSRSQVPWLVDKYLKKEIKVDEYITPSLSLAEINKAFDLMHEGGCLRCVLAMNV

SEQ ID NO: 2943 - protein, 202 aa, Glycine max
  unsure (1)..(202): unsure at all Xaa locations
GVSTXLGAXXXXXKVESGXXXAIXXXXXVGLAVAEGAKTAGASRVIGIDIXSKKFDIAKNFGVTEFINPNEHDKPIQQVIIDRTDGGVDXSFECIGNVSVMRAALECCHKGWGTSVIVGVAASGQEISTRPFQLVSGRVWKGTAFGGFKSRSQVPWLVDKYLKKEIKVDEYITHTLTLSEINKAFDLLHEGGCLRCVLSTQE

SEQ ID NO: 2944 - protein, 179 aa, Glycine max
  unsure (1)..(179): unsure at all Xaa locations
MSRVYVGNLDSRVTERDLEDEFRVFGVIRSVWVARRPPGYAFIDFDDRRDAQDAIRELDGKNGWRVELSHNSRGGGGGRGGRSGGSDLKCYECGEPGHFARECRMRGGSGRRRSRSPPRFRXRSPSYGRRSYSPRGRSPRHRSLSPRGRSYSRSPPYRGREEVPYANGNGLRERRRSRS

SEQ ID NO: 2945 - protein, 311 aa, Glycine max; identical to SEQ ID NO: 695

SEQ ID NO: 2946 - protein, 537 aa, Glycine max
  unsure (1)..(537): unsure at all Xaa locations
MRRTGLLHLLCLVIALVSVQAEDAYKYYTWTVTYGTISPLGSPQQVILINGQFPGPRLDLVTNENVILNLINKLDEPFLLTWNGIKQRKNSWQDGVLGTNCPIPPNSNYTYKFQAKDQIGTYTYFPSTQLHKAAGGFGALNVYHRSVIPIPYPNPDGDFTLLVGDWYKTNHKTLRQTLESGKPLAFPDGLLINGQAHSTFTGNPGKTYMFRISNVGFSTSINFRIQGHTLKLVEVEGSHTVQNLYDSLDVHVGQSVAVLVTLNQPPKDYYIVASTRFTETPLTTTAVLHYANSFSSALGPVPAPPVDKYDFDWSMKQARTYRWNLTANAARPNPXGSFHYGKITPTKVIKLANSAPLINGKLRYAVNSVSYVNPDTPLKLADYFNIPGIFSVNLLQNSPSNGPGYIGTSVLQTSLHDFIEVIFQNNENTMQSWHLDGYDFWVIGHGFGQWTDASRKTYNLVDALTRHTTQVYPKSWTTILVSLDNQGMWNLRSAIWERQYLGQQFYLRVWDAQKSLANEYDIPNNVLLCGKAVGHHP

SEQ ID NO: 2947 - protein, 540 aa, Glycine max
  unsure (1)..(540): unsure at all Xaa locations
MGSTGLLHLICLVIALVSVSLVQAEDAYKYFTWTVTYGTLYPLASPQQVILINGQFPGPRLDLVTNENVILNLINKLDEPFLLTWNGIKQRKNSWQDGVLGTNCPIPPNSNYTYKFQAKDQIGTYTYFPSTQLHKAAGGFGALNVYHRSVIPIPYPNPDGDFTLLVGDWYKTNHKTLRQTLDSGKSLAFPDGLLINGQAHSTFTGNQGKTYMFRISNVGLSTSINFRIQGHTLKLVEVEGSHTVQNLYDSLDVHVGQSVAVLVTLNQPPKDYYIVASTRFTETPLTTTAVLHYANSFSSALGPVPAPPVDKYDFDWSMXKARTYRWNLTANAARPNPQGSFHYGKITPTKVIKLANSAPLINGKLRYAVNSVSYVNPDTPLKLADYFNIPGVFSVNLLQNSPSNGPGYIGTSVLQTSLHDFIEVIFQNNENTMQSWHLDGYDFWVIGHGFGQWTDASRKTYNLVDALTRHTAQVYPKSWTTILVSLDNQGMWNLRSAIWERQYLGQQFYLRVWNAQKSLANEYDIPNNVLLCGKAVGHHP

SEQ ID NO: 2948 - protein, 346 aa, Glycine max
  unsure (1)..(346): unsure at all Xaa locations
MCGGAIISDFIPAAAIAGSRRLTADYLWPDLKKRKSDLDVDFEADFRDFKDDSDIDDDDDDHQVKPFAFAASSRLSTAAKSVAFQGRAEISANRKRKNQYRGIRQRPWGKWAAEIRDPRKGVRVWLGTFNTAEEAARAYDAEARRIRGKKAKXNFPEAPGTSSVKRSKVNPQENLKTVXQPNLGHKFSAGNNHMDLVEQKPLVSQYANMASFPGSGNGLRSLPSSDDATLYFSSDQGSNSFDYAPEISSMLSAPLDCESHFVQNANQQQPNSQNVVSIEDDSAKTLSEELVDIESELKFFQMPYLEGSWGDTSLESLLSGDTTQDGGNLMNLWCFDDIPSMAGGVF

SEQ ID NO: 2949 - protein, 367 aa, Glycine max
MSKPLLGIGEEEGQSNVTLLVSSSVIMESVCLNSSKLKERNYMGLSDCSSVDSSAPSFSDETKSNLNLKATELRLGLPGLQSPERDSDLCLRSSIQFDEKPLFPLHPATDDHHSSSKPAVLGNKRGFSDVMSGFAEEKLLVSSEVNTILSPRPSSNVALKPSSMLENVGAQQSKAKELATAKVGLERSHVFNDSRTNLNDSANNNSSAPATKAQVVGWPPIRSFRKNSLATTTKNVEEVDGKAGSGALFVKVSMDGAPYLRKVDLKNYSAYAELSSALENMFSCFTIGSCGSHGNLGGEVLNETKLKDLLHGSEYVLTYKDKDGDWMLVGDVPWEMFIETCKRLRIMKSSEAIGLAPRAVEKSKRRN

SEQ ID NO: 2950 - protein, 371 aa, Glycine max
  unsure (1)..(371): unsure at all Xaa locations
MAGVNPNGVADFPATPTHGGQFIQYNIFGNLFEVTAKYRPPIMPVGRGAYGIVCSLLNTETNELVAVKKIANAFDNHMDAKRTLREIKLLRHLDHENVIGLRDVIPPPLRREFNDVYIATELMDTDLHHIIRSNQNLSEEHSQYFLYQILRGLKYIHSANVIHRDLKPSNLLLNSNCDLKIIDFGLARPTVESDFMTEYVVTRWYRAHDLLMNSSDYTSAIDVWSVGCIFMELMNKKPLFPGKDHVHQMRLLTELXGTPTEADLGLVKNEDARRYIRQLPQYPRQPLXQXFPHVHXXAXDXVDKMXTVDPTKRITVEEALAHPYLEKLHDVADEPICMEPXSFDFEQXQXDEEQIKEMIYREALALNPEYA

SEQ ID NO: 2951 - protein, 371 aa, Glycine max
MAGVNPNGVADFPATPTHGGQFIQYNIFGNLFEVTAKYRPPIMPVGRGAYGIVCSLLNTETNELVAVKKIANAFDNHMDAKRTLREIKLLRHLDHENVIGLRDVIPPPLRREFNDVYIATELMDTDLHHIIRSNQNLSEEHSQYFLYQILRGLKYIHSANVIHRDLKPSNLLLNSNCDLKIIDFGLARPTLESDFMTEYVVTRWYRAPELLLNSSDYTSAIDVWSVGCIFMELMNKKPLFPGKDHVHQMRLLTELLGTPTEADLGLVKNEDARRYIRQLPQYPRQPLAQVFPHVHPAAIDLVDKMLTVDPTKRITVEEALAHPYLEKLHDVADEPICMEPFSFDFEQQQLDEEQIKEMIYREALALNPEYA

SEQ ID NO: 2952 - protein, 384 aa, Glycine max
  unsure (1)..(384): unsure at all Xaa locations
MAGVNPNGVADFAAVPTHGGQFIQYNIFGNLFEVTTKYRPPIMPIGRGAXYGIVCSLLNTETNELVAVKKIANAFDNHMDAKRTLREIKLLRHLDHENVIGLRDVIPPPLRREFNDVYIATELMDTDLHHIIRSNQNLSEEHCQYFLYQILRGLKYIHSANVIHRDLKPSNLLLNSNCDLKIIDFGLARPTLESDFMTEYVVTRWYRAPELLLNSSDYTSAIDVWSVGCIFMELMNKKPLFPGKDHVHQMRLLTELLGTPTEADLGLVKNEDARRYIRQLPQYPRQPLAQVFPHVHPXAIDLVDKMLTVDPTKRITVEEALAHPYLEKLHDVADEPICMEPFSFDFEQQQLDEEQIKEMIYREALALNPAVCLKQKTQGLEASI

SEQ ID NO: 2953 - protein, 1084 aa, Glycine max
MEASAGMVAGSHKRNELVRIRHDSSDSGSKPMKNLNGQICQICGDTVGLTATGDVFVACNECAFPVCRPCYEYERKDGNQSCPQCKTRYKRHRGSPRVEGDEDEDDSDDIENEFNYAQGKAKARRQWEDDPDLSSSSRRESQQPIPLLTNGQTMSGEIPCATPDTQSVRTTSGPLGPSEKVHSLPYVDPRQPVPVRIVDPSKDLNSYGLGNVDWKERVEGWKLKQEKNMVQMTGRYAEGKGGDVEGTGSNGEELQMVDDARQPMSRVVPIPSSQLTPYRVVIILRLIILGFFLQYRVTHPVKDAYPLWLTSVICEIWFALSWLLDQFPKWSPINRETYLERLALRYDREGEPSQLDPVDVFVSTVDPLKEPPLVTANTVLSILSVDYPVDKVSCYVSDDGSAMLTFEALSETAEFAKKWVPFCKKHNIEPRAPEFYFAQKIDYLKDKIQPSFVKERRAMKREYEEFKVRINALVAKAQKMPEEGWTMQDGTPWPGNNPRDHPGMIQVFLGHSGGLDTDGNELPRLVYVSREKRPGFQHHKKAGAMNALIRVSAVLTNGAYLLNVDCDHYFNNSKALKEAMCFMMDPVLGKKTCYVQFPQRFDGIDLHDRYANRNIVFFDINMKGQDGVQGPVYVGTGCCFNRQALYGYDPVLTEEDLEPNIIVKSCCGSRKKGKGGNKKYSDKKKAMGRTESTVPIFNMEDIEEGVEGYDDERTLLMSQKSLEKRFGQSPVFIAATFMEQGGIPPSTNPATLLKEAIHVISCGYEDKTEWGKEIGWIYGSVTEDILTGFKMHARGWISIYCMPPRPAFKGSAPINLSDRLNQVLRWALGSIEIFLSRHCPLWYGYNGKLKPLMRLAYINTIVYPFTSIPLIAYCTLPAFCLLTNKFIIPEISNFASMWFILLFVSIFTTSILELRWSGVSIEDWWRNEQFWVIGGTSAHLFAVFQGLLKVLAGIDTNFTVTSKASDEDGDFAELYVFKWTSLLIPPTTVLIVNLVGIVAGVSYAINSGYQSWGPLFGKLFFAIWVIAHLYPFLKGLLGRQNRTPTIVIVWSVLLASIFSLLWVRIDPFTSDSNKLTNGQCGINC

SEQ ID NO: 2954 - protein, 287 aa, Glycine max
MAIQDQNGFFRSQGGPPEEGGVSLSSGHSVTHIQLNDQFSCGNDYALKVRKPYTITKQRERWTDEEHKKFLEALKLYGRAWRRIEEHVGTKTAVQIRSHAQKFFSKVLHDPTGNNTNTVESIEIPPPRPKRKPMHPYPRKLVETPNKEISIPEQPMKSNSLKSSDFDQENQSPKSVLSGVGSDSLGSSDSDTPNGSLSPMSSISGFHTSSFTRAKPKTTTSEEEAGMDTDSTHDEKPLMKFKLPPNGCVSIKEDNTAEESSGRTFKLFGMTLFVTDTCKPSPTIEEC

SEQ ID NO: 2955 - protein, 272 aa, Glycine max
MSDLEAPLRPKRKKVWVDYFVQFRWILVIFVVLPISFTIYFLTYLGDVRSEWKSYKTRQKEHDENVKKVIKRLKQRNPSKDGLVCTARKPWIAVGMRNVDYKRARHFEVDLSAFRNVLEIDKERMIARVEPLVNMGQISRVTVPMNLSLAVVAELDDLTVGGLINGYGIEGSSHKYGLFADTVVAYEIILADGTLVRATKDNEYSDLYYAIPWSQGTLGLLVAAEIKLIPVKEYMKLAYKPVVGTLQDLAQAYCDSFAPRDGDQDNEEKVPD

SEQ ID NO: 2956 - protein, 567 aa, Glycine max
MSDLEAPLRPKRKKVWVDYFVQFRWILVIFVVLPISFTIYFLTYLGDVRSEWKSYKTRQKEHDENVKKVIKRLKQRNPSKDGLVCTARKPWIAVGMRNVDYKRARHFEVDLSAFRNVLEIDKERMIARVEPLVNMGQISRVTVPMNLSLAVVAELDDLTVGGLINGYGIEGSSHKYGLFADTVVAYEIILADGTLVRATKDNEYSDLYYAIPWSQGTLGLLVAAEIRLIPVKEYMKLTYKPVVGTLQDLAQAYCDSFAPRDGDQDNEEKVPDFVEGMIYTPTEGVMMTGRYASKEEAKKKGNKINSVGWWFKPWFYQHAQTALKKGEFVEYIPTREYYHRHTRCLYWEGKLILPFADQFWFRYLFGWLMPPKVSLLKATQGDAIRNYYHEMHVIQDMLVPLYKVGDALEWVHREMEVYPIWLCPHKLFKLPVKTMIYPEPGFELHRRQGDTQTAQMYTDVGVYYAPGPVLRGEVFDGAEAVRKMENWLIENHGFQPQYAVSELSEKNFWRMFDAGLYEHTRRKYGAVGTFMSVYYKSKKGRKTEKEVQEAEQAHLETAYAEVDQPVD

SEQ ID NO: 2957 - protein, 310 aa, Glycine max
MSDLEAPLRPKRKKVWVDYFVQFRWILVIFVVLPISFTIYFLTYLGDVRSEWKSYKTRQKEHDENVKKVIKRLKQRNPSKDGLVCTARKPWIAVGMRNVDYKRARHFEVDLSAFRNVLEIDKERMIARVEPLVNMGQISRVTVPMNLSLAVVAELDDLTVGGLINGYGIEGSSHKYGLFADTVVAYEIILADGTLVRATKDNEYSDLYYAIPWSQGTLGLLVAAEIRLIPVKEYMKLTYKPVVGTLQDLAQAYCDSFAPRDGDQDNEEKVPDFVEGMIYTPTEGVMMTGRYASKEEANKKGNNINTAGWR

SEQ ID NO: 2958 - protein, 368 aa, Glycine max
MATLVEPPNRIKPKGKHYYTIWQTLFEIDTKYVPIKPIGRGAYGVVCSSINRETNEKVAIKKIGNIFENSIDALRTLRELKLLRHIRHENVIALKDVMMPIHRTSFKDVYLVYELMDTDLHQIIKSSQPLSNDHCKYFLFQLLRGLKYLHSANILHRDLKPGNLLVNANCDLKICDFGLARTNGVDGQFMTEYVVTRWYRAPELLLCCDNYGTSIDVWSVGCIFAEILGRKPIFPGTECLNQLKLIISVLGSQHESHLEFIDNAKARRFIKSLPCTRGRHFSQLYPQADPLAIDLLQKMLLFDPTKRITVLEALQHPYMAGLYDPRCNPPAQVPISLDIDEHWGEPMIREMMWNEMLHYHPEAASTNA

SEQ ID NO: 2959 - protein, 297 aa, Glycine max
  unsure (1)..(297): unsure at all Xaa locations
MATLVEPPNRIKPKGKHYYTIWQTLFEIDTKYVPIKPIGRGAYGVVCSSINRETNEKVAIKKIGNIFENSIDALRTLRELKLLRHIRHENVIALKDVMMPIHRTSFKDVYLVYELMDTDLHQIIKSSQPLSNDHCKXYFLFQLLRGLKYLHSANILHRDLKPGNLLVNANCDLKICDFGLARTNGVDGQFMTEYVVTRWYRAPELLLCCDNYGTSIDVWSVGCIFAEILGRKPIFPGTECLNQAELNISVLGSPHESXLSLFDNAKSQGGLSKYLPLSLGAETFFXTFPPQAEPLAL

SEQ ID NO: 2960 - protein, 366 aa, Glycine max
  unsure (1)..(366): unsure at all Xaa locations
MQLLQKLAGQSYLVSRLSPNFNSGNYSSTGSYFNGGLHSSGLAVVSPGSPVTVHAPAEKGVSGFLVDFLMGGVSAAVSKTAAAPIERVKLLIQNQDEMIKSGRLSEPYKGIGDCFARTMKDEGXIALWRGNTANVIRYFPTQALNFAFKDYFKRLFNFKKDKDGYWKWFAGNLASGGAAGXASSLLFVYSLDYARTRLANDAKAAKKGGERQFNGLVDVYRKTIKSDGVAGLYRGFNISCVGIIVYRGLYFGMYDSLKPVVLVGGLQDSFFASFLLGWGITIGAGLASYPIDTVRRRMMMTSGEAVKYKSSLHAFQTIVANEGAKSLFKGAGANILRAVAGAGVLAGYDKLQLVLFGKKYGSGGGG

SEQ ID NO: 2961 - protein, 373 aa, Glycine max
  unsure (1)..(373): unsure at all Xaa locations
MADGPQHPSVVQKLAGQSYLVSRLSPNFNSRNYSATGSYVNGGMHSPGLAVVSPVSPVTVHAPAEKGVSGFLVDFLMGGVSAAVSKTAAAPIERVKLLIQNQDEMIKSGRLSEPYKGIGDCFARTMKDEGVIALWRGNTANVIRYFPTQALNFAFKDYFKRLFNFKKDKDGYWKWFAGNLASGGAAGASSLLFVYSLDYARTRLANDAKAAKKGGERXQFNGLVDVYRKTXIKSDGVAGLYRGFNISCVGIIVYRGLYFGMYDSLKPVVLVGGLQDSFFASFLLGWGITIGAGLASYPIDTVRRRMMMTSGEAVKYKSSLHAFQTIVANEGAKSLFKGAGANILRAVAGAGVLAGYDKLQLILFGKKYGSGGG

SEQ ID NO: 2962 - protein, 596 aa, Glycine max
  unsure (1)..(596): unsure at all Xaa locations
MTMEEGRVENEDYTQDGTVNIKGKPILRSKSGGWKACSFVVVYEVFERMAYYGISSNLILYLTTKLHQGTVSSANNVTNWVGTIWMTPILGAYIADAFLGRYWTFVIASTVYLSGMSLLTLAVSLPSLKPPQCFEKDVTKCAKASTLQLAVFYGALYTLAVGTGGTKPNISTIGADQFDDFHPKEKLHKLSFFNWWMFSIFFGTLFANSVLVYIQDNVGWTLGYALPTLGLLVSIMIFVAGTPFYRHKVPAGSTFTRMARVVVAALRKSKVPVPSDSKELYDXELDKEEYAKKGSYRIDHTPTLKFLDKACVKTDSNTSPWTLCTVTQVEETKQMIRMIPILVATFVPSTMMAQINTLFVKQGTTLDRHLGSFKIPPASLAAFVTVSLLVCIVLYDRFFVKIMQRFTKNPRGITLLQRMGIGLVIHTLIMIIASGTESYRLKVAREHGVVESGGQVPLSIFILLPQFILMGTADAFLEVAKIEFFYDQSPEHMKSIGTSYSTTTLGLGNFISSFLLSTVSNVTKKNGHKGWILNNLNESHLDYYYAFFAILNFLNLIFFAYVTRYYVYRVEVSDSIDKLAKELKEKTVSNVVNPKD

SEQ ID NO: 2963 - protein, 400 aa, Glycine max
  unsure (1)..(400): unsure at all Xaa locations
MTMEEGRVENEDYTQDGTVNIKGKPILRSKSGGWKACSFVVVYEVFERMAYYGISSNLILYLTTKLHQGTVSSANNVTNWVGTIWMTPILGAYVADAFLGRYWTFVIASTIYLSGMSLLTLAVSLPSLKPPECFVKDVTKCAKAFTLQLAVFYGALYTLAVGTGGTKPNIFTIGADQFDDFHPKEKLHKLXPSFNWWMFSIFFWDTLCKTGAXVYIQDNVGWTLGYALPTLGLLVSIMIFVAGTPFYRHKVPAGSTFTRMARVVVAALRKSKVPVPSDSKELYELDKEEYAKKGSYRIDHTPTLKFLDKACVKTDSNTSPWTLCTVTQVEETKQMIRMIPILVATFVPSTMMAQINTLFVKQGTTLDRHLXSFKIPPASLAAFVTVALLVCIGLYDRFFV

SEQ ID NO: 2964 - protein, 576 aa, Glycine max
  unsure (1)..(576): unsure at all Xaa locations
MTMEEGRVENEDYTQDGTVNIKGKPILRSKSGGWKACSFVVVYEVFERMAYYGISSNLILYLTTKLHQGTVSSANNVTNWVGTIWMTPILGAYIADAFLGRYWTFVIASTVYLSGMSLLTLAVSLPSLKPPQCFEKDVTKCAKASTLQLAVFYGALYTLAVGTGGTKPNIFTIGADQFDDFHPXEKLHKLSFFNWWMYSIFFGTLFAKSVLVYIQDNVGWTGGYARRKRIKSVKSFKTTFCTHLDRPRSTXGGTVGGVCMFTVEWFWSLEVTSEENSKQLNTIRAGRXNKQRKVSYRIDHTQISKFLDKACMKTDSNTSPWTLCTVTQVEETKQMIRMIPILVATFVPSTMMAQINTLFVKQGTTLDRHLGSFKIPPASLAAFVTVSLLVCIVLYDRFFVKIMQRFTKNPRGITLLQRMGIGLVIHTLIMIIASGTESYRLKVAREHGVVESGGQVPLSIFILLPQFILMGTADAFLEVAKIEFFYDQSPEHMKSIGTSYSTTTLGLGNFISSFLLSTVSNVTKKNGHKGWILNNLNESHLDYYYAFFAIXKLPQPHLLRVCXLGSMYIELKFQIP

SEQ ID NO: 2965 - protein, 298 aa, Glycine max
WIFTAAGPEFQLHSDPFRGELMEVLEPFMKSPSPNYFPSSPSLPNLYSNGLSSNTQSLIGFGQAQPTSLVGLNHLTPSQISQIQAQIQIQAQQHQNHSNTLSFLGPKPIPMKHAGMPPKPTKLYRGVRQRHWGKWVAEIRLPKNRTRLWLGTFDTAEEAALAYDKAAYKLRGDFARLNFPNLRHQGSSVGGDFGEYKPLHSAVDAKLQAICEGLAELQKQGKTEKPPRKSRSKLAEKVVSDKENNNSCKVEAASWSSEGSSPLSDLTFADVSEAQWEGDSDNYNLQKYPSYEIDWDSL

SEQ ID NO: 2966 - protein, 310 aa, Glycine max
  unsure (1)..(310): unsure at all Xaa locations
WIFTASSTEFQFHSDPFRGELMEVLEPFMKSPFSTPSPSNSCFLSTSYSPSPNNYSPSLYSNGLSSIPNTTQNLIGFGQGQPTSLVGLNHLTPSQISQIQAQIQIQNHSNTLSFLGPKPIPMKHVGMPPKPTKLYRGVRQRHWGKWVAEIRLPKNRTRLWLGTFDTAEEAALAYDKAAYKLRGDFARLNFPNLRHQGSSVGGDFGEYKPLHSAVDAKLQAICXALAELQKQGKTEKPPRKTRSKLASPPENDNNNDNNSCKVEAASSSSEGSSPLSVLTFADVSEPQWEGDSDNFNLQKYPSYEIDWDSL

SEQ ID NO: 2967 - protein, 471 aa, Glycine max
  unsure (1)..(471): unsure at all Xaa locations
MATAAEKLSALKSAVAGLNEISENEKNGFIXLVGRYLSGEAQHVXWSKIQTPTDEVVVPYDTLAPTPEGSSEVKNLLDKLVVLKLNGGSGTTMGCTGPKSVIEVRDGLTFLDLICIQIENLNSKYGSNGPLLLMNSFNTHDDTQKXIVEKYQNSNIEIHTFNQSQYPRLVVEDFLPLPSKGHTDKDGWYPPGHGDVFPSLLNSGKLDALLSQGKEYVFVANSXDTWGAIVDLKILNHLIQNKNEYCMEVTPKTLADVKGGTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARENPENPSIELGPEFKKVSNFLGRFKSIPSIVELDSLKVAGDVWFGAGVILKGKVSIVSKPGVKLEVPDGVAIVDKEINGPEDL

SEQ ID NO: 2968 - protein, 472 aa, Glycine max
  unsure (1)..(472): unsure at all Xaa locations
MATAAEKLSALKSAVAGLNEISENEKNGFISLVGRYLSGEAQHVEWSKIQTPTDEVVVPYDTLAPTPEGSSEVKNLLDKLVVLKLNGGLGTTMGCTGPKSVIEVRDGLTFLDLIVIQIENLNSKYGSNVPLLLMNSFNTHDDTQKIVEKYQNSNIEIHTFNQSQYPRLVVEDFLPLPSKGHTXTKDGWYPPGHGDVFPSLLNSGKLDALLSQGKEYVVCCQFRXLGMHIVDLKILNHLIQNKNEYCMEVTPKTLADVKGGTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARENPENPSIELGPEFKKVSNFLGRFKSIPSIVELDSLKVAGDVWFGAGVILKGKISIVANPGVKLEVPDGAVISDKEINGPEDLL

SEQ ID NO: 2969 - protein, 515 aa, Glycine max
  unsure (1)..(515): unsure at all Xaa locations
RQDVHPNSPSCLLFIDGDWKVPVLKNRIPIINPSTQHIIXGDIPAATKEDVDLAVAAAKAALSRNKGADWASASGSVXRARYLRAIAAKITEKKPELAKLEAIDCGKPLDEAAWDIDDVAGCFEFYADLAEKLDAQQKAHVSLPMDTFKSYVLKEPIGXVVALITPWNYXLLMATWXKVAPALAAGCACNIXKPSELASVTXLELAEICKEVGLPPGVLNILTGLGPEAGXAPLAAHXNVDKISFTGSSATGSRIMTAAAQLTKPVSLELGGKSPIIVFEDVDLDKTAEWTIFGCFFTNGQICSATSRLIVHESIATEFVNRLVQWAKNIKXISDPFEEGCRLGPIVSEGQYKKVLNCISTAKSEGATILIGGSRPXEHLKKGYFVEPTIITDVTTSMQIWREEVFGPVLCVKTFSTEEEAIELANDTHYGLGSAVMSKDLERCEXRISKAIQAGIVWINCAQPSFIQAPWGGVKRSGFGRELGEWGLENYLSVKQVTKYISDEPWGWYQSPSKL

SEQ ID NO: 2970 - protein, 224 aa, Glycine max
  unsure (1)..(224): unsure at all Xaa locations
MCGGAIISDFIGVKRGRNLAAQELWSELDPFSDLLGFDTTTTTTNQPPLPDKKVVSSCEKKKKKSVSAEKKSGGRARKNVYRGIRQRPWGKWAAEIRDPHKGXSRVWLGTFPTAEEAARAYDDAAKRIRGDKAKLNFPATAPPPSKKQRCLSPDTTTEQSSSSQSTTGSTGSPPSAAFHGGGDELDLKQLERFLGLDNMGAEWDNMDDLWMLDDVVVPNRHLIY

SEQ ID NO: 2971 - protein, 223 aa, Glycine max
MCGGAIISDFIGVKRGRNLAAQELWSELDPFSDLLGFDTTTTTTNQPPLPDKKVVSSCEKKKKKSVSAEKKSGGRARKNVYRGIRQRPWGKWAAEIRDPHKGVRVWLGTFPTAEEAARAYDDAAKRIRGDKAKLNFPATAPPPSKKQRCLSPDTTTEQSSSSQSTTGSTGSPPSAAFHGGGDELDLKQLERFLGLDNMGAEWDNMDDLWMLDDVVVPNRHLIY

SEQ ID NO: 2972 - protein, 237 aa, Glycine max
MCGGAIISDFIGVKRGRNLAAQELWSELDPFSDFLGFDTTNSKNQPPLQKIPDKKVVSSCEKKKKSVVGAEKKKSDSGRARKNVYRGIRQRPWGKWAAEIRDPHKGVRVWLGTFPTAEEAAQAYDDAAIRIRGDKAKLNFPATTISAAAAPPPSKKQRCLSPDIITEESSSSSSHSTTGSTGESGGGNDELDLKQIEWFLGLENELPVSNNIGAEWDNMDDLWMLDDVVVPNRHLIY

SEQ ID NO: 2973 - protein, 270 aa, Glycine max
  unsure (1)..(270): unsure at all Xaa locations
MAGSSINRGERWSLNGMTALVTGGTRGIGHSIVSDLAAFGAAVHTCSRTQTELNKCLQEWQSQGFQVTGSLCDVSSPPQREKLIQEVASTFNGKLNIYVNNVGINIRKPTIEYTAEEYSQIMTVNLDSSFHLCQXAYPLLKASEKGSIVFISSVAGVVSLGTGAVYAASKAAINQLTKNLACEWAKDNIRSNCVVPWATRTPLVEHLLRDQKFVDDIMSRTPIKRIAEPEEVSSLVTFLCLPAASYITGQVICVDGGLTVNGFQPSMRIT

SEQ ID NO: 2974 - protein, 155 aa, Glycine max
MASTKKITLKSSDGEAFEVEEAVALESQTIKHMIEDDCADSGIPLPNVTSKILAKVIEYCKKHVEANSADEKPSEDVLKAWDVDFVNVDQATLFDLILAANYLNIKSLLDLTCQTVADMIKGKTPEEIRKTFNIKNDFTPEEEEEVRRENQWAFE

SEQ ID NO: 2975 - protein, 156 aa, Glycine max
  unsure (1)..(156): unsure at all Xaa locations
MASTKKITLKSSDGRXFEVEEAVAVESQTIKHMIEDNCADSGIPLPNVTSKILAKVIEYCKKHVEANCADEKPSEDELKAWDADFVKVDQATLFDLILAANYLNIKSLLDLTCQTVADMIKGKTPEEIRKTFNIKNDFTPEXKREKVRRENQWAFE

SEQ ID NO: 2976 - protein, 507 aa, Glycine max
  unsure (1)..(507): unsure at all Xaa locations
MVLSKTASESDVSVHSTFASRYVRTSLPRFKMAEESIPKEAAYQIINDELMLDGNPRLNLASFVTTWMEPECDKLIMAAINKNYVDMDEYPVTTELQNRCVNMIAHLFNAPLEETEAAVGVGTVGSSEAIMLAGLAFKRKWQNRRKQEGKPYDKPNIVTGANVQVCWEKFARYFEVELKXEVKLRDDYYVMDPEKAVELVDENTICVAAILGXSTLNGEFEDVKRLNDLLIEKNKITGWEXTPIHVDAASGGFIAPFIYPELEWDFRLQLVKSINVSGHKYGLVYAGIGWVIWRSKQDLPEELIFHINYLGADQPTFTLNFSKGSSQVIAQYYQLIRLGFEGYRNVMENCRDNXLVLKEGLEKTGRFSIVSKDNGVPLVAFTLKDHTHFDEFQISDFLRRFGWIVPAYTMPPDAQHVTVLRVVIREDFSRTXLAERLVSDVEKVLHELDSLPARVISSTTVTLSAEENGKVVVAKKNPMETQREITAIWKKFVLERKKNNDKMNGVC

SEQ ID NO: 2977 - protein, 506 aa, Glycine max
  unsure (1)..(506): unsure at all Xaa locations
MVLSKTTSESDVSVHSTFASRYVRTSLPRFKMPEESIPKEAAYQIINDELMLDGNPRLNLXASFVTTWMEPECDKLIMAAINKNYVDMDEYPVTTELQNRCVNMIAHLFNAPLEETEAAVGVGTVGSSEAIMLAGLAFKRKWQNRRKQEGKPFDKPNIVTGANVQVCWEKFARYFEVELKEVKLRDDYYVMDPEKAVELVDENTICVAAILGSTLNGEFEDVKRLNDLLIEKNKITGWDTPIHVDAASGGXFIAPFLYPELEWDFRLPLVKSINVSGHKYGLVYAGIGWVIWRSKEDLPEELIFHINYLGADQPTFTLNFSKGSSQVIAQYYQLIRLGFEGYRNVMENCRDNMLVLKEGLEKTGRFSIVSKDNGVPLVAFTLKKDHTHFDEFQISDFLRRFGWIVPAYTMPPDAQHVTVLRVVIREDFSRTLAERLVADVEKVLHELDSLPARVISSTSVTVTAEENGKVVVAKKSAMETQREITAIWKKFVLERKKNNDKMNGVC

SEQ ID NO: 2978 - protein, 802 aa, Glycine max
  unsure (1)..(802): unsure at all Xaa locations
NPSPPIHIHSLIPFLLPFPLFTITLSLSPSLSSIMGAVILPDLGTEILIPVCAIIGIAFALFQWVLVSKVKLSAARDASSNAGGGKNGYNDYLIEEEEGLNDHNVVLKCAEIQNAISEGATSFLFTEYKYVGIFMVAFAILIFLFLGSXEGFSTSYQPCTYDQTKMCKPALATAVFSTISFLLGGVTSLISGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPXNPAVIADNVGDNVGDIAGMGSDLFGSYAESSCAALVVASISSFGVNHELTAMLYPLIISSVGIXLVCLLTTLFATDFXSIKAVKEIEPALKKQLIISTALMTIGIAIVSWIALPTSFTIFNFGVQKDVKNWQLFLCVAVGLWAGLIIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRAAITTVDVLTPKVFIGLIVGAMLPYWFSAMTMKSVGSAALKMVEEVRRQFNTIPGLMEGTAKPDYATCVKISTDASIKEMIPPGALVMLTPLVVGILFGVETLSGVLAGSLVSGVQIAISASNTGGAWDNAKKYIEXAGASEHARSLGPKGSDCHKAAVIGDTIGDPLKDTSGPSLNILIKLMAVESLVFAPFFATHGGLLFKI

SEQ ID NO: 2979 - protein, 769 aa, Glycine max
  unsure (1)..(769): unsure at all Xaa locations
MGAVILPDLGTEILIPVCAIIGIGFALFQWVLVSKVKLSAARDASPNAAGKNGYNDYLIEEEEGLNDHNVVLKCAEIQNAISEGATSFLFTEYKYVGIFMVAFAILIFLFLGSVEGFSTSYQPCTYDQTKMCKPALATAVFSTISFLLGGVTSLISGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGVNHELTAMLYPLIISSVGILVCLLTTLFATDFFEIKAVKEIEPALKKQLIISTALMTIGIAIVSWIALPTSFTIFNFGVQKDVKNWQLFLCVAVGLWAGLIIGFVTEYYTSNAYSPVQDVADSCRTGAATNVIFGLALGYKSVIIPIFAIAISIFVSFTFAAMYGIAXVAALGMLSTIATGLAIDAYGPISDNAGGIAEMAGMSHRIRERTDALDAAGNTTAAIGKGFAIGSAALVSLALFGAFVSRAAITTVDVLTPKVFIGLIVGAMLPYWFSAMTMKSVGSAALKMVEEVRRQFNTIPGLMEGTAKPDYATCVKISTDASIKEMIPPGALVMLTPLVVGILFGVETLSGVLAGSLVSGVQIAISASNXTGGAWDNAXKKYIEAGASEHARSLGPKGSDCHKAAVIGDTIGDPLKDTSGPSLNILIKLMXAVESLVFAPFFATHGGLLFKI

SEQ ID NO: 2980 - protein, 166 aa, Glycine max
  unsure (1)..(166): unsure at all Xaa locations
YLVAEHAAANNKIFMMNLSAPFICEFFKGALDKVLPYMDYVFGNETEARTFSKAQGWETDNVEEIALKISQLPKASEKHKRITVITQGADPVCVTEDGKVKLYPVILLPKEKLIDXNGAGDAFVGGFLSQLVKQKPIEECVRAGCYAANVIIQRPGCTYPEKPDFH

SEQ ID NO: 2981 - protein, 341 aa, Glycine max
MELDGVLLGMCNPLLDISAVVDDAFLQKYGIKLNDAILAEDKHKPMYEELANNPNVEYIAGGATQNSIRVAQWMLQAPGATSYIGCIGKDKFGEEMKKKCTLDGVKVNYYEIDNTPTGTCAVCVVGGERSLVANLSAANCYKSEHLTRPENWALVEKAKYFYISGFFLTVSPDSIQLVAEHAAANNKFFMMNLSAPFICEFFKDALNKVLPYMDYVFGNETEARTFSKAQGWETDNVEEIALKISQLPKASETHKRITVITQGADPVCVAEDGKVKIYPVIPLPKEKLVDTNGAGDAFVGGFLSQLVKHKPIEECIRAGCYAANVIIQRPGCTYPPTPDFH

SEQ ID NO: 2982 - protein, 389 aa, Glycine max; identical to SEQ ID NO: 2095

SEQ ID NO: 2983 - protein, 368 aa, Glycine max
  unsure (1)..(368): unsure at all Xaa locations
MATLVEPPNRIKPKGKHYYTIWQTLFEIDTKYVPIKPIGRGAYGVVCSSINRETNEKVAIKKIGNIFENSIDALRTLRELKLLRHIRHENVIALKDVMMPIHKTSFXDVYPVYELMDTDLHQIIKSSQPLSNDHCKYFLFQLLRGLKYLHSANILHRDLKPGNLLVNANCDLKICDFGLARTNGVDGQFMTEYVVTRWYRAPELLLCCDNYGTSIDVWSVGCIFAEILGRKPIFPGTECLNQLKLIISVLGSQHESHLEFIDNAKARRFIKSLPCTRGRHFSQLYPQADPLAIDLLQKMLVFDPTKRITVLEALQHPYMASLYDPRCDPPAQVPISLDIDEHWGEPMIREMLWNEMLHYHPEAASTNA

SEQ ID NO: 2984 - protein, 270 aa, Glycine max
FEEGRGFFVKIIYSGGVDLDVLPKGAGKGQALAYLLKKFETEGKPPVNTLVCGDSGNDAELFSIPGVYGVMVSNAQEELLQWHAENAKDNPKILHASERCASGIIQAIGHFKLGLNLSPRDVSDIGQNVENGSPGLEMVNFSLLLESWRRAEVEKTELFISGLKATTLPSGFFIHPSGADHNIKEYVNILRKVHGDKQGKQFRIWVDDLLATPLGSDTWLVKFDKWELSGEERQGCVVTAIISKKDSDWFTWVHVHETWLENSEQGLWIL

SEQ ID NO: 2985 - protein, 484 aa, Glycine max
  unsure (1)..(484): unsure at all Xaa locations
MSTVGEGKVSSNGHGCCKSGPGYASPLEAISGPRESLIYVTSVYTGTGIEKPDYLATVDVDPNSPTYSKVIHRLPVPYLGDELHHTGWNSCSSCHGDPSADRRFLIVPALVSGRVYVVDVKTNPRAPSLHKVVEPADIIQKTGLAYPHTSHCLASGDIMISCLGDKDGNAAGNGFLLLDSEFNVKGRWEKPGHSPLFGYDFWYQPRHNTMISTXWGAPSAFTKGFNLQHLSDGLYGRHLHVYSWPGGELRQTMDLGDSGLIPLEIRFLHDPAKDTGFVGSALTSNMIRFFKTQDESWSHEVAISVKPLKVQNWILPEMPGLITDFLISLDDRFLYFVNWLHGDIRQYNIEDVKNPKLTGQVWVGGLIXKGSPVVAITDDGETWQAEVPEIQGNKLRGGPQMIQLSLDGKRLYATNSLFSTWDKQFYPELVQKGSHIIQIDVDTEKGGLKINPNFFVDFGTEPDGPSLAHEMRYPGGDCTSDIWI

SEQ ID NO: 2986 - protein, 263 aa, Glycine max
  unsure (1)..(263): unsure at all Xaa locations
MAAAPSPREENVYMAKLAEQAERYEEMVEFMEKVSAAADNEELTVEERNLLSVAYKNVIGARPRPRGRIISSIEQKEESRGNEDHVSVIRDYRSKIESELSNICDGILKLLDSRLIPSASSGDSKVFYLKMKGDYHRYLAEFKTGARXRRRRAESTLSAYKAAQDIANAELXPPTHPIRXLGLALNFSVFYYEILNSPDRACNLAKQAFDEAIAELDTLGEESYKDSTLIMQLLRDNLTLWTSDMQDDGADEIKEAAPKQDDQ

SEQ ID NO: 2987 - protein, 123 aa, Glycine max
DSIEQKEESRGNEDHVSVIRDYRAKIECELSNICDGVLKLLDSRLIPSASSGDSKVFYLKMKGDYHRYLAEFKTGAERKEAAESTLSAYKGAQDIANAELAPTHPIRLGLALNFSVFYYEILN

SEQ ID NO: 2988 - protein, 262 aa, Glycine max
  unsure (1)..(262): unsure at all Xaa locations
MAAAPSPREENVYMAKLAEQAERYEEMVEFMEKVSAAADNEELTVEERNLLSVAYKNVIGARRASWRIISSIEQKXEESRGNEDHVSVIRDYRSKIESELSNICDGILKLLDSRLIPSASSGDSKVFYLKMKGDYXRYLAEFKTGRRAVRRLAESTLSAYKAAQDIANGRTASYSCQLGLGLALNFSVFYYEILNSPDRACNLAKQAFDEAIAELDTLGEESYKDSTLIMQLLRDNLTLWTSDMQDDGADEIKEAAPKPDDQ

SEQ ID NO: 2989 - protein, 333 aa, Glycine max
  unsure (1)..(333): unsure at all Xaa locations
MLPSMDNTCPCMSDITQIIRKALIPCYCLYFPCIFCVSPNERATLHTNTDLVAMASAPTPREEFVYMAKLXAEQAERYEEMVEFMEKVSASAESEELTVEERNLLXSVAYKNVIGARRASWRIISSIEQKEESRXGNEDHVAVIRDYRSKIEAELSNICDGILKLLDTRLVPSAAXADSKVFYLKMKGDYPQXYLAEFKTGAXRKEARREHALPPYKAAQDIANTEXLPPTSPLSGLGLALNFSXVFYYEILNSXPDRGXGSLAKQAFDEAIAELDTLGEESYKDSTLIMQLLRDNLTLWTSDMQDDGADEIKEAAPKGCTGNKIKHTILSAY

SEQ ID NO: 2990 - protein, 318 aa, Glycine max
  unsure (1)..(318): unsure at all Xaa locations
QKQKHSTTNQSQPFGSPTNKIVTTTHLLLAASESLSLFLFLSHPDLAKKKKTQWAASAPTPREEFVYMAKLAEQAERYEEMVEFMXEKVSASAESEELTVEERNLLSVAYKNVIGARRASWRIISSIEQKEESRGNEDHVAVIRDYRSKIEAELSNICDGILKLLDTRLVPSAASXGDSKVFYLKMKGDYHRYLAEFKTGXADRKEAAESTLSAYKAAQDIANTELPPTHPIRLGLALNFSVFYYEILNSPDRACSLAKQAFDEAIAELDTLGEESYKDSTLIMQLLRDNLTLWTSDMQDDGADEIKEAAPKGDGEQN

SEQ ID NO: 2991 - protein, 536 aa, Glycine max
  unsure (1)..(536): unsure at all Xaa locations
MGSIPDPGELSELTQPSFDEFQRQTSLMTSCTLLWKELSDHFSSLEQDLNHKSEALKRKIHTLDNSTSDSLRLLDHRETSLDATLQIALRTLDTRRTAALSALLHDADDTSPDGEVDDTAGLVLKLKSFCLRMDAFGFFAFVSAKKKELDGLRAEMPVALAECVDPAKFVLEAISEVFPVXKRGEKAGHDLGWACVLVLESLIPVVVDPVIGKSRLLVTPTVKEHATEIAETWKSSLEDRGGVENLKTPDVHTFLQHVVTFGIVKNDDSDLYRKLVIASAWRKQMPKLALSLGLAQQMPDMIEELISKGQQLDAVHFTYEVGLVEKFPPVPLLKSFLKDAKKVAASILEDPNNAGRAAYLAARKEQSALRAVIKCIEEYKLEDEFPPENLKKRLDQLEKVKTEKRKPVAVPANKRTRASNGNGGPMPPAXKAGRLTNAYVSSFPAAPTFVRSPSHGQYPAALPPYPSPPHMYGSRSPPANPYAAYSPEPAPAIAGSYPAAPMNYPHAYGGYGNVLAPTYAAGLLPIEMTTFEDGNH

SEQ ID NO: 2992 - protein, 539 aa, Glycine max
  unsure (1)..(539): unsure at all Xaa locations
GWVDPDLVELTNSRSHFLIYRQSLIVSSPLPPLSFSSPVISQRRKAWALLVEKTTSGREYKVKDLSQADFGRLEIELXAEVEMPGLMACRTEFGPSQPLQRGPASPAPSHMTIQTAVLIETLTALGAEVRWCSCNIFSTQDHAAAAIARDSAAVFAWKXGETLQEYWXWCTERALXDWGXPGGGPDLIVDDGGDATLLIHEGVKXPRSLYEKTGELPDPNSTDNAEFQIVLTIIRXGLKTDPTRYRKMKERLVGVSEETTTGVKRLYQMQANGTLLFPAINVNDSVTKSKFDNLYGCRHSLPDGLMRATDVMIAGKVAVVXGYGDVGKGCAAAMKQAGARVIVTEIDPICALQALMEGLQVLTLEDVVSEADIFVTTTGNKDIIMVDHMRKMKNNAIVCNIGHFDNEIDMLGLENYPGVKRITXIKPQTDRWVFPETNTGIIVLAEGRLMNLGCATGHPSFVMSCSFTNQVIAQLELWKEKSTGKYEKKVYVLPKHLDEKVAALHLGKLGAKLTQLSKSQADYISVPVEGPYKPAHYRY

SEQ ID NO: 2993 - protein, 352 aa, Glycine max
  unsure (1)..(352): unsure at all Xaa locations
GSASRSPLLDDDFEAGFREFKDDSEIEDVDDEDDEDEEELKKKPFGFSRSSNKAASKPLSRGSATVESKGQAEKCAKRKRKNQYRGXRQRPWGKWAAEIRDPRKGVRVWLGTFSTAEEAARAYDAEARRIRGKKAKVNFPDEPXAPAASSKRLKVNPEAQPMKENLNTVKPKMNQMFNFGHNLEGYYSPIDQVEQKPLVNQYVNPAPFPGNGVQVSPVTPSADVTAYFSSEHSSNSFDYSDLGWGEQGPXKTPEISSLLSAAPLEGAADQVQKTNNSQDVVAAQDDSAKTLSEELADIESQLKFFETPSFLDEAWADATLASLLGGDATHDAAGNPMNLWSFDDLPSMAGVF

SEQ ID NO: 2994 - protein, 366 aa, Glycine max
  unsure (1)..(366): unsure at all Xaa locations
GSGSRSRCWHDDFEAGFREFEDDSEIEDVDDEDDEEEEELKKKKXFGFSRSNNKAASKPLSRGATTVKSVESKGQAXEKCAKRKRKNQYRGIRQRPWGKWAAEIRDPRKGXVRVWLGTFSTAXEEAARAYDAEARRIRGKKAKVNFPDEPXGAASSKRLKANPEGSXMKKNLNSVKPKINQMFNFGDNLEGYYSPIDQVEQKPLVNQYVNRAPFAGNGVQVSPVTPSADVTAYFSXSEHSSSSFDYSDLGWGEQVPKTPEISSMLSAAPLDGESQFVQGAADQNQKKNNLLDMXSVQDDSAKTLSEELADIESQLKFFETPSFLDEAWGXCWHWASLLSEDASQDAAGNPMNLWSFDDLPSMAGVF

SEQ ID NO: 2995 - protein, 184 aa, Glycine max
MEAKLWEARLFSPTLPLLPPTPRLPSLNLHFPSSSTSTLHLARNSVSDTVPIQNEEKEQTLSSVKPTYSPTLPNRDLRTPHSGYHFDGTTRKFFEGWYFKVSIPERRQSFCFMYSVESPSFRKPLTPLELAQYGPRFTGVGAQILGADDKYICQYSPQSQFFWGSTHFLSTLLCSFNFLYYFLE

SEQ ID NO: 2996 - protein, 193 aa, Glycine max
ITTGYGAAVITAGRGGVEKGSQVAIFGAGCVGLSVIQGAVKQGASKIIVVDVNDSKKEWAKKFGATDFVNPAKDLKEGENIQSRLIDMTDGGCDYTFDCTGNVHVMRSALEACHKGWGESIIIGVAAAGQEISTRPFQLVTGRVWKGCAFGGVKGRSQMGSLVQDYMDNKLKVDEFITHRQPLSGINDAFHDM

SEQ ID NO: 2997 - protein, 423 aa, Glycine max
MDPLCEFCRVVRAVVYCKSDSARLCLHCDGCVHSANSLSRRHSRSLLCDKCNSQPAMIRCMNHKLSLCQGCDWNPNDCSALGHRRLALNCYTGCPSLAEFSRLWSFVFDANSSLGGWESVGTLPKSESCTSQCLEQTDHNGGYFGLVSDKLDEIESCVRYQPRMDQSQIIPSNPNYTPYCKDEAFFFPQDSNQPKLQECPNLGIHDGNELCEGFNVDNVQLNFEIADEIFYCSQVATRYHLEDGGMDCLLMDKNIAVTESSSLIESAMEASSSIQQDCVAFQSSRAGGSASVMQVINSNTNCALMNPSCTKNISLGFPQGLVHSNMPLQFPNIVGENNSTEYQDCGLSRVGESPWESNLEGTCPQARDKAKMRYNEKKKTRTFGKQIRYASRKARADTRKRVKGRFVKAGEAYDYDPLGTRDI

SEQ ID NO: 2998 - protein, 134 aa, Glycine max
PTRPPTRPGETAIVGNRVGVGHGVTLGGTGKEIGDRHPKVGEGALIRASATILGNIKIGEGAMIAAGSLVLKDVPPHCIAAGIPAKVISGLQEHDPSLTMKHDATKDFFTHVATNFRDEKPNGAQHPDRNGMNI

SEQ ID NO: 2999 - protein, 54 aa, Glycine max
MWLCRLGSLTFKTPDNVNYPSMNLAFSAGRAGGTMTGVLSAANEKAVEMFVEEK

SEQ ID NO: 3000 - protein, 110 aa, Glycine max
  unsure (1)..(110): unsure at all Xaa locations
SLIHRSSHASALSLTHTISLSFSHPDLVTRAMSTTPREKVTYMAKHTDHANRYXEMMKLMEKVSAYNDSHELTTEEHNLLSVNYKNVISARHAYXRIISIIEHKEDKRVN

SEQ ID NO: 3001 - protein, 134 aa, Glycine max
RFYPLFPLNPNVALMNSFQTFKYFSNPKQNLRPQIHNQPISLKPLMIIIMRMSNTICFLYWSINNYLPLTTRNKKNNDKPKILTMQNFKFLESSKYIRYLATLLVAYGISINLFDVTFKSKLKSQFPKPNKYSS

SEQ ID NO: 3002 - protein, 61 aa, Glycine max
  unsure (1)..(61): unsure at all Xaa locations
VACNPLTKSGCPLIHQSMRLTFGSLANSTPYLXRLLLLINSAYLASSKSLNTQFTALRKED

SEQ ID NO: 3003 - protein, 321 aa, Glycine max
  unsure (1)..(321): unsure at all Xaa locations
MSAADDEEPERRRRLKAFASCGLKSFQRDLIAGAVMGGGVHTIVAPIERAKLLLQTQESKLAIVASGRRRFKGMXDCIARTVREEGILSLWRGNGSSVIRYYPSVALNFSLKDLYKSMLRGGNSSDNLLPGATANFAAGAAAGCTTLVLVYPLDIAHTRLAADIGRTDVRQFRGIYHFLATIFHKDGIWGIYRGLPASLHGMVVHRGLYFGGFDTMKEIMSEESKPELALWKRWVVAQAVTTSAGLISYPLDTVRRRMMMQSGMEQPVYNSTLDCWRKIYRTEGLASFYRGAVSNVFRSTGAAAILVLYDEVKKFMNWGRI

SEQ ID NO: 3004 - protein, 131 aa, Glycine max
MGLVCSRSRRFREADAEENAQDAEIERRIELETKAEKHIQKLLLLGAGESGKSTIFKQTKLLFQTGFDEAELKSYIPVVHANVYQTIKVLHDGSKELAQNDFDSSKYVISNENQDIGEKLSEIGGRLDYPR

SEQ ID NO: 3005 - protein, 455 aa, Glycine max
MLLYKYLSTTLYRTWNTIYYIFLHGEEHKLNLLLSSFASHFTLNVSAKSRGIFHSTTISLQKRPFCFFSDNMGLVCSRGRRFREADAEENAQDAEIERRIKLETKAEKHIQKLLLLGAGESGKSTIFKQIKLLFQTGFDEAELKSYIPVVHANVYQAIKVLHDGSKELAQNDVDSSKYVISNENQDIGEKLSEIGGTLVYPRLTKELAQEIETLWEDAAIQETYARGNELQVPDCAHYFMENLERLSDANYVPTKEDVLYARVRTTGVVEIQFSPVGENKRSGEVYRLFDVGGQRNERRKWIHLFEGVTAVIFCSAISEYDQTLYEDENKNRMMETKELFEWVLRQPCFEKTSFMLFLNKFDIFEKKVLNVPLNVCEWFKDYQPVSTGKQEIEHAYEFVKKKFEELYFQSTAPDCVDRVFKIYQATALDQKLVKKTFKLVDETLRRRNLFEAGLL

SEQ ID NO: 3006 - protein, 188 aa, Glycine max
  unsure (1)..(188): unsure at all Xaa locations
MGLVCSRSRRFREADAEENAQDAEIERRIELETKAEKHIQKLLLLGAGESGKSTIFKQIKLLFQTGFDEAELKSYIPVVHANVYQTIKVCNTXRVLHDGSKELAQNDFDSSKYVISNENQDIGEKLSXIGGRLDYPRLTKELAQEIETLWEDAAIQETYARGNELQVPDCAHYFMENLERLSDANYVP

SEQ ID NO: 3007 - protein, 413 aa, Glycine max
MGNWSSERHQTTQQSDLGAVLRDGKEVLLQAFNWESNKYNWWNNLEGKVSDIAKAGFTSVWLPPPTHSFSPEGYTPQNLYSLNSKYGSERQLKALLQKMKQYKVRAMADIVINHRTGTTQGRGGMYNRFDGIPLGWDERAVTSDSGGLGNRSTGAIFQGFPNIDHTQDFVRQDIIGWLRWLRHEVGFQDFRFDFVKGFSPKYVKEYIEGAKPLFCVGEYWDSCNYKGSTLDYNQDSHRQRIINWIDGTGQLSTAFDFTTKGILQEAVKGNFWRLRDPQGKPPGVIGWWPSRSVTFVDNHDTGSTQAHWPFPKDHIMEGYAYILTHPGIPTVFYDHFYDWGDSIREQIVKLIDVRKRQGIQSRSSVRILEAKHDLYSAVIGEKVCMKIGNGSWCPTGREWTLSTSGHNYAVWHK

SEQ ID NO: 3008 - protein, 248 aa, Glycine max
NEKEKAGPPKPFGYGSKKIGHNGDVGWVEYLLLNTNQEHNFSFYGKNAEKFRCLLNSYMSSVRKMACEILELMAEGLKIQQKNVFSKLLMDKQSDSVFRVNHYPACPELAVNGQNLIGFGEHTDPQIISLLRSNNTSGLQIFLRDGNWISVPPDHKSFFINVGDSLQVMTNGRFRSVRHRVLANGFKSRLSMIYFGGPPLSEKIAPLPSLMKGKESLYKEFTWFEYKNSTYGSRLADNRLGHFERIVA

SEQ ID NO: 3009 - protein, 175 aa, Glycine max
MPGGSRNPLVVGRVIGEVIDPFEISIPFRVTYGNREVGNGCELKPSQVANQPRVSVGGDDLRNFYTMVLVDPDAPSPSNPNFREYLHWLVTDIPETTGPNFGNEVVSYESPRPTMGIHRLVFVLFRQQFRQRVYAPGWRQNFNTREFAELYNLGLPVAAVFFNCQRESGSGGRTF

SEQ ID NO: 3010 - protein, 157 aa, Glycine max
MSENKSEGGAEKKKSGGFNTKKFLLDLASGGTAAAVSKTAVAPIERVKLLLQVQDASIHITADKRYKGIIDVLVRVPKEQGFLSLWRGNLANVIRYFPTQALNFAFKDTYKRVFTHGVDKEKQFLKFFAMNLASGGAAGATSLCFVYPLDFARTRLA

SEQ ID NO: 3011 - protein, 77 aa, Glycine max
  unsure (1)..(77): unsure at all Xaa locations
LNLPMANGLILFHTXYPNPLSKHPLFYTSILPFIPYFPAFIFELHPLRHSIYPQSSTDNLLNLLRPYFLFPLTIMIT

SEQ ID NO: 3012 - protein, 131 aa, Glycine max
  unsure (1)..(131): unsure at all Xaa locations
DSWANTWLNSWAHWLKADPRKYLKMKERLVGVSEETTTVVKRLYQMHETGALLFPAINVNDYVTKSKFDNLYGCRHSLPDGLMMATDVMIAGKDAAVCGYGDVLTGCAAALKQCXARVIETEIDPICAVQA

SEQ ID NO: 3013 - protein, 243 aa, Glycine max
MGRGKVQLKRIENKINRQVTFSKRRSGLLKKAHEISVLCDAEVALIVFSHKGKLFEYATDSCMEKILERHERYAYAERQLVANDSETQGNWTIEYTRLKAKIDLLQRNHRHYMGEDLASMSLKELQSLEQQLDTAIKNIRTRRNDLMYASISELQKKEKMIQEQNNILAKKIKEKEQAVAQQAAQWEQPNYRVDTSFMPQQQPLRTSLNIGGNNYNQEAAPELGRNGLDLTLEPLYSCHLGCF

SEQ ID NO: 3014 - protein, 97 aa, Glycine max
  unsure (1)..(97): unsure at all Xaa locations
FFFFQIFSLPSFYLFICFATKSSTSLIFSFPFVKYRWHAVASWTWDAQDETCGICKMAFDGCCPDLXLPGDDLPLSKLLLMILLATFIGIMVCTKLS

SEQ ID NO: 3015 - protein, 224 aa, Glycine max
LDLVIKKLEEAGFSQDRFYIHCDGALFGLMLPFVKRAPKISFKKPIGSDQVSGHKFVGCPMPCGVQITRLEHVNALSRNVEYLASRDATIMGSRNGHAPIFLWYSLNMKGYRGFQKEVQKCLRNAHYFKDRLVDAGIGAMLNELSSTVVFERPHDEGFVHKWQLACQGNVAHVVVMPNVTIEKLDDFLNELVQKRAVWFRDGNCQPYCIASDVGQEKCLCALHR

SEQ ID NO: 3016 - protein, 178 aa, Glycine max
MSRVYVGNLDSRVTERDLEDEFRVFGVIRSVWVARRPPGYAFIDFDDRRDAQDAIRELDGKNGWRVELSHNSRGGGGGRGGRSGGSDLKCYECGEPGHFARECRMRGGSGRRRSRSPPRFRRSPSYGRRSYSPRGRSPRHRSLSPRGRSYSRSPPYRGREEVPYANGNGLRERRRSRS

SEQ ID NO: 3017 - protein, 101 aa, Glycine max
IRLELTHTLCIYLYQPDLVATASAPTPREELVCMAKLAEQAKRYKETVEFMENVCSSAESEELTVEERNLLSVDYKNVNGARRAYRRIISLIEQKEESRGI

SEQ ID NO: 3018 - protein, 71 aa, Glycine max
  unsure (1)..(71): unsure at all Xaa locations
MGYSSREENAYMEKLAELSTRFNEMVDFMXMVAXTVEVEELTVEERILLSVAYKNVIDSRRAWLMIIFFIE

SEQ ID NO: 3019 - protein, 82 aa, Glycine max
  unsure (1)..(82): unsure at all Xaa locations
NHPSSPKTIHFXTPTFKWRISITYIPDFSKPPVKLPYPQQISITVTENIXSRYTTVITPQNFNLFNVHIAMAGTAIYQLSRT

SEQ ID NO: 3020 - protein, 263 aa, Glycine max
MATFSKERENFVYVAKLAEQAERYDEMVDAMKKVAKLDVELSVEERNLFSVGYKNVVGSRRASWRILSSIEQKEDSKGNELHVKHIRDYRNKVELELSNICSDIMIILDEHLIPSTNIAESTVFYYKMKGDYYRYLAEFKAGNEKKEVADQSLKAYQTASTTAESELQPTHPIRLGLALNFSVFYYEILNSPERACHLAKQAFDDAVSELDTLNEDSYKDSTLIMQLLRDNLTLWTSDIPEEGEDLKMESAARVDQGEDELGR

SEQ ID NO: 3021 - protein, 251 aa, Glycine max
MGRGRVQLKRIENKINRQVTFSKRRSGLLKKAHEISVHCDAEVALIVFSTKGKLFEYSSDPCMEKILERYERYSYAERQLVASDQPLTENWTLEHAKLKARLEVLQKNQRVCLLFCRNFMGQDLEGLSIKELQNLEHQLESALKHIRSRKNQLMYESISELHKKDKALQEQNNTLAKKIKEKEKALAQQAQLERLGDEVDLTSSALVPQPLVTSNIRTSSQIRGEGDNEGTPTPTQANAILPPWMLRPTNE

SEQ ID NO: 3022 - protein, 91 aa, Glycine max
  unsure (1)..(91): unsure at all Xaa locations
MASLAEKTTSGLKYKVKDLYQADFGRLXIELAYVEMPGLMACLTAFGPYQPLQGARISGFLHMNIQTAVLIETLTDLGAEVRLCFLNILFN

SEQ ID NO: 3023 - protein, 121 aa, Glycine max
  unsure (1)..(121): unsure at all Xaa locations
ITLLYFMMEEVKLPVPKVDIGEAHXLINYFLLNKSMLDTVLYTRDRYLDTGVIIFPDKATIFLNVIDDXSPKNRTFAYXDNIWSFDYTPLKKTAMTTXFVDTDYMKAAVTDPSVVFTIDLY

SEQ ID NO: 3024 - protein, 216 aa, Glycine max
MAATFDSVRSLALLTLAFVCSVANSMRFELQSGNTKCISEDIKTNAMSVGKYSVVNPREGYPLPDSHRIVVKVTSPHANMYHFGDHVDSGNFAFTASESGDYSACFWVQDTRDTPSVVTIEFEWRTGVAAKDWSKVAKKGQIEVMEFELKKLYDTILSIHDEMFYLREREEEMQDLNKATNSKMFTFSFLSIVVCLSVAGLQLWHLKTFFERKKLL

SEQ ID NO: 3025 - protein, 78 aa, Glycine max
  unsure (1)..(78): unsure at all Xaa locations
ARVVPLNNMAEMXSATDRTNISLAAIAELAHLTGGGLINRSGLEGRSLECGSLADTVEAYEILLADGTRVRPTKDHEF

SEQ ID NO: 3026 - protein, 167 aa, Glycine max
  unsure (1)..(167): unsure at all Xaa locations
MVSKPTDSASKPRKQLGEPANDGIGSLSLELNQLKKQIQAERIVCIKEKIRSNEKKLQCHMSGVLSETSTRGSSQTEENRKTPILSSRIDHPLCKFSGFSPVSGDKDHSNQDALSATSIKMPYIETLPPYTSWIFLDRNQRMAEXQSVVGRRRIYYDQHGSEALICS

SEQ ID NO: 3027 - protein, 153 aa, Glycine max
TSTFTEYTVVDSACVVKIHVDGDGDLNPYIKRLTLLSCGVSTGVGAAWNTADVHFGSPVAVFGLRAVGLSVAEGARARGASKIIGVDINSDKFIKARAMGITDFIDPRDDENSVYERIREMTRGDVHYSFECAGNLNVLRDAFLSAHMGCIFM

SEQ ID NO: 3028 - protein, 389 aa, Glycine max
FPKAIGELHGHSGIARLLLFYARSLFGLVDGSHGMGVANAGLVYFNNHLLAMSEDDLPYHLRITPNGDLTTVGRYNFNGQLKSTMIAHPKLDPVTNNLHALSYDVVQKPYLKYFRFSPDGVKSPDVEIPLKEPTMMHDFAITENFVVVPDQQVVFKLSEMITGGSPVVYDKNKVSRFGILDKNAKDANDMKWIDAPECFCFHLWNAWEEPENDEIVVIGSCMTPADSIFNECEESLKSILSEIRLNLKTGKSTRKPIISESEQVNLEAGMVNRNKLGRKTKFGYLALAEPWPKVSGFAKVDLFSGEVKKYMYGEERFGGEPLFLPNGVDGDEDDGHILAFVHDEKEWKSELQIVNAKTLKLEASVKLPSRVPYGFHGTFIHSKDLRKQA

SEQ ID NO: 3029 - protein, 274 aa, Glycine max; identical to SEQ ID NO: 2502

SEQ ID NO: 3030 - protein, 288 aa, Glycine max
  unsure (1)..(288): unsure at all Xaa locations
PPPEEVSDIGHLQLHILQCYEIAEACGACICCRWSLQGFTPLVTGGAKGVGDACVVSLPLLTAFGPTSAPYVAGLYVSFEDSVAEGPLASGSVCCVAXRAERQDLIARVSNEFNGKLNILVNNVGTNVPKHTLDVTEEDFSFLINTNLESAYHLSQLAHPLLKASEAANIIFISSIAGVLSIGIGSTYGATKGAMNQLTKNLACEWAKDNIRTNCVAPGPIKTPLGDKHFKNEKLLNAFISQTPLGRIGEAEEVSSLVAFLCLPAASYITGQTICVDGGLTVNGLYIN

SEQ ID NO: 3031 - protein, 159 aa, Glycine max
FNFKGHELLEFARESVVVYLDDEDGATRKDAALCCCRLVASSFSGMACSHVGSSRLTRSGGKRRRLVEELVEKLLISAVADADVTVRHSIFTSLHGDRGFDEYLAQADNLSAVFAALNDEDFDVREYAISVAGRLSEKNPAYVLPALRRHLIQLLTYLE

SEQ ID NO: 3032 - protein, 112 aa, Glycine max
MNKITSKMETMEVADTGVASGTTNKDESSTKDETTNNKVSVDEMTSRDYYFDSYAHYAIHEEMLKDEVRTITYRNSMYHNKHIFKGKVVLDIGCGTGILSMFAAKAGASHVI

SEQ ID NO: 3033 - protein, 248 aa, Glycine max
SAREHSQSMDGSTTIKPELLVSGSEDMSAADSKKAISAAKLAELALIDPKRAKRIWANRQSAARSKERKMRYIAELERKVQTLQTEATSLSAQLTLLQRDTNGLNSENSELKLRLQTMEQQVHLQDALNDALKEEIQHLKILTGQVMAPNGGPMMKLASFGGGQQFYPNNHVMHTLLAAQQFQQLQIHPQKQQQQQHQHQFQQFQQQHQHQHQQHQQSSDLKMRETSPTPCPKDNTSSDVNPSGAKDC

SEQ ID NO: 3034 - protein, 283 aa, Glycine max
KFEANVVISWRDYFLRVVPTACGTAMDVNLSNVSLVFISVTFATMRLALGAVFLLLFAFAFRLETPSVKLSGIILIISVGILLTVAKETEFDFWGFVLVMLAAVMSGFRWCMTQILLQKEAYGLKNPLVLMSYVSPVMAAATALLSLALDPWDEFRENKYFDNSLHITRSCLLMLLGGTLAFFMVLTEYVLVSVTSAVTVTIAGVVKEAVTILVAVLYFHDQFTWLKGCGLLTIMVGVSLFNWYKYLKLQKGHAGGSDVEEHSRDSAAKYVILEEMDEQEDGI

SEQ ID NO: 3035 - protein, 246 aa, Glycine max
MVFEETELRLGLGLCLPGNGTTATTEAAAAELGVRKRGFSETETDETATVDLMLNLSPKEAAAADGADPREKPKTSPKEKTLLLPDPAKPPAKAQVVGWPPVRSFRKNMFAAQKSSGGEESEKSSPNASFVKVSMDGAPYLRKVDLKMYKSYPELSDALGKMFSSLTIGNCESQGFKDFMNESKLMDLLNSSDYVPTYEDRDGDWMLVGDVPWEMFVESCKRLRIMKGKEAIGLAPRAVEKCKNRS

SEQ ID NO: 3036 - protein, 201 aa, Glycine max
  unsure (1)..(201): unsure at all Xaa locations
FAALLMELAAQTSRGINHVTSHVEEQLSPIRKSDSKNENKTDEIQKTEHTPRGFPKSSTLVKLPFWPILEGLWLILSSTYLLHVSLFIWLSAVVSSFFYFQKVSVIATTVTSSLGRRKLFAQINSFIAVFILVGQLSLTYXGRILTVAGVTTAICSAPFVGLLNLVALAVWPKWVVVAICETLRKVIMTCKYWFLLIDFSN

SEQ ID NO: 3037 - protein, 329 aa, Glycine max; identical to SEQ ID NO: 931

SEQ ID NO: 3038 - protein, 108 aa, Glycine max
  unsure (1)..(108): unsure at all Xaa locations
RIEAAEVDEYARGMISGSXSSLYXELGLYYIGPGGGHNINDLFTILNKLXSTNTTIPVFIHAITXKGRRYPYAKKAFFKYHXVTKFYPPTGKQFKYNVXTQYNTTYFA

SEQ ID NO: 3039 - protein, 79 aa, Glycine max
KEWHAVASWTWDAQDETCGICRMAFDGCCPDCKLPGDDCPLIWGVCNHAFHLHCILKWVNSQTSQAHCPMCRREWQFKG

SEQ ID NO: 3040 - protein, 215 aa, Glycine max
  unsure (1)..(215): unsure at all Xaa locations
MGRGRVELKRIENKINRQVTFSKRRSGLLKKAREISVLCDADVALIVFSTKGKLLDYSNQPCTERILEPSERDSYAGRELVGDDQPPNENWGIEHXKLRLGWRYYSRNQRNLMGEDLDRLNLTGLQRWEHQLDSALKHIRSRKNQAMNESISELQKKDRTLREHNSLLSKKIKEKEKELTPQEQEGLQNNMDVSSVLVTQPLESLTIGLVSFCDV

SEQ ID NO: 3041 - protein, 55 aa, Glycine max
MISISSFIFPYKYWISGWIEWDGERIEFDNAPSYSEKNWGGGFPRKWFWVQCNVF

SEQ ID NO: 3042 - protein, 532 aa, Glycine max
LGTITCPLKRSVITKELHLKALDTWLWGDSANSSSSLVNWGPSCKRKALEGSSRQLCSGGSSSTLVQSGNGCWPTDPVDLNASSDLTDSTPIEDIPVTSPPLFQNATNEERQEAPNGFPLISIAENVERPLRNFDRRMSHLQHQESVPLNLPSTGSARHHNHSSLHQAPGSHSINDSLELRLTAGGTSSANSGASLNQSPALRIHSFPWNRTANPRGARSSTSYNSGERAVREDFNLRMFPRDSTEHPMNVPASSGHEPIGWHTPSGNVNNSGGAPPPSWIGSSSNVHSPANRSWIFNHEVPAENMQSVSEFSPWSLFPSISSASGVHNAHSAPSSSGPPSFTQGSSSNQSYARTALVMERRGGDVLSGGPHSLRALTFDNEGRRRLISEIRQVLMAMRRGENLRAEDYMVFDHPFLYHGMAEMHDRHREMRLDVDNMSYEELLALEEHIGDVSTGLSEDIIIKLMKQRIYVSVMTDSSIDLEPCCICQDEFADGENVGSLDCGHEFHSGCIKQWLMQKNLCPICKTTALAT

SEQ ID NO: 3043 - protein, 400 aa, Glycine max
MACPAMANGNGSLKNLKLNDTKGKTITCKAAVVYGPGEPFVVENILVHPPQKMEVRIKILYTSICHTDLSAWRGVNEAQRAYPRIFGHEASGIVESVGEGVSEVEEGDIVVPIFNGECGECSMCKCEKTNLCERFGVDATKKVMEGDGTTRFSTVNGKPIFHFLNTSTFSEYTVVDSACVVKFLDSDHSLSHKNLTLLSCGVSTGVGGAWNTANVHSGSTVAIFGLGVVGLAVAEGARARGASKIIGVDINPDKFIKAQTMGVTDFINPDDEEKPVYERIREITDGGVHYSFECTGNVDVLRDAFLSSHEGWGLTVILGVHASPKLLPIHPMELLDGRNIVGCVFGGFKGRSQLPHFAKECGQGVVKLDNFITHELPFEEIDKAFDLLITGKSLRCLLHF

SEQ ID NO: 3044 - protein, 383 aa, Glycine max
MGWLDSVWGRGRKFIKRKDSDAGDAGKALEELRASLYNEIRTSEGAKRQQQRYCGPVVALSFNFMVSVGIIMANKLVMGKVGFNFPIFLTFVHYITAWLLLAIFKTLSVLPVSPPSKTTPFSSLFALGVVMAFASGLANTSLKYNSVGFYQMAKIAVTPTIVLAEFILFGNTIDFKKVLALAVVSAGVAVATVTDLEFNLFGALIAIAWIIPSAINKILWSTLQQQGNWTALALMWKTTPITVFFLGALMPWIDPPGVLSFKWDVNNSTAVFVSALLGFLLQWSGALALGATSATTHVVLGQFKTCVILLGGYLLFESDPGVVSIGGAVVALSGMSVYTSLNLQEPQEPSSKPKSTSEDTKSTDSNVNTTTTTTTSTTIVCVI

SEQ ID NO: 3045 - protein, 424 aa, Glycine max
MGNSEDEKSVKTGSPSSSPATTEQTNQPNIHVYPDWAAMQYYGPRVNIPPYFNSAVASGHAPHPYMWGPPQPMMPPYGPPYAAFYSHGGVYTHPAVAIGPHSHGQGVPSSPAAGTPSSIESPTKLSGNTDQGLMKKLKGFDGLAMSIGNCNAESAERGAENRLSQSVDTEGSSDGSDGNTAGANQTKRKRSREGTPTTDGEGKTELQNGPASKETASSKKIVSATPASVAGTLVGPVVSSGMATTLELRNPSTVHSKANSTSAPQPCAIVPNETCLQNERELKRERRKQSNRESARRSRLRKQAETEELARKVDMLTAENVSLKSEITRLTEGSEQMRMENSALREKLINTQLGPREEITLSSIDSKRAAPVSTENLLSRVNNSGSNDRTAENENDICENKPNSGAKLHQLLDTNPRANAVAAG

SEQ ID NO: 3046 - protein, 172 aa, Glycine max
  unsure (1)..(172): unsure at all Xaa locations
ENIDTAKLAXKTARYEEMVVFMAKXNTVVAEVLTKEERNLLCVSYTNGIDTXRALWMIMSSIVLQDESIGNVDHVVIIKEDRCVNEGXLIMNCDGILNLLESNLIPFIAFPDSKIHFLEMKGDSEETLAQFKTGAETKDADESTFIADRXSHDIAFVDLAPTHPIRLGPALT

SEQ ID NO: 3047 - protein, 182 aa, Glycine max
  unsure (1)..(182): unsure at all Xaa locations
SLRDIDLLVFACQKAVSGDTYTTLSLDDDRSSYSLLATDWDSRSASVTAPISKKSNAFDEESETDREESDVSGSDRDDTYWILXFCNLRGNEFLCEDDDDYIQDDFKLCGLSSLVPYYDHALDLILDVESYHGDMFTAEQSELIESAAEMLYGLSHARYIWTSKRMAXECLDQSENYDFGRC

SEQ ID NO: 3048 - protein, 98 aa, Glycine max
  unsure (1)..(98): unsure at all Xaa locations
DEAARRGKVYXKYMCSFLFNLNNDFVVDATRKGNKICFANHSVNPNCYAKVMMVNGDPRIGIFAKRAIQTGEELFFDYRYSQADALKYVGIEREMEIP

SEQ ID NO: 3049 - protein, 217 aa, Glycine max
IANCAVGSPVSANKPEGRENHTKGATSGSSEPSDEDDEAGACEQSTNPADMKRLRRKVSNRDSARRSRRRKQAQLSDLELQVEKLKVENATLYKQFTDASQHFREADTNNRVLKSDVEALRAKVKLAEDMVTRSSFTTLNNQLLQTQHHQMSTPQQLNTTNLRRMAHVSPTITVHGNDVSYNNGGQNSALGNLDMSFNDINEVMNDAMSCGTIWPLD

SEQ ID NO: 3050 - protein, 121 aa, Glycine max
  unsure (1)..(121): unsure at all Xaa locations
IRHEGAQKVKYRXLMFXXKDSNNPDFRRKVLLGVVEPEQLINMSTAEMASDQRNQEYQKISENALFECERGGHPKPTPDQFKCAPCGQRKPPYHQIQPPSPDDPMPPYVPCCVSNTRWKFC

SEQ ID NO: 3051 - protein, 154 aa, Glycine max
  unsure (1)..(154): unsure at all Xaa locations
MSGVWGFKNGVVRLVENPEGEAAXGSRGGRRTVLVHRASSEVLIYYAALEHTLDSLDWETDYDHANLLQFHKRCTYHLIYVTIDFIMFMPMLMSDILMKNKIPFEVRDIQSMSGKRLNIIHIRTNMPTTCKAYVHCTLPATTVQRQLIVTICTT

SEQ ID NO: 3052 - protein, 307 aa, Glycine max
MHLASLINPTSNFPLLSSRTTTTSFIFNHRRKKSQSNCIRSHQSTIQQRWTLQGMTALVTGGTRGIGHAIVEELTGFGARVHTCARNEHDLTKCLKNWNDSGFDVTGSVCDVSVPHQREALMESVSSLFHGKLNILINNVGTNIRKPVTDFTSAEFSTLIDTNLGSVFHLCQLAYPLLKASGMGSVVFVSSVSGFVSLKSMSVQGATKGAINQLTRNLACEWAKDNIRSNAVAPWYIKTSLVEQVLSNKDYLEEVYSRTPLRRLGDPAEVSSLVAFLCLPASSYITGQIICIDGGMSVNGFYPTTQF

SEQ ID NO: 3053 - protein, 476 aa, Glycine max
MKKENSVMLKAGELPGRLTRARAAAALRAYGQLPPLKERAQQNQNQLSRVNSKRAVSDNTCVQRKRKAVLQEVTNVCCENAYKACLNSTNIQARKSKLAKAGQINVSKVAPSVTVEPRQFQVDSKAKETALQSEDTMCSINLENNELLQLNANDCSKDFRLPESQMSGISAHPLISQKKDTKDNLPKLLTALKDSDITNIDDDDLEDPQSCSLYAADIYDTIRVAELARRPYPNFMETVQRDITQSMRGILVDWLVEVSEEYKLVTDTLYLTVYLIDWFLSKNYIERQRLQLLGITCMLIASKYEEINAPRIEDFCFITDNTYTKAEVLKMESQVLKSSEYQLYTPTIQTFLRRFLRAAQASYKDQSLELECLANYLAELTLMDYGFLNFLPSIIAASAVFLARWTLDQSNHPWNPTLQHYACYKASDLKTTVLALQDLQLNTDGCSLTAVRTKYRQDNFKCVAALSSPKLLETLF

SEQ ID NO: 3054 - protein, 134 aa, Glycine max; identical to SEQ ID NO: 2125

SEQ ID NO: 3055 - protein, 805 aa, Glycine max; identical to SEQ ID NO: 1391

SEQ ID NO: 3056 - protein, 373 aa, Glycine max
  unsure (1)..(373): unsure at all Xaa locations
MATRRVRCMQCGRPLLVPIEVAYSIPLMCYGCQASRPNYHFANNVTPPFVNYHPAPGYAHRIRRNQFNYPRPLPLTPPPTPLNPPSSYGNKRAVLVGISYCNQINNLKGSVNDAQSMKYFLINKMGFPSDSIRVLTDDPEEKNPMRIPTKYNMRMAMRWLVEGCRSGDSLXVFHFSGHGSQEEDTNMDXEVDGYDEAICPXDYEHEGKILDDEINATIVRPLPRGAKLHALVDTCFSGTILDLPFMCRMNRKGYYGWEDQRNPRAGYKGTRGGLAVCISACDDDGNAADTSALSGEESSGALTFSFIQAMQNESNLTYGHLLNSMRSTIRGAKEKAFGQNDQDFTMNTRQQYTHEPQLSSSEKFDIYSKSIEM

SEQ ID NO: 3057 - protein, 307 aa, Glycine max
MMAVARKEMDRIKGPWSPEEDEALQKLVERHGPRNWSLISRSIPGRSGKSCRLRWCNQLSPQVEHRAFTPEEDETIIRAHARFGNKWATIARLLSGRTDNAIKNHWNSTLKRKCASFMTADEAAAGGFSPRPLKRSFSAGTAVPPPGSPSGSDVSESSAAPGVVSVSVSVSPSQVFRPVPVRPVVETASSQDDADADAEDAGPTTSLSLSLPGVESSEISNRTSTVPVMPVHTVAAAAPVPLPAPEVGLGALNLNAEFMAVMHEMIRKEVRSYMEQQNGMMCFQGMEMMEGFRNVSVKRIGISRVDS

SEQ ID NO: 3058 - protein, 238 aa, Glycine max; identical to SEQ ID NO: 1310

SEQ ID NO: 3059 - protein, 238 aa, Glycine max
MKIQCDVCEKAPATVICCADEAALCAKCDVEVHAANKLASKHQRLLLQSLSNKLPRCDICQDKPAFIFCVEDRALFCKDCDEPIHLASSLSANHQRFLATGIRVALGSNCTKGNEKGHVEPSKPKAQEVPAKIPSQQVPSFTSSWAVDDLLELTDFESPDKVQKQSLEFGELEWLADVGLFGEQFPHEALAAAEVPQLPMTSSVGSHKAPKSLLSYKKPRIEVLDEDDDEHFTVPDLG

SEQ ID NO: 3060 - protein, 320 aa, Glycine max
VRLYFIHGGKRIWLSSFLETAANSARVLPIIISYIHKRRRHRSSALISIKPPLFLASALIGLLTGLDDYLYACGVARLPVSTFSLIQASHLAFTAVFAFLLVRHRFTPYSVNSVVLLTVAAVVLALRSSGDRPAGESSRQYVIGFVMILAAAALYGFVLPLMELVYKKSRQRITYSLVMEIQLVLCFFATLFCTVGMIINNDFKVIPREARDFKLGETKYYVVLVWSAIMWQFFFLGAIGVIFCASSLLSGIIIAAFLPVTEVLAVIVYKESFHAEKGVALVLSLWGFVSYFYGEIKQDREKNKNRCPETDLPQSLPPNA

SEQ ID NO: 3061 - protein, 155 aa, Glycine max
  unsure (1)..(155): unsure at all Xaa locations
MGMVPDERCVKNRYWIERTTDLAVXPMVLDSHTFVLNEEDRPKDLYLLPTYEGQXFVNLGARVARFTVELAKKAGPVLAVXLLRVLLKRSDSIIGHHMNVKVMCADLTFPNLYIAEGSADLLFCYWVFMCASXTEVANSAARMIVWYKGDAYVLF

SEQ ID NO: 3062 - protein, 364 aa, Glycine max
  unsure (1)..(364): unsure at all Xaa locations
MGIAYLNMPGFMRAMFIMLCAMMILPELTHAKHARVTRHYKFNIKMQNFTRLCQTKSIVTVNGRFPGPRIIAREGDRIVVKVVNHVQYNVTLHWHGIRQLKSAWADGPAYITQCPIQTGQSFVYDFTVIGQRGTLWWHAHISWLRTTLYGPIVILPKRHVPYPFPQPFREVPIIXGEWWKADTEAVINQAMQTGLAPNVSDAHTINGLXPGPVSNCAPKETFQLKVKPGKTYLLRLINAALNDEMFFSIANHTLTMVEADAVYVKPFSTKIGLITPGQTVNVLLKAKSKAPNGTCAISTRPYATGPASFDXTTATGFLEYKKTSHXEHKSNTKKLPLLRAVFPKFNDTVFAMNFHNRGRSLANA

SEQ ID NO: 3063 - protein, 264 aa, Glycine max
MAETKWVMKDKRWSLHGMTALVTGGTRGIGHAIVEELAEFGATVHICARNQDDIDKCLEEWKNKGLNVTGSVCDLLCSDQRKRLMEIVGSIFHGKLNILVNNAATNITKKITDYTAEDISAIMGTNFESVYHLCQVAHPLLKDSGNGSIVFISSVAGLKALPVFSVYAASKGAMNQFTKNLALEWAKDNIRANAVAPGPVKTKLLECIVNSSEGNESINGIVSQTFVGRMGETKEISALVAFLCLPAASYITGQVICVDGGFTT

SEQ ID NO: 3064 - protein, 264 aa, Oryza sativa
  unsure (1)..(264): unsure at all Xaa locations
SSINKRFSLAGATALVTGGSKGIGRAIVEELASFGATVHTCARNQAELSRCQEEWTAKGLAVTVSVCDVAVRADREALAGRVSAMFDGKLSILVNNAGTAYLKPAADLTPEETSRLMTTNFESCFHLSQLFYPLLKDSGRGSIVNISSVASVLAFHSLPIYSAAKGAMNQVTRNLACEWASDGIRVNSVAPGYIQTPLLTAFVAGNDFAQVEFNRLPLGRLGKPEDISSLVAFLCMPAASYITGQIICVDGGRMLSXXTLHIQN

SEQ ID NO: 3065 - protein, 546 aa, Oryza sativa
  unsure (1)..(546): unsure at all Xaa locations
MEKLSMVTSLLCAITVAVLAVAVVSGEAAVVEHTFVVHEMNATHLCNTTKIYVVNGQFPGPTVDVTEGDTVVVHVINKLPFGLTIHWHGVRQMRSCWADGAGFVTECPIPPGNEHTYRFNVTGQVGEWWELDLIELDRRMMDGNFDDNPLSATINGKLGDLSNCSRMVEESFILDVKHGESYLLRVINTALFSEYYFRVAGHTFTVVGADGNYLTPFKTDMVTVAPGEAIDVIMVADAPPAHYHMIALANQPPEPDPQIPVFTSRGLVRYAGTTANNNAVPMPIMPNQHNTMPSYYFHANLTGLAHPERHRVPMHVDERLFVTLGLGSICRGQNTTCKRRRSXXETIVVATMNNVSFAHPKTTALPLLRRHIEGRVHXEDFPIRPPRPFNYTNRDLIPPGPLEEALEPTFKATKLKRFKYNTSVEIIFQSTTLMQSDSNPMHLHGYDVFLLAQGLGNFNAKRDVRKFNYHNPQLRNTVQVPRGGWAAIRFVTDNPGMWYLHCHFEFHIIMGMATAFIVEDGPTPETSLPPPPPEFKRCGNNGLSQP

SEQ ID NO: 3066 - protein, 728 aa, Oryza sativa
  unsure (1)..(728): unsure at all Xaa locations
MGIAKIPAVLWLLACAVLTFAVAISPAHGGRTRRHYDFFITETNYRRLCHEKSVLTVNGQFPGPTIYARKGDLVIVNVYNHGNKNITIHWHGVDQPRNPWSDGPEFITQCPIRPDGKFTYQVIMSEEEGTLWWHAHSDFDRATVLGAIVVHPKHGDTFPFKRPDKEIPIILGEWWKNDVNHLLEEMKRIGEDVKPSDANTINGQPGDMFPCSRDDTFKVAVEHGNTYLLQVINAGLTNDMFFAVSGHRLTVVGIDARYTKPLTVEYIMIAPGQTMDLLLEANRSLGSKSNSRYYMAARTFITLPVXXIPFNNSTATAVVEXXTPATAVXGPPDFPAVLPSLDDVDAAMAFLRQLRSLGSKDHPVHVPTHVDEHMLIDLAINFLPCNATNATDTACKGPKGNTTRFAASLNNVSFVSPAIDVLHAYYYGSGRGVYEDDFPNKAPVFVNLTGDNDRPGVTKHGAKVKVLEYGTVVEVVFQDTSFESHPMHLHGFAFYVVGLGSGKFDDRRDPATYNLLDPPYQSTVSVPKAGWAAIRFRADNPGVWFMHCHFDRHMVWGMNTVFIVKDGKTPQAQMLPRPPNMPKNKDAEFCPSCKMADEIRSSDESLCVELLRRKYLQEGGVFQFNKESCSQFWKVKSKGASYTTNNNDGAQTQDIAAKLNTKATQQLQHRRRGVIVAELAVQATQQRRFHNRSDTEATKIARAKSSSDIQQWISAKPPKSHCLSIKER

SEQ ID NO: 3067 - protein, 492 aa, Oryza sativa
MKFRSDSSGGDEPRAPAAGDGGGGGDEPAKRQRTDPSSSSSQGEASSSSQPPPQQQQEEQPPEDAGEGEQPRVPDLGEDLVFEVLRRAEARTLAAAACVSRGWRQLAEDERLWEAACVREWANLGFSERQLRAVVLSLGGFRRLHAVYIRPLQWRGAGVPRQQGRRQPPVRLGRDQVQLSLSLFSIGFFQNMPCPKKDKGNDSDKNGGGQCGKTQTVKMSQPAELSREENVYMAKLAEQAERYEEMVEFMEKVAKTVDSEELTVEERNLLSVAYKNVIGARRASWRIISSIEQKEESRGNEDRCTLIKEYRGKIETELSKICDGILKLLDSHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDCQNVCFKCPKGRSGPRNIILSVKVKTAWF

SEQ ID NO: 3068 - protein, 478 aa, Oryza sativa
  unsure (1)..(478): unsure at all Xaa locations
VLLQHAFFKRDENEISPYSWNITGTYKGIKYVLFALGILFETWELPSIPWSSVLASXNNITNLFSGSWNFAGSTNGSSRFLEFTKLKGDAVLELLSTPTKISGVHYVQLRIFSSQVFQETSEEKNRRKNCKILNDMEKHCSVEIAAKVVRVSSNLNEGEHEKYRLEGLMESTAVDDDGECFSPILLNATSLNVEVYYNKAVNYTLMVLLLIRQMEHSNTQSLFELSTESLFNAFATAAFFKFVVFSIFEMRYLLAIWKASRPLNSGEGWEVMRRELSVLYSRFYGILLGGILLMYELHNFLRPLLFLMYSFWVPQIVTNVIRDTRKPLHPQYILGMTITRLAIPLYIFGCPSNFMRIEPDKHYFGSRCFIPHQILPEKYCYHRKVEDNTNQPIDCVICMTTIDLTQRTSEYMVIMKSCCLXLTVMSXITLAERVLPLFATLDGYQDGVPNLQALLAASLDEHYFVLVNKXVAQHIQGI

SEQ ID NO: 3069 - protein, 533 aa, Oryza sativa
  unsure (1)..(533): unsure at all Xaa locations
CAAARRSGPWGPPQPRXGPPPWWGWXXVAVGLALPPLAAALRPLRERVASAGAAYAFFKRDENEISPYSWNITGTYKGSWNFAGSTNGSSRFLEFTKLKGDAVLELLSTPTKISGVHYVQGSVTFHDVLDNAHDRGVAQIRLEGVEEDYFLSNPYHLLMYQLRIFSSQVFQETSEEKXXRRKNSLTYDMEKHCSVEIAAKVVRVSSNLNEGEHEKYRLEGLMESTAVDDDGECFSPILLNATSLNVEVYYNKAVNYTLMVTFISFLQVLLLIRQMEHSNTQSGAAKVSILMIGQQAIMDAYLCLLHLTAGILVESLFNAFATAAFFKFVVFSIFEMRYLLAIWKASRPLNSDGILLGGILLMYELHNFLRPLLFLMYSFWVPQIVTNVIRDTRKPLHPQYILGMTITRLAIPLYIFGCPSNFMRIEPDKTWCIAVTIFMGIQAAVLLLQHYFGSRCFIPHQILPEKYCYHRKVEDNTNQPIDCVICMTTIDLTQRTSEYMXAPCEHIFHSGCLQRWMDIKMECPTCRRSLPPA

SEQ ID NO: 3070 - protein, 177 aa, Oryza sativa
  unsure (1)..(177): unsure at all Xaa locations
XPLWGGLVIPNVQGRGSVSSREGLALPEHDXLMEKFGSGVCRVASVSLAVSNPTIGAAPLMFLDGXKNVLAVAVETQYSSPHADKIKEYLQAPIKFAVPAPVAPGSGASAPSPAKEEKKKEEPGEESYGGLGISLFGLASYHFAAPPPSFVSSSEHRGLFLIFSKLILNKTKKVSNK

SEQ ID NO: 3071 - protein, 218 aa, Oryza sativa
  unsure (1)..(218): unsure at all Xaa locations
VEAVTVHATQKYFVTASKDNTWCFYDIPSGSCLTQVVGESSGQEGYTSASFHPDGLILGTGTTEAVVKIWDVKTQXNVAKFEGHVGPVTAMSFSENGYFLATAALDGVKLWDLRKLRNFRTISPYDSDTPTNSVEFDFSGSYLAVGGSDTRVYQVANVKLEWNLVKTLPDLSGTGKVTNVKFGTDAKYIAVGSMDRNLRIFGHPGEDDQMDDAKPSEE

SEQ ID NO: 3072 - protein, 184 aa, Oryza sativa
DEDSYMTVSSAPPKRRAGRTKFKETRHPVYKGVRSRNPGRWVCEVREPHGKQRIWLGTFETAEMAARAHDVAAMALRGRAACLNFADSPRRLRVPPLGAGHEEIRRAAVEAAELCPAPGQHNAAAEAAAAVAAQATAASAELFADFPCYPMDGLEFEMQGYLDMAQGMLIDEEDYDCEVNLWSY

SEQ ID NO: 3073 - protein, 200 aa, Oryza sativa
  unsure (1)..(200): unsure at all Xaa locations
GGDGDEDSYMTVSSAPPKRRAGRTKFKETRHPVYKGVRSRNPGRWVCEVREPHGKQRIWLGTFETAEMAARAHDVAAMALRGRAACLNFADSPRRLRVPPLGAGHEEIRRAAVEAAELCPAPGQHNAAAEAAAAVAAQATAASAELFADFPCYPMDGLEFEMQGYLDXGTGNAHRAAAIGRAIDVGRGGLXDCEVNLWSY

SEQ ID NO: 3074 - protein, 280 aa, Oryza sativa
  unsure (1)..(280): unsure at all Xaa locations
MAANAGMVAGSRNRNEFVMIRPDGDAPAKPGKSVNGQVCQICGDTVGVSATGDVFVACNECAFPVCRPCYEYERKEGNQCCPQCKTRYKRHKGSPRVQGDEEEEDVDDLDNEFNYKHGNGKGPEWQIQRQGEDVDLSSSSRHEQHRIPRLTSGQQISGEIPDASPDRHSIRSGTSSYVDPSVPVPVRIVDPSKDLNSYGINSVDWQERVASWRNKQDKNMMQVANKYPEARGGDMEGTGSNGEDMQMYGQPILILYTLLCSGFRYVSLHXIEIHIRHPKX

SEQ ID NO: 3075 - protein, 282 aa, Oryza sativa
  unsure (1)..(282): unsure at all Xaa locations
MAANAGMVAGSRNRNEFVMIRPDGDAPPPAKPGKSVNGQVCQICGDTVGVSATGDVFVACNECAFPVCRPCYEYERKEGNQCCPQCKTRYKRHKGSPRVQGDEEEEDVDDLDNEFNYKHGNGKGPEWQIQRQGEDVDLSSSSRHEQHRIPRLTSGQQISGEIPDASPDRHSIRSGTSSYVDPSVPVPVRIVDPSKDLNSYGINSVDWQERVASWRNKQDKNMMQVANKYPEARGGDMEGTGSNGEDMQMYGQPILILYTLLCSGFRYVSLHXIEIHIRHPKX

SEQ ID NO: 3076 - protein, 431 aa, Oryza sativa
GGINQSIPHAGWFLSKNGSSPCRSITSADGEILWGFVGGFGLKIPFLSSPFGLGWIRLALVLLLVGGHGGGVVGCCCCGRGREEGPDGSEPVSRAPSAAAASGKAGCRRRLPVAAAELRRHGGERAKGLGGGGGPPPAAAAYSPSNALSAPEQVLVDPVAAWLVDPGEQQPVPPLETPSYMARASSTLPQIFACAALEMLVQTGGAIPPTGLIRGAEIAAASRPMTPEDRLRRLIQVSDQHGVGNGRAGTGPVSRSRRANSPEADNLARAIQRSHNSLEASRRQMLDGDGSDATKKDDEHSDCPVCKGEVLEVNVTPIYGRGGGEENSSRNDIQIPPRPSAQRTESLRQQLQRPDTRGGIANMARQDAPSAPATQQQVVNADAGSGNQAPLPPPDANGAAPAAAVAPQQSSSVEQASTSSTVGVIAGGPAQ

SEQ ID NO: 3077 - protein, 241 aa, Oryza sativa
  unsure (1)..(241): unsure at all Xaa locations
XDAGESAAEVDPGDDGCGCNGSFECNICFESAKDPVVTPCGHLFCWPCIYQWLHGHSEHSDCPVCKGEVLEVNVTPIYGRGGGEXXNSSRNDIQIPPRPSAQRTESLRQPRHKRRHCKHGKTRCAFCTSNTAAGGQXXDAGSGNQAPLPPPDANGAAPAAAVAPQQSSSVEQAHKVGGQEFLNPPLQGGQGGGISRXLRVVTVIEHIHHVSSLIIFRLIPKLCRIVDEIFSFIYLVSTILP

SEQ ID NO: 3078 - protein, 379 aa, Oryza sativa
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 3079 - protein, 224 aa, Oryza sativa
MGRGKIEIKRIENATNRQVTYSKRRTGIMKKARELTVLCDAQVAIIMFSSTGKYHEFCSPSTDIKGIFDRYQQAIGTSLWIEQYENMQRTLSHLKDINRNLRTEIRQRMGEDLDGLEFDELRGLEQNVDAALKEVRHRKYHVITTQTETYKKKVKHSYEAYETLQQELGLREEPAFGFVDNTGGGWDGGAGAGAAADMFAFRVVPSQPNLHGMAYGGNHDLRLG

SEQ ID NO: 3080 - protein, 95 aa, Oryza sativa
  unsure (1)..(95): unsure at all Xaa locations
LVFPYVXDLGIPYTFASLGRQHPFIIAAIVLIVRFSTDLVRIFGDSITLCSTRLDAIIVYLISFWLLDIGNNATXGPCMAFLANLTAFDXLHVGH

SEQ ID NO: 3081 - protein, 370 aa, Oryza sativa
MAIMVDPPNGMGNQGKYYYSMWQTLFEIDTKYVPIKPIGRGAYGIVCSSINRETNEKVAIKKIHNVFDNRVDALRTLRELKLLRHLRHENVIALKDIMMPVHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSESDLEFIDNPKARRYIKSLPYTPGVPLASMYPHAHPLAIDLLQKMLIFDPTKRISVTEALEHPYMSPLYDPSANPPAQVPIDLDIDENISADMIREMMWHEMLHYHPEVVAAMSAR

SEQ ID NO: 3082 - protein, 250 aa, Oryza sativa
  unsure (1)..(250): unsure at all Xaa locations
MEERKGLMGRERDQFPVGMRVLAVDDDPVCLKVLETLLRRCQYHVTSTNQAITALKLLRENRDMFDLVISDVHMPDMDGFKLLELVGLEMDLPVIMLSVNGETKTVMKGITHGACDYLLKPVRIEELRNIWQHVVRRKFGNRERTNLDADTDHGPYQPTXXGSSDQNGRSSRKRKELHGEDDDEGDDNDYQENDEPSAAKKPRVVWSVELHRKFVAAVNQLGIDKAVPKRILELMNVEKLTRENVASHLQ

SEQ ID NO: 3083 - protein, 261 aa, Oryza sativa
  unsure (1)..(261): unsure at all Xaa locations
MLLGPRVIPEVRGLMGRERDQFPVGMRVLAVDDDPVCLKVLETLLRRCQYHVTSTNQAITALKLLRENRDMFDLVISDVHMPDMDGFKLLELVGLEMDLPVIMLSVNGETKTVMKGITHGACDYLLKPVRIEELRNIWQHVVRRKFGNRERNNLDFSKECNKPQSADTDHGRGSSDQNGRSSRKRKELHGEDDDEGDDNDYQENDEPSAAKEPRVVWSVELPRKFVAAVNQLGIDXXVPKRILELMNVEKLTRENVASHLQ

SEQ ID NO: 3084 - protein, 312 aa, Oryza sativa
MVSLMKLLFSALHGCHFCPILFFKWSAILGEHLFEMLYDPLRDKWITLPVMPSQIRNIARFGVASVAGKLYVIGGGSDRVDPLTGDHDRIFASNEVWSYDPLCRLWVQRAPMLVARAMFACCALDGNIIVAGGFTNCRKSISKAEIYNPEADTWEPLPDLRQAHSSACSGLVIKGKMHVLHKGLPTVQILEDGNAWAVEDYSWLQGPMAMVRGELYVLSNSCIMKQRGVNFPDKMVSCASEFQSRIGFGMIGLGDNIYLVGGVIGPGPRNQCIKPLSDVDILNVTSERPTWLPGSPMTHCRGSISGCALLRI

SEQ ID NO: 3085 - protein, 312 aa, Oryza sativa
MVSLMKLLFSALHGCHFCPILFFKWSAILGEHLFEMLYDPLRDKWITLPVMPSQIRNEARFGVASVAGKLYVIGGGSDRVDPLTGDHDRIFASNEVWSYDPLWRLWVQRAPMLVARAMFACCALEGNIIVAGGFTNCRKSISKAEIYNPEADTWEPLPDLRQAHSSACSGLVIKGKMHVLHKGLPTVQILEDGNAWAVEDYSWLQGPMAMVRGELYVLSNSCIMKQRGVNFPDKMVSCASEFQSRIGFGMIGLGDNIYLVGGVIGPGPRNQCIKPLSDVDILNVTSERPTWLPGSPMTHCRGSISGCALLRI

SEQ ID NO: 3086 - protein, 185 aa, Oryza sativa
  unsure (1)..(185): unsure at all Xaa locations
MSARDRETAVALARLAAALDGAVLGLGTAALAVASWVKYLAASGQLQRIASAPAAAIPDLRSLLAEYGGGGGDGDQXXILAVVRGHVRAAPRGKYLVPPGSGEHCVVAKHTQLCLFNEWRGIFGWTFEHALFFKSIKEQIITSFRWVPFVLVDPENMTGMVHVKLDRAMQPLPLTTVYHKLTPVX

SEQ ID NO: 3087 - protein, 274 aa, Oryza sativa
MDPKLVEVTQLFSRFKAAFARNDFDTCVDLLSQLKVRLTKFPSLPPSFQQTPNAVEELKIARDIYEHAVVLSVKIEDQDAFERDFCQLKPYYMDTCGIIPPSPQEYPILGLNLLRLLVQNRIAEFHTELELLPVTALENPCIKHAVELEQSFMEGAYNRVLSARQAVPHETYVYFMDLLAKTVRDELAGCSEKGYDYMSIAEARQVLMFSSDKELHQYIAEEHPEWEVKDGSVFFQKAKETQPCKEIPSLQVINQTLSYARELERIVEMRMLQL

SEQ ID NO: 3088 - protein, 1199 aa, Oryza sativa
  unsure (1)..(1199): unsure at all Xaa locations
MVLAIAAAAAAALVWISNSKMSPCVRTSPFQAVGCIGGVHALGEDSAPSTREGKESRATTSGESGADFCLTAASDDAIAPCRRSSIPDDDDIELIGAPPHILLGAAAELTSAPPPATVHGIPLESGYVGLLAYGPTSRNRVETRQGEQPPRSKSSSAAADAAMDPKLVEVTQLFSRFKAAFARNDFDTCVDLLSQLKVRLTKFPSLPPSFQQTPNAVEELKIARDIYEHAVVLSVKIEDQDAFERDFCQLKPYYMDTXXLLVQNRIAEFHTELELLPVTALENPCIKHAVELEQSFMEGAYNRVLSARQAVPHETYVYFMDLLAKTVRDELAGCSEKGYDYMSIAEARQVLMFSSDKELHQYIAEEHPEWEVKDGSVFFQKAKETQPCKEIPSLQVINQTLSYARELERIKMCPSFCCRRNQRPSTCKHHLRWRIWVAGTTTHATIKWIRNAIQVSDFFTGPSHAIVNEVILEREELDLSTSRFVVCRTGTVPSGHDSSSFVHAIGNTTSSSAASPCAAAAPPTLGLSSGSGSTCTRTQLSQTRSINVQRHAVDDITVGALNATMHNTTSNHLESLVRWRPVLRRRLPPPPLPTAAATAPAKSARQRVNDAMSDETASQTTKGGDLLWFSEKKEALYPVFQLRDVIHANARDEGAGKGRRNPSSAAHEPTPKFAASDPPPPKLKLFNCVSIDYAIGSGEGSEFAVDAYAIAAAGGDVCVLDLLHLLARQGGTLTSTESIGVGPLPMALGLPHAVSRRPPGIAPCSTCLPLLASLTTSSAVHTSTCACRILAVTGSSELATSNGIVGEFGALALASAVAPSLPLPSPPRYTGSKKIVDSKATQEDLQPQLHDCESIARMRAACELTARVLEYAGTLVKPLATTDEIDRAVHQMIIDAGAYPSPLGYGGFPKSVCTSVNECICHGIPDSRVLQNGDIINIDVTVYLNMNQVLISIDLKALKKGTQKLIRMLFFPVISKHFPLKFTEKFCFIEYVDEYGYSIDPFVGHGIGKIFHSEPIIWHTYDYEPGYMVAGQTFTIEPTLSMGGTQCTLWDDGWTAVTVDSSLTAQFEHTILVTGDGAEILTMHPRPNCPFKETKNPYSHTQKAEAPNGRTGALITDMWHSLTSATDYGSTSSFSYRKRPLAPCSSHEAIEENFLKDMKPPLIVSFLPVMAIQPIMNMGEYPHQEIVLVLYTHVEEYPY

SEQ ID NO: 3089 - protein, 267 aa, Oryza sativa; identical to SEQ ID NO: 1196

SEQ ID NO: 3090 - protein, 222 aa, Oryza sativa
  unsure (1)..(222): unsure at all Xaa locations
PRVRSEVTQLIVSSYLAGRRRGRRGGGARRSLVGEFAGEIDHGXNLKATELRLGLPGTEEEXRRRRRLTPRAGSKRALAGEPDQAKXSSPPPXAKAQVVGWPPVRSYRKSCLQQQKEDVAGAGGLFVKVSMDGAPYLRKIDLKVYKGYRELREALEAMFLCFSGGAAADAAVNPSDFAVTYEDKDGDLMLVGDVPFEMFISTCKRLRIMKGSEARGLGATRG

SEQ ID NO: 3091 - protein, 302 aa, Oryza sativa
MGAMDVQLESTAVQHGQAKINVEEHALVSLLSDEKYATEKTEDVDPDDYEKLEEGIMQYGCAHYRRRCRIRAPCCNEIFDCRHCHNETKNSIKIDAVKRHELPRHEVQQVICSLCGTEQEVRQVCISCGVCMGKYFCEVCKLFDDDVSKQQYHCNGCGICRIGGKENFFHCSKCGCCYSIVLKNSHACVEGAMHHDCPICFEYLFESTNDVSVLPCGHTIHVKCLREMEEHCQFACPLCSKSVCDMSKAWERLDEELATISDTCDNKMVRILCNDCGATSEVQFHLIAHKCQKCKSYNTRQI

SEQ ID NO: 3092 - protein, 562 aa, Oryza sativa
  unsure (1)..(562): unsure at all Xaa locations
TLLHHLRVTLVVXYMEPMDLYGAYGSMRTYGRFCSGIDYDQLASSKQRSTAMSRSVGVTMDAAGADADQARLHQLGYRQELKRGLSLVSNFAFSFSIISVLTGVTTTYGTGLRYGGPVSMTLGWLVVAAFNGCVALSMAEICSAYPTSGGLYYWSAKLAGKEWAPLASWVTGWFNIMGQWACTTSVDFSLAQLLQVIILLATGGANGGGYMASKYVVLAIYSAILILHGLINSLPIRWLSWFGQLGAFWNVAAVAKERVSPEFIFTHFNAENGAGIHDKAYILAAGLLMSQYSLIGYDTSAHIIEETKNADWSGPIGIITSVALSTMFGWIYLIALTSIMTDIPYLLNPSNDAGGYAIAQALYTSFHRRYGTGAGALACLGVIAVAIFLCGSACITSNSRMGYAFSRDGAMPLSRVWHRVDSREVPLNVVWLSVAVAFVMALTSLGSQVAFQAMVSIATLGLLIACALPVFFRVTTARRSFVRGPFHLGKYGVIVGWVGVVWVATVTVLFSLPVAYPVAKETFNYTPVAVGGVLLLSLVAWVLHARFWFQGPVTNVDTYNVP

SEQ ID NO: 3093 - protein, 1661 aa, Oryza sativa
MPHTLLRDLVNINLLDRRWLSEMGECKLSASMDNYVGAKTSHTCLIWVHRAPTLYDHQGAEKCKANKKFLHVDGIIFIILKSKLYFALCKLHRVSLVFTWTQLLCGTAPAEAYIYSITEQRNRGDIIEKSSEQTPTAMSRSGVVAMDAAGADADQARLHQLGYRQELKRGLSLVSNFAFSFSIISVLTGVTTTYGTGLRYGGPVSMTLGWLVVSAFNGCVALSMAEICSAYPTSGGLYYWSAKLAGKEWAPLASWVTGWFNIVGQWACTTSVDFSLAQLLQVIILLATGGANGGGYMASKYVVLAIYSVILILHGLINSLPIHWLSWFGQLGAFWNVAENGMGIHQKAYILAVGLLMSQYSVIGYDTSAHMIEETKNADWSGPMGIITSVGLSTMFGWIYLIALTSIMTDIPYLLNPSNDAGGYAIAQALYTSFHRRYGTGAGALACLGVIAVAIFLCGSACITSNSRMGYAFSRDGAMPLSRVWHRVDSREVPLNVVWLSVAVAFVMALTVNSKSIAAAAAVNFSSCSDLVVFSWQSLGSQVAFQAMVSVTTLGLYIAYALPVFFRVTTARKSFVPGQFHLGRYGLMVGWMAVVWVATVTVLFSLPVAYPVAKETFNYTPVAVGGVLLLSLVAWVFHARFWFQGPVTNVDARSRQRRLSPPRAAGRESRRRRLPPSRAARRGDADGGGAASRHVAAVDDPRAVEEHGDQEPAANGVDQAAAANGGNQAVAANGQPPRSPAAALRRLHDLIATDAFHRDHQAPAPLLPPPHAALLLPSRPLGLPRPRRVHLRGVDIAARESHPVIRFAHADANLRRLPHARRSLGEDGRRQGETGGTRPAEGRLPLSSPRPLDADADVEAVPELTVVDPDGVSAGAGGIAGEGNLDVALLLQCVKPALRREGGNTQLATWTASTPLCLWRGLRWRLGLRMPFPFIMLQSRWPAEEKSDGGARWRRHQSPPLPPPSPSPTSPATSSRPCESRKPSRWIKPGLKTTEEPKTNGFRSYCLNQTLVPCTEPVKFLQIYCKGSTIQMALSRSVEVAVPADPAGDGDRDKIRLRQLGYKQELKRGLSVLSNFAFSFSIISVMAGVTTTYSTGLRYGGPVSMTLGWLVVSAFNGCMALSMAEICSAYPTSGGLYYWSAKLAGNDWAPFASWITGWFNITGQVGTFGFLGPGFSLIDGPFYWAMSTERNKFTLGPFICCPVRFSSLNHKTGHRRCRRRRPCCSSPRPSPRRRRRPACRDCRGGGEEEDEDAGGSSGGEEEDEDAGGGGALGVVSWAATTSVDFALAQLVQVIVLLSTGGANGGGYMASNYVVLAIYGAMLVIHGAINSLPIQCLSWFGQLGAFWNAAGVFVLVALIPAVATERASVEFIFTHFNTENGMGIRDKAYILLIGLLMSQYAMAGYDTSAHMTEETKNADWSGPIGIVTSVALSTVFGWIYIVSLTSAVTDIPYLLSPDNDAGGNAVAQAFYTTFHRRYGSGLGGILCLGVVAVAVFLCGLACITSNSRDGAMPFSKVWHRVNKQEVPINAVWLSVVVAFIMALTSLGSQVAFQAMVSIATIGLCISYALPIFFRVTTARGSFVPGPFHLGKYGIVVGWAAVLWVAAVTVLFSLPVAYPVAEETFNYTPVAVGGVLLLTVGAWALRARFWFQGPITNTNDGPL

SEQ ID NO: 3094 - protein, 510 aa, Oryza sativa
SRSVGVTMDAAGADADQARLHQLGYRQELKRGLSLVSNFAFSFSIISVLTGVTTTYGTGLRYGGPVSMTLGWLVVAAFNGCVALSMAEICSAYPTSGGLYYWSAKLAGKEWAPLASWVTGWFNIVGQWACTTSVDFSLAQLLQVIILLATGGANGGGYMASKYVVLAIYSAILILHGLINSLPIRWLSWFGQLGAFWNVAAVAKERVSPEFIFTHFNAENGAGIHDKAYILAAGLLMSQYSLIGYDTSAHIIEETKNADWSGPIGIITSVALSTMFGWIYLIALTSIMTDIPYLLNPSNDAGGYAIAQALYTSFHRRYGTGAGALACLGVIAVAIFLCGSACITSNSRMGYAFSRDGAMPLSRVWHRVDSREVPLNVVWLSVAVAFVMALTSLGSQVAFQAMVSIATLGLLIACALPVFFRVTTARRSFVRGPFHLGKYGVIVGWVGVVWVATVTVLFSLPVAYPVAKETFNYTPVAVGGVLLLSLVAWVLHARFWFQGPVTNVDTYNVP

SEQ ID NO: 3095 - protein, 925 aa, Oryza sativa
  unsure (1)..(925): unsure at all Xaa locations
MSRSGVVAMDAAGADADQARLHQLGYRQELKRGLSLVSNFAFSFSIISVLTGVTTTYGTGLRYGGPVSMTLGWLVVSAFNGCVALSMAEICSAYPTSGGLYYWSAKLAGKEWAPLASWVTGWFNIVGQWACTTSVDFSLAQLLQVIILLATGGANGGGYMASKYVVLAIYSVILILHGLINSLPIHWLSWFGQLVAFWNVAENGMGIHQKAYILAVGLLMSQYSVIGYDTSAHMIEETKNADWSGPMGIITSVGLSTMFGWIYLIALTSIMTXDIPYLLNPQQPTAXGGYAHPRRLPPSFPRRYGTRPPALACLGVIAVAIFLCGSACITSNSRMGYAFSRDGAMPLSRVWHRVDSREVPLNVVWLSVAVAFVMALTVNSKSIAAAAAVNFSSCSDLVVFSWQSLGSQVAFQAMVSVTTLGLYIAYALPVFFRVTTARKSFVPGQFHLGRYGLMVGWMAVVWVATVTVLFSLPVAYPVAKETFNYTPVAVGGVLLLSLVAWVFHARFWFQGPVTNAESPAAAFSTARSREGAVDDPRAVEEHGDQEPAANGVDQAAAANGGNQAVAANGQPPRSPAAALAAEVACCSGVCTTSSPRTPSTATTRHQRHCSRHPMPLFFYRLDHWAYPDRVASTSAASTSPPASPTRSFASPTPTPTSAVCRTPGHLLHARAPSAPPAGRSPHRRLVLRQARAAAPPVARRRPLRPQLLPSPAAAITAAASPASPSNWREGETGGTRPAEGRLPLSSPRPLDADADVEAVPELTVVDPDGEATETAGGGRRRPSGGGGAPVPLLDLGHYAGVDEVGSGGGPRAPSGVSSARRRPHRRRGERHSRERQMWVMANDAALQKVAREGNLDVALLLQCVKPALRREGGNTQLATWTASTPLCLWRGLRWSTAATLSPPNPRRPLHNPCRRPCCRILGASA

SEQ ID NO: 3096 - protein, 335 aa, Oryza sativa
MWCSPPYRGEGHKKVSPHMEYSRWEYSTRPVYGWGDVTSKQKSTAGWLAAFPFFEPHWQICMAGGLSTGWIEWDGERFEFENAPSYSEKNWGAGFPRKWYWVQCNVFSGAFGEVALTAAGGLRKIGLGETYESPSLIGIHYEGKFYEFVPWTGTVSWDIAPWGHWKLSGENKNHLVEIEATTKEPGTALRAPTMEAGLVPACKDTCYGDLRLQMWEKRNDGGKGKMILDATSNMAALEVGGGPWFNGWKGTTVSNEIVNNVVGTQVDVESLFPIPFLKPPASCFQPENYRNSKPISMEFILVGLEKGAFRVKSCCTNFYRSGMDAVIQENKYNSS

SEQ ID NO: 3097 - protein, 457 aa, Oryza sativa
  unsure (1)..(457): unsure at all Xaa locations
LLPARSIRGGLAAAAGGVSFPRPAPPPRRCAPRXHRRALAPRAGSSSPSPSTAVAAPVYAPTPRDRALRTPHSGYHYDGTARPFFEGWYFKXVSIPECRQSFCFMYSVENPXLFRDGMSDLESGHTMVPRFTGXVAAQILGADDKXYICQFTEKSNNFWXXEFSSRVLEGFQVTPIWHQGFIRDDGRSKYVPNVQTARWEYSTRPVYGWGDVTSKQKSTAGWLAAFPFFEPHWQICMAGGLSTGWIEWDGERFEFENAPSYSEKNWGAGFPRKWYWVQCNVFSGASGEVALTAAGGLRKIGLGETYESPSLIGIHYEGKFYEFVPWTGTVSWDIAPWGHWKLSGENKNHLVEIEATTKDPGTAFRAPTMEAGLVPACKDTCYGDLRLQMWEKRNDGGKGKMILDATSNMAALEVGGGPWFNGWKGTTVSNEVVNNVVGTQVDVESLFPIPFLKPPGL

SEQ ID NO: 3098 - protein, 150 aa, Oryza sativa
  unsure (1)..(150): unsure at all Xaa locations
XGRXXPXESPISMYGDDTGSGMXHVSVLNFGDPSRKHXMHCRFEKKPPWPWLAITSSFGTLVIALLTGHIFQATVHRIAKVEDDFHKMSELKKRAEDADVAKSQFLATVSHEIRTXMNGVLXXVHCLRFKXLSLDQLXLTSMSIIFGFAX

SEQ ID NO: 3099 - protein, 508 aa, Oryza sativa
MESEMADAAPAPAVAAAATAEPLAAVAEEGEEGGEAAVGSTLTMERVAAAKKFIENHYRSQMKNIQERKERRFRLERQLESSQVPREQQINLLKDLERKETEYMRLKRHKICVDDFELLTIIGRGAFGEVRLCREKTSSNIYAMKKLKKSDMVVRGQVEHVRAERNLLAEVASHCIVKLYYSFQDSEYLYLIMEYLPGGDIMTLLMREDTLTEHVARFYIAETILAIESIHKHNYIHRDIKPDNLLLDKNGHMKLSDFGLCKPIDCSKLSTLNEDEPMGDDNLRESMDIDSSFSETTNGRRWRSQHEQLQHWQMNRRKLAFSTVGTPDYIAPEVLLKKGYGMECDWWSLGAIMYEMLVGYPPFYSDDPITTCRKIVHWRNHLKFPEDSKVSPEARDLICRLLCDVDHRIGSAGADQIKAHPWFRGVAWEKLYEMEAAFKPQVNDELDTQNFMKFEEMDNAPTRTGSGPSRKMMLNSKDLSFVGYTYKNFDAVKGLKHSDSFPKKKKKK

SEQ ID NO: 3100 - protein, 257 aa, Oryza sativa
MAANFWTSSHCKQLLDQEDVDKVPQADSDRGITLEEFRLVKIHMSFHIWRLAQQVKVRQRVIATAVTYFRRVYTRKSMTEYDPRLVAPTCLYLASKVEESTVQARLLVFYIKKMCASDEKYRFEIKDILEMEMKLLEALDYYLVVYHPYRPLLQLLQDAGITDLTQFAWGIVNDTYKMDLILIHPPYMIALACIYIASVLKDKDITLWFEELRVDMNIVKNISMEILDFYDTYKIDPQRGLPEDKIAPVMNKLPSKA

SEQ ID NO: 3101 - protein, 220 aa, Oryza sativa
  unsure (1)..(220): unsure at all Xaa locations
XEXSTSCSGACSLSSGLLRQGSITMPPELSKKTVDEVWKGIQAAPNGGGGRRRRERQPTLGEVTLEDFLVKAGVVTQXMCYSNRDCGSGTWITXWIEQYHLMLAPVLFWSHPXSDGQXXSSGMIGGMSDSQTPGRKRGMSGDVADKLMERRQKRMIKNRESAARSRARKQAYTNELENKVSRLEEENVRLKRQKELDELICAVPVPEPKYQLRRTSSADF

SEQ ID NO: 3102 - protein, 294 aa, Oryza sativa
  unsure (1)..(294): unsure at all Xaa locations
AGASRGAEEXXRMRSLGRQGSMYSLTLDEVQSQLGXXPLHSMNLDELLRSVCLAIADGAGATTSSQQHQPGSGLLRQGSITMPPELSKKTVDEVWKGIQAAPNGGGGRRRRERQPTLGEVTLEDFLVKAGVVTQGSLKELSDVGNVDPVGRGVTATGTVDLAPGSHWIEQYKQPLNVGPGAILEPSYSDGQXXSSGMIGGMSDSQTPGRKRGMSGDVADKLMERRQKRMIKNRESAARSRARKQAYTNELENKVSRLEEENVRLKRQKELDELICAVPVPEPKYQLRRTSSADF

SEQ ID NO: 3103 - protein, 305 aa, Oryza sativa
  unsure (1)..(305): unsure at all Xaa locations
WRRRPEAGASRGAEEXXRMRSLGRQGSMYSLTLDEVQSQLGXXPLHSMNLDELLRSVCLAIADGAGATTSSQQHQPGSGLLRQGSITMPPELSKKTVDEVWKGIQAAPNGGGGRRRRERQPTLGEVTLEDFLVKAGVVTQGSLKELSDVGNVDPVGRGVTATGTVDLAPGSHWIEQYKQPLNVGPGAILEPSYSDGQXXSSGMIGGMSDSQTPGRKRGMSGDVADKLMERRQKRMIKNRESAARSRARKQAYTNELENKVSRLEEENVRLKRQKESDYLELDELICAVPVPEPKYQLRRTSSADF

SEQ ID NO: 3104 - protein, 101 aa, Oryza sativa
  unsure (1)..(101): unsure at all Xaa locations
AARQPMTINIGXCSSTIARVWMMTYPGVKXRITMKPXTDRWVXFLVTNTGIIVLAEGSFMNLGCATGHPRFVMFCLFTNQVIAXLELVKEKSTAKYLKKVX

SEQ ID NO: 3105 - protein, 552 aa, Oryza sativa
  unsure (1)..(552): unsure at all Xaa locations
MGNACGGSLRSKYLSFKQTASQRHDTDDNNNAAAADSPKKPSRPPAAAKTDDHPVSASAPAAAMRRGQAPADLGSVLGHPTPNLRDLYAMGRKLGQGQFGTTYLCTELSTGVDYACKSISKRKLITKEDIEDVRREIQIMHHLSGHKNVVAIKGXAYEDQLYVHIVMELCAGGELFDRIIQRGHYSERKAAELTRIIVGVVEACHSLGVMHRDLKPENFLLANKDDDLSLKAIDFGLSVFFKPGQTFTDVVGSPYYVAPEVLLKHYGPEADVWTAGVILYILLSGVPPFWAETQQGIFDAVLKGFIDFDSDPWPVISESAKDLITKMLNPRPKERLTAHEVLCHPWIRDHGVAPDRPLDPAVLSRIKQFSAMNKLKKMALRVIAESLSEEEIAGLKEMFQTMDADNSGAITYDELKEGLRKYGSTLKDTEIRDLMDAADIDNSGTIDYIEFIAATLHLNKLEREEHLVAAFSYFDKDGSGYITVDELQQACKEHNMPDAFLDDVINEADQDNDGRIDYGEFVAMMTKGNMGVGRRTMRNSLNISMRDAPGAL

SEQ ID NO: 3106 - protein, 258 aa, Oryza sativa
MRPTKLSRPTQLKPNHPMETVQLARPISGTAISGEVPDEPVVSKKSGLLFERRLVERYIEDHGKCPVTKEELTMDDIVAVKTNKVVKPRQLQAASIPGLLGMFQNEWDAIMLSSFALEQQLHTARQELSHALYQHDAACRVIARLKKERDEARALLAQAERQIPASMAGAAPTAVVSNGKRAAFEDEVGPDGKKIRPGINPVMIDELTECNTMLSAHRKKRQVPPTLASIDAIERYTQISSHPLHKTNKPGILSMDIH

SEQ ID NO: 3107 - protein, 657 aa, Oryza sativa
  unsure (1)..(657): unsure at all Xaa locations
MEWDSESDGAGSIGAGEEEEEEGGGGGGGGMFSFAIEGMLRASGPCGLVVTDALEPDCPIIYVNCGFEEATGYRAEEVLGRNCRFLQCRGPFAQRRHPLGDAMVVSEIRKCIDNGTELRGDLLNFRKDGSPLMNKLHLTPIYGDDETITHYMGIQFFTNANVDLGPLPGSLTKEPVRSTRSFSGPYPLDXGQSNFCREYSSLFQLTDEVLCQSILSRLSPRDIASVSSVCRRLYLLTRNEDLWRMVCQNAWGSETTRALETVPAAKRLGWGRLARELTTLEAVAWRKSTVGGAAEPXSRCNFSACAVGNRAAPFGGEGVNMPPMNDTFVLDLNASHPEWRHVNVSSAPPGRWGHTLSCLNGSLLVVFGGCGRQGLLNDVFTLDLDAKQPTWREIPGVAPPVPRSWHSSCTLDGTKLVVSGGCADSGVLLSDTYLLDVTMDKPVWREVPASWTPPSRLGHSMSVYGGRKILMFGGLAQSGPLRLRSSDAFTTDLSEEEPCWRCLTGSGMPGAGNRAGPPPRXLDHVAVSLPGGRVLIFXGGSVAGLHSXASQLYLLDPTEEKPTWRILNVPGRPPRFAWGHSTCVVGGTKAIVLGGQTGEEWMLTEIHELSLASSTVXASCCXVRSLFFMFQRASFRTIMIIHVWPETFLHWQDWNTG

SEQ ID NO: 3108 - protein, 474 aa, Oryza sativa
MAIAVSGRWTRLRTLGRGASGAVVSLAEDGASGELFAVKTAAAAEAAMLRRERGMMSGLSSPHVVPCIGGGDGPDGSYNLFLEFAPGGSLANEVARDGGRLEERAIRVYAADVLRGLTYLHGMSLVHGDVKADNIVIGVDGLAKLADFGCAKTMDSERPVSGTPAFMAPEVARGEEQGPAADVWALGCTVIEMATGRAPWSDMDDVLAAVHRIGYTDAVPEVPVWLSAEAKDFLAMCFARNAGDRSTAAQLLEHPFVAFACHEVKAAQPKPRWVSPKSTLDAAFWESETDDEEEVDEITESLCDRIKSLACPVSALPDWDSDEGWIDLLGEQCEACDSEAARESIDVARSAPSKVSSAATVPAAEVVLVGGGCCPSNEADAFDQSIGGDIQAADRSIERRNKVCAGSDNDVLPFRLRLALLGPSRPSTAHIRKPPPNPRGRSALTASASISSPRRACVDVKRGVCVAPRPHRLT

SEQ ID NO: 3109 - protein, 347 aa, Oryza sativa
  unsure (1)..(347): unsure at all Xaa locations
XAPRASIADVSCSADNSKKKEKSKKYGRVLEPDEPFKLFLRDRETTEFLTAKEERHLFSKIQILMKIEEAHRKLEVQCGREPTLAEWAEAVGMSSKELQSSIRTGRRCREKMARSNFRLVIHVARKYEGYGLDIQDLVQDGCSGLMKTFEKFNPSKGCRFPTYAYWWIRQSIKKSIFKNSRLIRLPESVYALLRKVGKARMECIMEGEQPTNANVARRAGITIEKLAKLRAKTRKPRSMQDHVWSDEGVTFQEITEDPNVEPPDLSVDRMMMRQQVRDFLGILSPREKEIIEHRFGIHDGEPKTLHVIGDMFGLSKERIRQLQNRALEKLKRSASLQGFDVYFDLLT

SEQ ID NO: 3110 - protein, 255 aa, Oryza sativa
  unsure (1)..(255): unsure at all Xaa locations
MDENGSSGNFCDSVREFIKRKNALLVGGHHFVNSFASSSSSAYVPPNPLHRSWNASFEANILPSTGVSNPPEYSSADSLNNSNSMASHPELVHHGNYVFPAGHMSQYNAWIAQASRXLVEYHSGNMAMQRLIXXPGVIDEHRDMRLDVDSMTYEELVALEERIGNVNSGFTESYIEENLKSSSYVPDADCMPDXXSSVEKDACIICQEEYEAKELVGTLGCGHKYHAMCIKGWLMVKNLCPICKTTALPADRRNG

SEQ ID NO: 3111 - protein, 287 aa, Oryza sativa
  unsure (1)..(287): unsure at all Xaa locations
MAIMYSPRVPRADTMHGLHRQAELVEYHSGNMAMQRLILQVDLFILGTIDMPNGGLQGYQAGPFANYYGPLPHFHQNPLNSMQHPALFNHIQMQVPHQHCLSNNLLHHPSGNGLPLDPRILAISSNSGHTFGPTAQPSLANQVNAGSSRIQPYENAPFVDLSRLYEAGVIDEHRDMRLDVDSMTYEELVALEERIGNVNSGFTESYIEENLKSSSYVPDADCMPDXXSSVEKDACIICQEEYEAKELVGTLGCGHKYHAMCIKGWLMVKNLCPICKTTALPADRRNG

SEQ ID NO: 3112 - protein, 446 aa, Oryza sativa
  unsure (1)..(446): unsure at all Xaa locations
MAVTIQSVKARQIFDSRGNPTVEVDVGLSDGSFARGAVPSGASTGIYEALELRDGGSDYLGKGVLKAVSNVNTIIGPALIGKDPTEQVDIDNFMVQQLDGTSNNWGWCKQKLGANAILAVSLAVCKAGAMVKKIPLYQHIANLAGNKTLVLPVPAFNVINGGSHAGNKLAMQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYKQLLRIEEELGDAAVYAGEKFRAPVKPX

SEQ ID NO: 3113 - protein, 312 aa, Oryza sativa
MARCFVLNTGAKIPSVGLGTWQAEPGVVGNAVYAAVKAGYRHIDCAQAYFNEKEIGVALKKVFDEGIVKREDIFITSKLWCTNHAPEDVPVALDSTLQDLQTDYVDLYLIHWPVRMKKGAGFGGQNVLPTDIPATWAAMEKLHDSGKARAIGVSNFSSKKLEDLLAVARVPPAVDQVECHPVWQQTKLRKFCTSKGIHLSAYSPLGSPGTASVKAVGNVLAHPVVVSTAEKLGKTPAQVALRWGIQMGHSVLPKSTHEERIKENIDVYDWSIPEDLFIKLSEIEQARLIRGEFWTHPEGVYKSIEELWDGEI

SEQ ID NO: 3114 - protein, 326 aa, Oryza sativa
MHFPACVQCLQQNTMARCFVLNTGAKIPSVGLGTWQAEPGVVGNAVYAAVKAGYRHIDCAQAYFNEKEIGVALKKVFDEGIVKREDIFITSKLWCTNHAPEDVPVALDSTLQDLQTDYVDLYLIHWPVRMKKGAGFGGQNVLPTDIPATWAAMEKLHDSGKARAIGVSNFSSKKLEDLLAVARVPPAVDQVECHPVWQQTKLRKFCTSKGIHLSAYSPLGSPGTASVKAVGNVLAHPVVVSTAEKLGKTPAQVALRWGIQMGHSVLPKSTHEERIKENIDVYDWSIPEDLFIKLSEIEQMKLIRGEFWTHPEGVYKSIEELWDGEI

SEQ ID NO: 3115 - protein, 367 aa, Oryza sativa
  unsure (1)..(367): unsure at all Xaa locations
MEAQNQEVAALVEKIAGLHAAISKLPSLSPSAEVDALFTDLVTACVPASPVDVAKLGPEAQAMREELIRLCSAAEGHLEAHYADMLAAFDNPLDHLARFPYYGNYVNLSXXFVFLGRYGRGIAPTRVAFVGXGPLPXSSLXLAAHHLPDAVFDNYDXRCGAANERARRLFRGANEGLGARMAFHTADVAPLTGELGAYDVVFLPALVGMAAEEKAGVIAHLGAHMADGAALVVRSAHGARGFLYPIVDPEDVRRGGFDVLAVCHPEDEVINSVIVARKVPTLFLVVVFPSYFFFFPLFFSYCSVLFFFFSSFSFPFSFPSAPLFFFLILPLFYSLPFLVSLSCVSLLSILSPISFLFLSSLLSLFAT

SEQ ID NO: 3116 - protein, 328 aa, Oryza sativa
  unsure (1)..(328): unsure at all Xaa locations
XXRTSKNLKQGSSIDDFALEGHYGFDRDKEFFATAGVNKKIKVFEYNMIVNEHCDIHYPVVEMSNRSKLSCICWNSYMKSHIASSDFEGIVQVWDVTRSQVFVEMREHERRVWSVDFSLADPTKLVSGSDDGSVKLWNMNQAISVGTIRTRANVCSVQFQPDSARSIAIGSADHKIYCYDLRNIRAPYCTLVGHTKTVSYVKYVDASTIVSASTDNSLKLWDLSMSQARIIDSPLRTFTGHTNTKNFVGLSISDGYIATGSETNEVFVYHKAFPMPVLAYKFSVTDPISGQEIDDPSQFISCVCWRGQSSTLLSANSSGNIKILEMDX

SEQ ID NO: 3117 - protein, 439 aa, Oryza sativa
  unsure (1)..(439): unsure at all Xaa locations
XIQESVLSKSSRLMKNFKKLETAYFLTRSKLAKQVGNPVSSCHXXVVKRTTGSPVVTEGSSIDDFALEGHYGTRQRGWMNSFLEGLCSYLSFSKLKVKAELKQCDLLNSSNLVCSVGFDRDKEFFATAGVNKKIKVFEYNMIVNEHCDIHYPVVEMSNRSKLSCICWNSYMKSHIASSDFEGIVQVWDVTRSQVFVEMREHERRVWSVDFSLADPTKLVSGSDDGSVKLWNMNQAGSVGTIRTRANVCSVQFQPDSARSIAIGSADHKIYCYDLXRNIRAPYCTLVGHTKTVSYVKYVDASTIVSASTDNSLKLWDLSMSQARIIDSPLRTFTXHTNTKNFVGLSISDGYIATGSETNXVFVYHKAFXMPVLGIXFRVTDPYQAXEIDDPSQFISCVCWRGQSSTLLSANSSGNIKILEMDXPCTNGQLVRVQFPIELI

SEQ ID NO: 3118 - protein, 316 aa, Oryza sativa
  unsure (1)..(316): unsure at all Xaa locations
MGECGGGEYRCWEELLPDALGLVFRNLPLREVLTVVPRVCKSWSREVAGPYCWQEIDIEEWRQQQGKPEQLVRMVEMLVARSCGSCRRISVSGLPGDPLFSFIGDHARALRTLEIPRSEISDAAVESVAPRLPNVTFLDISSCTKIGARALEAFGKNCKSLVGLRRVMHPTDVAGKACQRDEARAIACTMPRLRHLEMGYMVIATDAVLDILARCRDLRFLDLRGCWAVDDKFLQERHPGLRVLGPGVDDWXXENSYLEECSDYSDDSSIYSWELMEDDDDDYYAVGSDDEAIWDDGQGLENLEVSYAGFDWPPSP

SEQ ID NO: 3119 - protein, 76 aa, Oryza sativa
  unsure (1)..(76): unsure at all Xaa locations
SLXSLIAEAENDKHIVVVHGGMGIDRSIQLFQSRFPDRFFDLGIAEQHAVTFSAGLACGGFKPFCIIPSXTFFQRA

SEQ ID NO: 3120 - protein, 310 aa, Oryza sativa
MGAGVSGLFGLGGDEGETSAAVGGAAAAGLGDLPELCAAEVLLRLDAPEICRLARLNHAFRGAAGADFVWEAKLPENYRYLMSFVEGGGGGDDGRQLRRRRWRPAGKKEIYARLARPVPFDGGSKEFWLEKSKGRVCMALSSKSLVITGIDDRRYWQHIPTAESRFYSVAYLQQIWWFEVVGEIDFSFPVGTYSLYFRIHLGKFYKRFGRRVCSTEHVHGWDKKPVRFQLSTSDGQHSLSQCSLGEPGSWVLYHAGDFVVSKPDQTIKLKFSMAQIDCTHTKGGLCVDSAFIYPKGFQQERMVRSQKCRC

SEQ ID NO: 3121 - protein, 215 aa, Oryza sativa
  unsure (1)..(215): unsure at all Xaa locations
MGSVLCCLADDGRPVCCFRLPWPIFNXCVRAAAHNHNHNSGSIARPRADTRVAPDQGRISLTAPSQHDSMDTFRCPPRPCPWDVQPSYRASPTSSRTXQASTTFHKSGSLGESKNADSISNSKAVKDDGPSTAVKDDGSSVKHHSDGLHIGKEQVHDLFDFEDDCPICLEEYDYENPKMTLQCNHNFHLCCIYEWMERSQACPVCSKVMLFHEDS

SEQ ID NO: 3122 - protein, 262 aa, Oryza sativa
  unsure (1)..(262): unsure at all Xaa locations
MLPAEAWREENVYMVKLAEQAERYXVNGRIMEKVAKTTDVAELTVEERNLLCVAYKNVIGARRASXRIISSIEQKEESRVNDAYVASINEHRNKIETDLINICDGILKLLDSHLVPSATAAESKXVFYLTMKGDYHMYLAEFQSXAERNEAADNTLVAYKAAQDIRLGDLSTTHPIRLGLALSFSAFYYEILNXPDRACNLAKQAFDDAIAELDTLGEESYKDSPLXIMQLLRDNLTLWTSDNAEDGGDEIKEAAKPEGEGP

SEQ ID NO: 3123 - protein, 260 aa, Oryza sativa
MSPAEASREENVYMAKLAEQAERYEEMVEFMEKVAKTTDVGELTVEERNLLSVAYKNVIGARRASWRIISSIEQKEESRGNEAYVASIKEYRSRIETELSKICDGILKLLDSHLVPSATAAESKVFYLKMKGDYHRYLAEFKSGAERKEAAENTLVAYKSAQDIALADLPTTHPIRLGLALNFSVFYYEILNSPDRACNLAKQAFDDAIAELDTLGEESYKDSTLIMQLLRDNLTLWTSDNAEDGGDEIKEAAKPEGEGH

SEQ ID NO: 3124 - protein, 185 aa, Oryza sativa
  unsure (1)..(185): unsure at all Xaa locations
LTVTVPPPIYHLHIFADRXARKMGARCLALLLLYGTLLLLLLLPQLPLAGAATRYYTFNVKLQNVTRLCNTRAIPTVNGKFPGPKIVTREGDRVVVKVVNNIKDNITIHWHGVRQMRTGWSDGPAYVTQCPIQTGQSYVYNFTINGQRGTLFWHAHVSWLRSTLYGPIIILPXAGXPLPFXEPHX

SEQ ID NO: 3125 - protein, 271 aa, Oryza sativa
MKIQCDACESAAAAVVCCADEAALCAACDVEVHAANKLAGKHQRLPLEALSARLPRCDVCQEKAAFIFCVEDRALFCRDCDEPIHVPGTLSGNHQRYLATGIRVGFASASPCDGGSDAHDSDHHAPPMGSSEHHHHHQQPAPTVAVDTPSPQFLPQGWAVDELLQFSDYETGDKLQKESSPPLGFQELEWFADIDLFHNQAPKGGAAAGRTTAEVPELFASQAANDVAYYRPPTRTAAAAFTAATGFRQSKKARVELPDDEEDYLIVPDLG

SEQ ID NO: 3126 - protein, 346 aa, Oryza sativa
  unsure (1)..(346): unsure at all Xaa locations
XKGALTAPFPLLKSNHLGVVLTFTVYKYDLPPDATPEERIEATLGYLGASFDVPSLVERLLEQLASKQKIVVRLYDITNHTYPTKMYDSDVIASDDLHISNIDFGDPTRKHVMHCRFKHAPSLPWSAIMISSAVAIIVLLVGYIIYATLNSLEEAEDNYTTMRDLKGRAEAADVAKSQFLATVSHEIRTPMNGVLGMLQMLMDTELDTTQRDFVVTAQESGKSLINLINEVLDLAKIESGKIELEAVRFDVRDILDNVVSLFSEKSWAKGIELAVLVSDQVPDVLIGDPWRFRQIITNLVGNSMKFTEQGHIFIRVHLIEEVKRKMEALDDTSPENTLSGLEVANX

SEQ ID NO: 3127 - protein, 170 aa, Oryza sativa
  unsure (1)..(170): unsure at all Xaa locations
XHASEQIGGSEHELAAKVDKYACSMISGSGSTLFEEMRLYYIVTFDGYNIYDLMTMISEAKSTKTTCTVLIHVKTKKGRGYSYSERVRDKHHRGDKLDTTTVKQDELLDKTLVHTYYYGEALIDYAYHDNRLMKMHADLWRATAMSYILXRCAMLGFDVFIIEQDCNTFG

SEQ ID NO: 3128 - protein, 287 aa, Oryza sativa
  unsure (1)..(287): unsure at all Xaa locations
MAPPLLPAAEEDGGCVARWMRRDVLLGLALGQFVSLLITSTGFSSSELARRGINAPTSQSLLNYILLSLIYGGILIYRRQPLTIKWYYYLILGIIDVEANYIVVKSYQYTSLTSVMLLDCWSIPCVIILTWIFLKTKYGLRKFIGVGVCVAGLILVVFSDVHASDRAKGPNPLKGDLLVIFGSMLYACSNVTEEYLVKKSNRIGLMAMLGPFGAPISGIQIFSLTWHRSILERKELHSIKWNAGAVSPILPICTXHFFXAVVAMMELQTLLSKPFNXCLIXTNNKMX

SEQ ID NO: 3129 - protein, 464 aa, Oryza sativa
  unsure (1)..(464): unsure at all Xaa locations
XHEEAAKLHMFDAGVLFVLVGRVFRYNKEMLGKHMWKFPAPFLMNTVHFTMQAVASRVIVWFQHRGLEGAATMTWRDYFLRGDQSVAYFMPLDASTYLARESAVVPTALATALDINLSNISLVFITVTFATMVHFTLYESFSVFFINRFDVIELNFSSFFGRLEKPSFNLLGIILIVSFGVLLTGTEILNSSRNIAKETEFNLWGFVFIMLAAVMSGFRWCMTQILLQVYSLSYYCYDSKLMIGHVTINSHPFCFLXFTGLRNPFTLMSYVTPVMAITTAILSIAMDPWHDVRASHFFDNSTHIIRSSLLMLLGGALAFFMVWIMYPLVRISLLMMNVXPCTNRPFHLQVLTEYVLVSVTSAVTVTVAGIVKEAVTILVXLKFESTCNNXNXQVAVLFFNDTFTWLKGLGLGIIIFGVSLFNLYKYHRFKKGHRNKNCDKNPQTSSGASKYVILDXXDDMENQG

SEQ ID NO: 3130 - protein, 733 aa, Oryza sativa
  unsure (1)..(733): unsure at all Xaa locations
MAGAGAVGGSNWEEMVRRMLPPGTTIPEAPANLDYSIALEYDGPPPVSGPLVPGRSNGVVAPVVRPVFMPPVHRKQDAHRAEPPPVAAQGRRRRSSESVDSAPQNEGFSDDDDSCSVSQESAHNFHGQRGGRTAAQEGRRAQVVTFGVTEDSRYESKEFDDVSEQYVAVTKKEKRGRTCSRCGKRKWESKESCIVCDARFCSYCVLRAMGSMPEGRKCITCIGQPIDESKRSKLGKGSRILSRLLSPLEVRQILKAEKECQANQLRPEQLIINGFPLNPDEMASLLSCQRPPQKLKPGRYWYDKESGLWGKEGEKPDRVVSTNLTFNGKLQPNASNGNTQVYMNGREITKIELRVLKIAQVQCPRDTHFWVYHDGGYEEXEAQNNIKGKIWEXARTVPDYLDQKRIQKLLILGSPGAGTSTIFKQAKLLYDTRFTQEELDSIKLMIQSNMFKYLGILLEGRERFEEEALAGSNNPSSEDENTQHDGNKSNGSDSCIYSINAKLKKFSDWLLDIIAMGDLDAFFPAATREYAPIVEEXXYQLIRVSAKGMNEGCKWVEMFEDVSMVIFSVALSDYDQLGAPSSGGNSPLVNKMIQSRDLFEATIRQPCFRDMPFVLVLNKFDLFEEKIGRVPLSTCEWFSDFCPLRTHHNNQSLAHQAFYYVAMKFKELYAACTDRKLFVWQARARDRLTVDEAFKFIREVLKWEDEKDGGGYYPDESFYSTTELSSSRLIRQE

SEQ ID NO: 3131 - protein, 842 aa, Oryza sativa
  unsure (1)..(842): unsure at all Xaa locations
GAGAVGGSNWEEMVRRMLPPGTTIPEAPANLDYSIALEYDGPPVXSYELPRIDPVDLPAIPTAQPVSGPLVPGRSNXXAQGRRRRSSESVDSAPQNEGFSDDDDSCSVSQESAHNFHGQRGGRTAAQEGRRAQVVTFGVTEDSRYESKEFDDVSEQYVAVTKKEKRGRTCSRCGKRKWESKESCIVCDARFCSYCVLRAMGSMPEGRKCITCIGQPIDESKRSKLGKGSRILSRLLSPLEVRQILKAEKECQANQLRPEQLIINGFPLNPDEMASLLSCQRPPQKLKPGRYWYDKESGLWGKEGEKPDRVVSTNLTFNGKLQPNASNGNTQVYMNGREITKIELRVLKIAQVQCPRDTHFWVYHDGGYEEXEAQNNIKGKIWESPVTRFACALFSLPVPPANSDEPKDEAPYSARTVPDYLDQKRIQKLLILGSPGAGTSTIFKQAKLLYDTRFTQEELDSIKLMIQSNMFKYLGILLEGRERFEEEALAGSNNPSSEDENTQHVDADGNKSNGSDSCIYSINAKLKKFSDWLLDIIAMGDLDAFFPAATREYAPIVEEMWKDPAIQATYKRKDELHFLPDVAEYFLSRAIEVSSNEYEPSEKDIIYAEGVTQGNGLAFIEFTLDDRSPMSEMYTDNHEPHSQTLNKYQLIRVSAKGMNEGCKWVEMFEDVSMVIFSVALSDYDQLGAPSSGGNSPLVNKMIQSRDLFEATIRQPCFRDMPFVLVLNKFDLFEEKIGRVPLSTCEWFSDFCPLRTHHNNQSLAHQAFYYVAMKFKELYAACTDRKLFVWQARARDRLTVDEAFKFIREVLKWEDEKDGGGYYPDESFYSTTELSSSRLIRQE

SEQ ID NO: 3132 - protein, 867 aa, Oryza sativa; identical to SEQ ID NO: 964

SEQ ID NO: 3133 - protein, 316 aa, Oryza sativa
  unsure (1)..(316): unsure at all Xaa locations
XVVESVGEHVQEVAVGDMVVPVFAAQCSECPDCLSDRSNLCSKLPNXXAGLMPRDRTTRFSSVSTGEPIRHFLSVSSFAEYTVVDITHIVKLDVGFPPAMACLLSCGISTGVGAAWKVAAVEPGSSVAVFGLGAVXVAQGARMRGAKRIIGVDLNPDKFDVGKRLGMTDFINPNDTGGKTVSEVIKEMTGGGGADYCFECIGSTSVMAEAFQSTRNGWGKTILLGVSGNKAPISIPSHEILRGRSVIGSLFGGIKPKNDIPMLAQKYLDKELELEEFITHEMGFEEINRAFELLTQGKSIRCIIWMDGAKVIDNGE

SEQ ID NO: 3134 - protein, 477 aa, Oryza sativa
  unsure (1)..(477): unsure at all Xaa locations
XVVESVGEHVQEVAVGDMVVPVFAAQCSECPDCLSDRSNLCSKLPNVAGLMPRDRTTRFSSATGEPIRHFLSVSSFAEYTVVDITHIVKLDVGFPPAMACLLSCGISTGVGAAWKVAAVEPGSSVAVFGLGAVGLAVAQGARMRGAKRIIGVDLNPDKFDVGKRLGMTDFINPNDTGGKTVSEVIKEMTGGGGADYCFECIGSTSVMAEAFQSTRNGWGKTILLGVSGNKAPISIPSHEILRGRSVIGSLFGGIKPKNDIPMLAQKYLDKELELEEFITHEMGFEEINRAFELLTQGKSIRCIIWMDGAKVIDNGEVFDSALASVAVVLESIRSEGQLWSLAGERGALSNVDYDHLLAPVKASPRPLSREGEEEEGDIAMVAAQSFVSTQDSASDTVVDYSGNEDKFHEVPEPRRRRPFDGTGMNLARVFGTALVGWHWRHHWVYWLGPFIGAGLAGLLYEYLVIPSADATPHGGAH

SEQ ID NO: 3135 - protein, 363 aa, Oryza sativa
MGWWLGGGLPVIAMLALNVVAAVLVSLVKVAMDGGLNPLVLVTLQQLTAAIFLGPIAYFKERKSRPKLTLEIFTYLFVSAALGAALRQYMIFVALRYTTATFVTAFSNIAPVLTFLLAILTRSESLNLRRKTGIAKLVGTLISVAGAMVLTFYKGVAVTHTTKIHHATAAAAVAAEAAMSSRNWTLGTVAILGNCVCLSCWFLLHSRLAKKYPHVYSCNAFMCMFSFLQVAVVGLSTQRNVSVWIVRTKFHILTILYAGVVGCGLSFVLLTWCIEKRGPVFVAAFIPVVQIIVSVIDFTVLHEQLFLGSVLGSVLVIGGLYLLLWGKRQEALHLPPKVAEHDKEQQQQQQQQQQQQQQQQVQL

SEQ ID NO: 3136 - protein, 309 aa, Oryza sativa
  unsure (1)..(309): unsure at all Xaa locations
XDSRCRKIWFYQILPFFVNELFFLLFCLGRCVIVEDGKVISSGSNKTNATRNATRHAEMEAIDILLREWQGMGLDQPQVAEKFARCDLYVTCEPCIMCAMALSILGIREVYFGCANDKFGGCGSIMSLHQSSSAELSGEEIPGPKGYKCTGGIMAEEAVALFRNFYEQGNPNVPDLTIIASTSVVYSRGCRNRVISFPSTRAPHSRNPATISICRSPSSNFGILKREQSASAPGANGLVDHLISSLVRGRRSRTPARSSTAEEASVDRYREDPAALSPRMRPRPRVPLPPAPGPHPVLAVGDPCLFAMA

SEQ ID NO: 3137 - protein, 598 aa, Oryza sativa
  unsure (1)..(598): unsure at all Xaa locations
MGGEVPEPRRLNRALSFDDWVPDEALHLVMGHVEDPRDREAASRVCRRWHRIDALTRKHVTVAFCYAARPARLRERFPRLESLSLKGKPRAAMYGLIPDDWGAYAAPWIDELAAPLECLKALHLRRMTVTDADIAALVRARGHMLQELKLDKCIGFSTDALRLVARSCRSLRTLFLEECHITDKGGEWLHELAVNNSVLVTLNFYMTELKVAPADLELLAKNCKSLISLKMSECDLSDLISFFQTANALQDFAGGAFYEVGELTKYEKVKFPPRLCFLGLTYMGTNEMPVIFPFSMKLKKLDLQYTFLTTEDHCQIIAKCPNLLILEVRNVIGDRGLEVVGDTCKKLRRLRIERGDDDPGLQEEQGGVSQLGLTAVAVGCRELEYIAAYVSDITNGALESIGTFCKNLYDFRLVLLDRERQVTDLPLDNGVCALLRNCTKLRRFALYLRPGGLSDDGLSYIGQYSGNIQYMLLGNVGESDHGLIRFAVGCTNLQKLELRSCCFSEXRALSLAVLXQMPSLRYIWVQGYRASQTGLDLLLMARPFWNIEFTPPRRVLIIXQKMENPXVDSHAQVLAYYSLAGRRSDCPQWVIPLHPAXL

SEQ ID NO: 3138 - protein, 122 aa, Oryza sativa
  unsure (1)..(122): unsure at all Xaa locations
XLLIHEGVQAEGELLKLGRVPVLDSTDIVGYKIGLTIIRDGLKGDPSKYLEMTVRLVGVSAETTTGVMRLLQMLDTGALLLDDINXIIDSVTNSRLDNLYGCRHSLPDGLMRATYLMIADKD

SEQ ID NO: 3139 - protein, 263 aa, Oryza sativa
  unsure (1)..(263): unsure at all Xaa locations
XPCVRPRVRSARAVTFHDFMGQNFTSEHLPVSAPGATPPGPYIAYFQPLQSSASSSSSHGGERTMDGTTYHDHWNPLPGPSDGRPLATVHPIDFHHNHWTHLPNSYSQPNSNNGVAEQMAIPVVPMRVGGLDSDSQQRGSLPSVYGNGSGSRSRIPSVPPSAPLSLCPHGXXTGPNSMETEDAGGNQFXAWERDRFAPYPLMPVDSEANWWGSTPQSHGVTDHSAAPGRRLFGQWIGAGRSPPPPPPPPADNSSYRQMHIPRM

SEQ ID NO: 3140 - protein, 533 aa, Oryza sativa; identical to SEQ ID NO: 1207

SEQ ID NO: 3141 - protein, 228 aa, Oryza sativa
MAPAAARWLRREVFVGLALGQFVSLLITSTGFSSSELARRGVNAPTSQSLLNYVLLALVYGGILIYRRQHLTIKWYYFLILGIVDVEANYIEGPNPLKGDLFVIAGAMLYAVSNVTEILPFIGFAVAMFLFYSTVPIILKICGATMLNLSLLTSDMWAVLIRIFAYHEKVDWMYFVAFAGTAAGLVIYSYKGSKVAEETAQVAGATDEEAATRVAGAGDDEPASTNKE

SEQ ID NO: 3142 - protein, 260 aa, Oryza sativa
  unsure (1)..(260): unsure at all Xaa locations
MAPAAARWLRREVFVGLALGQFVSLLITSTGFSSSELARRGVNAPTSQSLLNYVLLALVYGGILIYRRQHLTIKWYYFLILGIVDVEANYIVVKAYQYTSLTSVMLIDCWAIPCVILLTWVFLKTKYGLRKFIGVVICVAGIILVVFSDVHASDRATLTAHRIKHKTKLGNAHEXTLHVLPTTFQEYFVKKSSRIEXSILERQELRSTEWNAGAILPFIGFAVAMFLFYSTVPIILKKTLASRGSKPTRRSPRWLLLPQX

SEQ ID NO: 3143 - protein, 339 aa, Oryza sativa
  unsure (1)..(339): unsure at all Xaa locations
MAPAAARWLRREVFVGLALGQFVSLLITSTGFSSSELARRGVNAPTSQSLLNYVLLALVYGGILIYRRQHLTIKWYYFLILGIVDVEANYIVVKAYQYTSLTSVMLIDCWAIPCVILLTWVFLKTKYGLRKFIGVVICVAGIILVVFSDVHASDRAKGPNPLKGDLFVIAGAMLYAVSNVTEEYFVKKSSRIEVMAMLGVFGAVISGIQMYPLDYYRSILERQELRSTEWNAGAILPFIGFAVAMFLFYSTVPIILKICGATMLNLSLLTSDMWAVLIRIFAYHEKVDWMYFVAFAGTAAGLVIYSYKXVAEETAQVAGATDEEAATRVAGAGDDEPAS

SEQ ID NO: 3144 - protein, 168 aa, Oryza sativa
  unsure (1)..(168): unsure at all Xaa locations
MEVGGGGRPLPRIPWRQSLARTAIPDGPAAASMRSCAPKQPIRSVISLMEPYGVTNQVFRYAKKVGASYINKPKMRHYVHCYALHCLDEEASDALRRAYKARGENVGAWRQACYAPLVDISARHGFDIDAVFAAHPRLAIXXRRRLCCCSRAATARGSFLWCWAVFSL

SEQ ID NO: 3145 - protein, 389 aa, Oryza sativa
MDPNDAFSAAHPFRWDLGPPAPAPVPPPPPPPPPPPPANVPRELEELVAGYGVRMSTVARISELGFTASTLLAMTERELDDMMAALAGLFRWDLLLGERFGLRAALRAERGRLMSLGGRHHGHQSGSTVDGASQEVLSEEHDMAGSGGMGDDDNGRRMVTGKKQAKKGSAARKGKKARRKKVDDLRLDMQEDEMDCCDEDGGGGSESTESSAGGGGGERQREHPFVVTEPGEVARAKKNGLDYLFHLYEQCRLFLLQVQSMAKLHGHKSPTKVTNQVFRYAKKVGASYINKPKMRHYVHCYALHCLDEEASDALRRAYKARGENVGAWRQACYAPLVDISARHGFDIDAVFAAHPRLAIWYVPTRLRQLCHQARSSHAAAAAALPPPLF

SEQ ID NO: 3146 - protein, 583 aa, Oryza sativa
MGSMPEGRKCVGCIGRPVADARRRARLGKGSRLLARLLAPAEVRQVMRAERGCAANQVRPGEILVNGRGLSQGELDLLLGCAVPPERLAAGRYWYDKDSGLWGKEGERPDRIVSSKLSIGGKLQTDASNGTTQVFINGREITKTELRMLKLANVQCPRNTHFWLYDDGSYEEEGQNIIKGNIWQKAKFLYGTEFSPEEILNLKLMIQSNVYKYLSTLLEWRECFEDEALEEEKELGMSNHKGDENVTECELPTGEPKAVQSTSSLYSLNQRLMHFANWLLEIVALGNLDAFFPAATREYAPIVEEVWKDPAIQATYKRKNELHFLPDVASYFLDRVVEISSNEYEPTETDILYAEGVNQWNGLSTLEFSLDDRGPLSDSYADKAGNPAIQTKYQLIRMNSKGLTGGFKCLGMLEDIRAIIFCISLADYDQTWVQSSGEPCNKMIASRDLFEDVIRHPSFEDTPCVLLLNKYDAFEEKISRVPLTVCEWFADFSPVRPHHTSQTSLASHAYYYVAVKFKDLYSSVADGRKLFVFQTKALERRTVDDAFRYIREVLRWDDVKNSDAGYCSADESSYSVDMTTSPS

SEQ ID NO: 3147 - protein, 250 aa, Oryza sativa
  unsure (1)..(250): unsure at all Xaa locations
MHLCLLHYDTCTSLCKDNMACCSSLLRLMILPVAFAVLVIASVAHGAVVEHTFNVGNLSISRLCQQMIITAVNGQLPGPTINVTEGDTVVVHLVNESPYNMTIHWHGVFQRGSQWADGPSMITQCPVGPSDNYTYRFNVSDQEGTLWWHAHISFLRATVYGAIVLNPRAAAPFPAKPDTEHVVLLGEWWNANVVDLERMAFLTGIPARNADAYTINGKPGDLYNCTADQTEVFRVRRNETHLLRIINAAX

SEQ ID NO: 3148 - protein, 77 aa, Oryza sativa
  unsure (1)..(77): unsure at all Xaa locations
XLXRAHACAHTSGYEVMVEYMXMVANTAYVEELTGVERNLLAAADKNVNAAHRACWRIALSIVQTEEGRANEEHVTX

SEQ ID NO: 3149 - protein, 560 aa, Oryza sativa
  unsure (1)..(560): unsure at all Xaa locations
MVMPGGSSMMRLLWFLFALLLARSVADAATANYTFTVESMRVSRLCNSTDIIAVNGQLPGPMIEVNEGDAVAVEVINGSPYNLTIHWHGILQLLTPWADGPSMVTQCPIQPNSSYTYRFNVTGQEGTLWWHAHSSFLRATVYGALIIRPRNGSAYPFPAPDQEVPIVLGEWWSRNVVDIESDAVSSGQLPRESDAFTVNGVTGELYQCANDTFTVDVQPNTTVLLRVINAGLNTHLFFKVAGHAFTVVAVDACYTANYTTDTLVLAPGHTVDALMVTNASAXXSYYMAVQAYDSLSPXPPWPXPNTTATAIVHYNTTSTKKNATPVMPTMPQSSDSATANAFYFGLRGXXPSPSAPAVPTKVDVNMTIELGLGQLPCAQSSCSGKFAAAMNGVSFRLPSQMSLLEAQFNRTPGVYTADFPDAPXXPSGTPMVEGXXQVRRLKYNSTAGVVXEHTAAFPSENPPIHLHGFNFFVLAQGLGNFTPGNVSGYNLVDPVSRNTLAVPTGGWAVIRFVANNPGMWFFHCHLDAHVPMGLGMVFAVDNGTTPDSFLPPPPADLPKC

SEQ ID NO: 3150 - protein, 349 aa, Oryza sativa
  unsure (1)..(349): unsure at all Xaa locations
XDGGEVSLREWLDRPGRAVEAPECLHVFRQVAESVAIAHAQGVAVGSARPSCFVVSPPFARVAFIESASGSDVSGSCSGSDGSEEADPEPSPPRRRRDGASGGEDRGGKTFPLRSVLAMELTWYTSPEEADGGGATFASDVYRLGVLLFELFCTFETMEEKMRAMANLRHRVLPPQLLLKWPKEASFCQLLMHPVPETRPKMSDVLQSEFLNRSRNSLEEREAALRLREEIEEQELLLDFLLQLQRRKQDIADNLQDTVAFLSSDINEAHQQSALGQSETVEDQSDCGSRKRFRPELPAVDMEEQNRSLEECSGTVPSSVLIQESVLSKSSRLMKNXQKLETAYFLTRX

SEQ ID NO: 3151 - protein, 360 aa, Oryza sativa
  unsure (1)..(360): unsure at all Xaa locations
MAGGGGAGGMSESVLRKVLLSYCYVGVWIFLSFAVIVYNKYILDPKMYNWPFPISLTMVHMAFCSSLAVALVRLLRVVEPPSSPAMTPQLYTSSVVPIGALYAMSLWFSNSAYIYLSVSFIQMLKALMPVAVYSIGVLFKKETFRSSSMLNMLSISFGVAIAAYGEARFDVRGVALQLAAVAFEATRLVLIQILLTSKGISLNPITSLYYVAPCCLGFLLVPWVFVELPRLRAVGTFRPDFFVFGTNSLCAFALNLAVFLLVGKTSALTMNVAGVVKDWLLIAFSWSVIRDTVTPINLFGYGIAFLGVAYYNHVKLQALKAKEAQKKISQADEEAGSLLQERDGHSDRKSDNQAXSHHQI

SEQ ID NO: 3152 - protein, 139 aa, Oryza sativa
  unsure (1)..(139): unsure at all Xaa locations
XGFPPFLFGGVFSHVFARGSVFTPGGVAPPGDALMEKVAFGVFMGAPVSLAILCPTFFFAPPLFLHGAKNLLFFFLGPQFLFPPFFKIQGFFXAPPQFFFFAPVSPPRGGVVPSAPQGEKKKERPRGGSHGGLGLSLFF

SEQ ID NO: 3153 - protein, 469 aa, Oryza sativa
MAVTADVKLEGLRAATDKLDQISENEKSGFISLVSRYLSGEAEQIEWSKIQTPTDEVVVPYDTLSAAPEDLNETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKTGKDGWYPPGHGDVFPSLNNSGKLDTLLAQGKEYVFVANSDNLGAIVDIKILNHLIHNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFEKAIGINVPRSRFLPVKATSDLLLVQSDLYTLVDGFVIRNPARTNPSNPSIELGPEFKKVANFLARFKSIPSIVELDTLKVSGDVWFGSGVTLKGKVTITAKSGKLEIPDGAVLENKDINGPEDL

SEQ ID NO: 3154 - protein, 321 aa, Oryza sativa
MAKHFVLNTGAKIPSVGLGTWQSDPGVVGDAVYAAVKAGYRHIDCARMYKNENEVGIALKKLFEEGVVKREDLFITSKLWCDCHAPEDVPESLDKTLSDLQLEYLDLYLIHWPFRVKKGSGISNTEDYIPPDIPSTWGAMEKLYDSGKSRAIGVSNFSSKKLGDLLAVACVPPAVDQVECHPGWQQTKLHNFCQSTGVHLSAYSPLGSPGSTWMNSNVLKESVIISIAEKLGKTPAQVALHWNIQMGHSVLPKSVTEERIKQNIDVYDWSIPEDLLVKFSEIKQVSSTSFDHLYLIVNVFKHLYRLFLNNQCLHMIWTNLH

SEQ ID NO: 3155 - protein, 539 aa, Oryza sativa
  unsure (1)..(539): unsure at all Xaa locations
MGSSVKDAGGGKEEQQQQLESPLLEAAVSSGGGDGGGGHGVSGELESILGDETVPWARRMWAATGVEMRLMLRLAAPAVLVYMINYLMSMSTQIFSGHLGTLELAAASLGNTGTRRVAVRLLLGMGSAVETLCGQAYGAHKYDMLGVYLQRSTVLLMATGVPLAVIYAFSRPILVLLGESPEIASAAAVFVYGLVPQIFAYAANFPIQKFMQAQSIMAPSAYISAATLAFHLVLSYLVVYQFGLGLLGASLMLSISWWVIVVAQFIYIVTSRRCRLTWTGFSMLAFSGLPDFFKLSLASAVMLCLETWYFQILVLIAGLLKDPEMALASLSVCMTISGWVFMISVGFNAAASVRVSNELGAGNPKSAAFSVVVVTVLSFFLSVVISLVILLCRDYISYIFTAGEAVATAGARLTPLLALTLILNGIQPVLSGVAVGCGWQAFVAYVNVGCYYIVGIPLGCLLGFYFDLGAAGIWSGMIGGTLMQTLILMWVTFRTNWNREVEEAMKRLNKWEDKTPLLSEXEQNKRKGYCGYYTESLHA

SEQ ID NO: 3156 - protein, 92 aa, Oryza sativa
  unsure (1)..(92): unsure at all Xaa locations
MLIGGDCLLPTIDLNLWSGAHCKQLLDHEDVDKVPQADSDRGITLEELRLVKIHMCFHIWRLGQQVKVRHRVIATGCTYFXRVYTRKSMTEY

SEQ ID NO: 3157 - protein, 274 aa, Oryza sativa
  unsure (1)..(274): unsure at all Xaa locations
GFRKIDPDRWEFANDGFLRGQRHLLKMIKRRRPLSYLPGSQQALGTCLEVGQFGLDEEIDRLKRDKNILLAEVVKLRHKQQSTKANMRAMEERLQHAEQKQVQMMGFLARAMQNPDFFHQLIHQQDKMKGLEDTFSKKRTRSIDXXSAISQPRGGQPXAINSSRHCCLIQGHLLNXMMSLQXSELENLALNIQGLGKGKQDVNRTRNQPRNQASNETELTDDFWEELLNEGARDDAGXFQGWSEDVDALAQKLGYLSNSSQKXIKWLRFVQPFL

SEQ ID NO: 3158 - protein, 421 aa, Oryza sativa
  unsure (1)..(421): unsure at all Xaa locations
MGRKRALLVGINYPGTKAELKGCHNDVDRMHRCLVDRFGFDEDDIRVLLDRDSSGTQPTGANIRRALAQLVGDARPGDFLFFHYSGHGTRLPAETGQNDDTGYDECIVPSDMNLITDQDFRELVQKVPNGCLFTIVSDSCHSGGLLDSAKEQIGNSTRQNQTQSREREEPSDSGSGFRSFLKETVRDVFESEGIHLPRSRHSQSPHGGEDQYETYAQPTDGHTKNRSLPLSTLIEMLKEKTGKDDIDVGSIRMTLFNIFGDDASPKXVKKFMKVLLGKFQQGPXSGEQGGXSWGMVGSXLAQEFLKVKLEGNEEEAFKPAIEQEVHSVDEVYAGTKTWAPNNGILISGCQSNQTSADATTPQGSSYGALSNAIQTILADKRGNVSNKDLVMKARSLLAKQGYTQQPGLYCSDDHVHVSFIC

SEQ ID NO: 3159 - protein, 1423 aa, Oryza sativa
MPSVSRAVCVQRASGNNGRRCRDGAAAAGRRSVVAQRARHGKPEVAIRSGSGGSARGGHCSPLRAVAAPIPTTKKRVFHFGKGKSEGNKAMKDLLGGKGANLAEMASIGLSVPPGFTVSTEACQQYQAAGKTLPAGLWEEIVEGLQWVEEYMAARLGNPARPLLLSVRSGAAVSMPGMMDTVLNLGLNDEVAAGLAAKSGDRFAYDSYRRFLDMFGNVVMDIPHALFEEKLEAMKAVKGLHNDTDLTATDLKELVAQYKDVYVEAKGEPFPSDPKKQLQLAVLAVFNSWDSPRAIKYRSINKITGLKGTAVNVQTMVFGNMGNTSGTGVLFTRNPSTGEKKLYGEFLVNAQGEDVVAGIRTPEDLDAMRDHMPEPYEELVENCKILESHYKEMMDIEFTVQENRLWMLQCRTGKRTGKGAVKIAVDMVNEGLVERRTALKMVEPGHLDQLLHPQFENPSGYKDKVIATGLPASPGAAVGQIVFTAEDAEAWHAQGKDVILVRTETSPEDVGGMHAAVGILTARGGMTSHAAVVARGWGKCCVSGCSSVRVNDASKIVVIEDKALHEGEWLSLNGSTGEVIIGKQPLCPPALSGDLETFMSWVDEVRKLKVMANADTPEDATTARQNGAEGIGLCRTEHMFFASDERIKAVRQMIMASSLELRQKALDRLLPYQRSDFEGIFRAMDGLPVTIRLLDPPLHEFLPEGHVEDMVRELCSETGAAQDDVLARVEKLSEVNPMLGFRGCRLGISYPELTEMQARAIFEAAITMTNQGIQVFPEIMVPLVGTPQELGHQVDVIRQIANKVFTDMGKTIGYKVGTMIEIPRAALVADEIAEQAEFFSFGTNDLTQMTFGYSRDDVGKFLPIYLSQGILQHDPFEVLDQRGVGELVKLATERGRKARPNLKVGICGEHGGEPLSVAFFAKAGLDYVSCSPFRSPAVGAPGLKEFLEEKQRNPIQWNNSYESLRACLVAALTTSCLAEDMPETNLIVHSIGISKDCTCLLLKKRIDPVYKKNRTRKPYNCTVNYGKPAKTHHTEESKRSSYTTSKQQRSPNVEHHCQAKTQKWPKQLQHHRRGVIVAELAAQTTQQRRLHNRSDTESAKVARAKSSSDIQQWTSAKPPKRHFLHTVSTNSLEETTTCHRCQASPHPISEQLRLHQQKQPKSLSPTTRTKRTQGGEGLAERQATPPRRTRRVTSSLLVRNRNKVFTRRFVGNMKERHDDAFKKVNGAQERRRGRTGQRHGKAFASVFTLLRQAPHVDDHGIDRDQSYLDVTKHVSASTSTHREQEAHHQRATLLEPASTPHSHRARRSPPEPCNTATRNRRPRHARSRSPPFLPPNSFPAFICCRWRRRVVCCTAPPSPAITTTAVSRRGPPVISTPPSPAAAASRHYHRSPLAAAAHPDPAGVARVRGTERATQHQAGARQP

SEQ ID NO: 3160 - protein, 332 aa, Oryza sativa
MEAQNQEVAALVEKIAGLHAAISKLPSLSPSAEVDALFTDLVTACVPASPVDVAKLGPEAQAMREELIRLCSAAEGHLEAHYADMLAAFDNPLDHLARFPYYGNYVNLSKLEYDLLVRYVPGIAPTRVAFVGSGPLPFSSLVLAAHHLPDAVFDNYDRCGAANERARRLFRGADEGLGARMAFHTADVATLTGELGAYDVVFLAALVGMAAEEKAGVIAHLGAHMADGAALVVRTAHGARGFLYPIVDPEDVRRGGFDVLAVCHPEDEVINSVIVARKVGAAAAAAAARRDELADSRGVVLPVVGPPSTCCKVEASAVEKAEEFAANKELSV

SEQ ID NO: 3161 - protein, 1274 aa, Oryza sativa
MVFKGRFFSSRHKSSESSSPTDGSNSPRTPTSAPPAAGSPAAASSSSSSRSDKKKPKSETPRKRDKLFGGSASGSAASKGGAGAAPASASSSPSADGRKAAAAQLRDGGAGGASAAALSPILASSLGLNRIKTRSGPLPQEGHRIAAALGSSNLSRGQAQADPSAASAGGGGGGGRKAGSSWADSTSGSRGKGKAAEHPARGATATSLEGKSSAKDVLSYKEIGAHDFHFAAWCLDAKLGTTGANCAYDPCETPKESESPRFKAIMQATSAPRKRVPADIKSFSHELNSKGVRPFPFWKPRGIYNLKEVLKVIQVRFEKAKEEVNSDLAVFAGDLVGVMEKYADSHPEWKETLEDLLILARSCCVMTPGEFWLQCEGIVQDLDDHRQELPMGVLKKLYTRMLFILTRCTRLLQFHKESGFAEDEVVMDQRDKIIQSADRQILAQPGDDTTTRGSKSDVRKSYSQEQHNLKWKRSQEIKPVKFLSPLDTTDVKKEVESPTRERISSWKPFPSPVPKPPKDPTPIKEESPNKKTDTPPAVSSQAELNSPVESTSHQSLPPKHQHKTSWGHWSDQPNISEEGSIMCRICEEYVPTHYVENHSAICASADRCDQKGVSVDERLIRVAEALEKLVESYTQKDLPNAVGSPDVAKVSNSSINEESDGPSPKLSDWSRRGSADMLDYLQEADSTISLDDIKNLPSMTCKTRFGPKSDHGMATSSAGSMTPRSPLTTPRSNHIDMLLAGRSAINESDDLPQIVELADIARCIATTPLDEERALSLLVTCIEDLQEIVNRRKHEALTVQTFGTRIEKLHREKYLLLCDSVDMDKVDSASTVMDEEDDVVRSLRASPVHPVKDRTSIDDFEIIKPISRGAFGRVFLAKKRTTGDLFAIKVLRKADMIRKNAVESILAERDILITVRNPFVVRFFYSFTSRENLYLVMEYLNGGDLYSLLRNLGCLDEDVARIYLAEVVLALEYLHSMHIVHRDLKPDNLLIAHDGHIKLTDFGLSKVGLINSTDDLSGPAVSGSSLYGDDEPQMSEFEEMDHRARRQKRSAVGTPDYLAPEILLGTGHGTSADWWSVGVILFELIVGIPPFNAEHPQTIFDNILNRKIPWPHVPEEMSSEAQDLIDKLLTEDPHQRLGANGASEVKQHQFFKDISWDTLARQKAAFVPSSDSAFDTSYFTSRYSWNPSDENIYEAYEFEDSSDNGSLSGSSSCVSNHQDDMGDESSGFTEFESSSNVNYSFSNFSFKNLSQLVSINYDLLTKGLKDDPPTKSET

SEQ ID NO: 3162 - protein, 1242 aa, Oryza sativa
  unsure (1)..(1242): unsure at all Xaa locations
MVFKGRFFSSRHKSSESSSPTDGSNSPRTPTSAPPAAGSPAAASSSSSSRSDKKKPKSETPRKRDKLFGGSASGSAASKGGAGAAPASASSSPSADGRKAAAAQLRDGGAGGASAAALSPILASSLGLNRIKTRSGPLPQEGHRIAAALGSSNLSRGQAQADPSAASAGGGGGGGRKAGSSWADSTSGSRGKGKAAEHPARGATATSLEGKSSAKGFCSFWKIGGLAYHCQALALXNAKLGTTGANCAYDPCETPKESESPRFKAIMQATSAPRKRVPADIKSFSHELNSKGVRPFPFWKPRGIYNLKEVLKVIQVRFEKAKEEVNSDLAVFAGDLVGVMEKYADSHPEWKETLEDLLILARSCCVMTPGEFWLQCEGIVQDLDDHRQELPMGVLKKLYTRMLFILTRCTRLLQFHKESGFAEDEVVMDQRDKIIQSADRQILAQPGDDTTTRGSKSDVPKSYSQEQHNLKWKRSQEIKPVKFLSPLDTTDVKKEVESPTRERISSWKPFPSPVPKPPKDPTPIKEESPNKKTDTPPAVSSQAELNSPVESTSHQSLPPKHQHKTSWGHWSDQPNISEEGSIMCRICEEYVPTHYVENHSAICASADRCDQKGVSVDERLIRVAEALEKLVESYTQKDLPNAVGSPDVAKVSNSSINEESDGPSPKLSDWSRRGSADMLDYLQEADSTISLDDIKNLPSMTCKTRFGPKSDHGMATSSAGSMTPRSPLTTPRSNHIDMLLAGRSAINESDDLPQIVELADIARCIATTPLDEERALSLLVTCIEDLQEIVNRRKHEALTVQTFGTRIEKLHREKYLLLCDSVDMDKVDSASTVMDEEDDVVRSLRASPVHPVKDRTSIDDFEIIKPISRGAFGRVFLAKKRTTGDLFAIKVLRKADMIRKNAVESILAERDILITVRNPFVVRFFYSFTSRENLYLVMEYLNGGDLYSLLRNLGCLDEDVARIYLAEVVLALEYLHSMHIVHRDLKPDNLLIAHDGHIKLTDFGLSKVGLINSTDDLSGPAVSGSSLYGDDEPQMSEFEEMDHRARRQKRSAVGTPDYLAPEILLGTGHGTSADWWSVGVILFELIVGIPPFNAEHPQTIFDNILNRKIPWPHVPEEMSSEAQDLIDKLLTEDPHQRLDSAFDTSYFTSRYSWNPSDENIYEAYEFEDSSDNGSLSGSSSCVSNHQDDMGDESSGFTEFESSSNVNYSFSNFSFKNLSQLVSINYDLLTKGLKDDPPTKSET

SEQ ID NO: 3163 - protein, 1409 aa, Oryza sativa
  unsure (1)..(1409): unsure at all Xaa locations
MRRESTRRAPRPTGRVLLLLGSSPLSSLYICGLVPTTTLSLSLSLSPCGLAVSLARPPPPPVRPNASPAGGEEMVFKGRFFSSRHKSSESSSPTDGSNSPRTPTSAPPAAGSPAAASSSSSSRSDKKKPKSETPRKRDKLFGGSASGSAASKGGAGAAPASASSSPSADGRKAAAAQLRDGGAGGASAAALSPILASSLGLNRIKTRSGPLPQEGHRIAAALGSSNLSRGQAQADPSAASAGGGGGGGRKAGSSWADSTSGSRGKGKAAEHPARGATATSLEGKSSAKGFCSFWKIGGLAYHCQALALXNAKLGTTGANCAYDPCETPKESESPRFKAIMQATSAPRKRVPADIKSFSHELNSKGVRPFPFWKPRGIYNLKEVLKVIQVRFEKAKEEVNSDLAVFAGDLVGVMEKYADSHPEWKETLEDLLILARSCCVMTPGEFWLQCEGIVQDLDDHRQELPMGVLKKLYTRMLFILTRCTRLLQFHKESGFAEDEVVMDQRDKIIQSADRQILAQPGDDTTTRGSKSDVRKSYSQEQHNLKWKRSQEIKPVKFLSPLDTTDVKKEVESPTRERISSWKPFPSPVPKPPKDPTPIKEESPNKKTDTPPAVSSQAELNSPVESTSHQSLPPKHQHKTSWGHWSDQPNISEEGSIMCRICEEYVPTHYVENHSAICASADRCDQKGVSVDERLIRVAEALEKLVESYTQKDLPNAVGSPDVAKVSNSSINEESDGPSPKLSDWSRRGSADMLDYLQEADSTISLDDIKNLPSMTCKTRFGPKSDHGMATSSAGSMTPRSPLTTPRSNHIDMLLAGRSAINESDDLPQIVELADIARCIATTPLDEERALSLLVTCIEDLQEIVNRRKHEALTVQTFGTRIEKLHREKYLLLCDSVDMDKVDSASTVMDEEDDVVRSLRASPVHPVKDRTSIDDFEIIKPISRGAFGRVFLAKKRTTGDLFAIKVLRKADMIRKNAVESILAERDILITVRNPFVVRFFYSFTSRENLYLVMEYLNGGDLYSLLRNLGCLDEDVARIYLAEVVLALEYLHSMHIVHRDLKPDNLLIAHDGHIKLTDFGLSKVGLINSTDDLSGPAVSGSSLYGDDEPQMSEFEEMDHRARRQKRSAVGTPDYLAPEILLGTGHGTSADWWSVGVILFELIVGIPPFNAEHPQTIFDNILNRKIPWPHVPEEMSSEAQDLIDKLLTEDPHQRLGANGASEVKQHQFFKDISWDTLARQKAAFVPSSDSAFDTSYFTSRYSWNPSDENIYEAYEFEDSSDNGSLSGSSSCVSNHQDDMGDESSGFTEFESSSNVNYSFSNFSFKNLSQLVSINYDLLTKGLKDDPPTKSETQMSYCDAVSWFNPVVTTNVADESVRHGLVPIEVVPTFRGAEYSFDVACFRTIPVSSSMKHP

SEQ ID NO: 3164 - protein, 1640 aa, Oryza sativa
  unsure (1)..(1640): unsure at all Xaa locations
MVYCHIAINSKSKIRAKDQIGSSNAKYFTMLQTPRSIKVSKYFGLFHLFFGSFSMVFMSNLSEPSKEAASADDSSAVQKTGAWSNTLNILLQQASVYGVAAGYCLSASLLSIINKWAVMKFPYPGALTALQYFTSVVGVLLCGQLKLIEHDGLNLRTMWKFLPAAVMFYISIFTNSELLLHANVDTFIVFRSAVPIFVAIGETLYLHQPWPSLKTWLSLSTILGGSVIYVFTDNQFTVTAYTWAVAYLASMSIDFVYIKHVVMTIGLNTWGLVLYNNLEALMLFPLEMLLMGELNQMKGDSAKVTNWLSSDVILPVALSCLFGLSISFFGFSCRRAISATGFTVLGIVNKLLTVVINLLIWDKHASFVGTIGLLICMSGGVLYQQSTXXKPKAPKAEPKEENDEEQQKLLEMQQGLERIQIQVNSDLASRSLPLMGRNTHRVGRAYSLGLQLALLSLRHGVLLHIILYKIHVDYGFAPAREKSGPCIPFSNGPDLSSHADSTSPRRRRSIPAASRGVTGGEPPNKPLASPLGVFCSSRKESAVEGRLRTRGEEILPEGFDSELGMYGQGGNFNPQYRHAAPPPPPQQAGVTGGFPQQPLPPPPPRMAQYPQPPAMAAPPPGPYQHRMPLVQNQAYPFAQMHQMPMLPQQRGYAQMPMPGPPSQPPPPQAMYQAHPQYPMPGSLPPPPPRPPSFAPENALPPSSPPPPSPPPPPPSSPPPVPPSPTAAPTTGQSWNSEPERKEGATATDVGHDVKTEKVTNQLIVSDDSDMDMDADEDSPSREHVSPINSSLATAECTGNVNTRKPACDVSNLVKDSGGKAKTTNVTDEGRSTFQLIQGYASDDSEDEDGACAVSNLVPLTENNEPVHSIGTNPDIGHQLLTEAAPCTERSLEDREHQLMSKSNPVKHDSDELGHPVKEDLSGNDSDRGQQTRRHGRSQWKRSRGQSPQGRRSCSPLSQSLSSGRQSNSPLAKRANLLESKSPDGVGQTFRAQPGVKLGISKDGFYNDKHDSPVKVATPFDIHPAGGHISGDRISEQDGLMGTKKFNGSPDDIDCNEKTNDASVGSFGPHGHGAVLTCGPSQSVASSANGSDPHKMQRFTPNLPGSTEFGAISDTDLPKSSIKPHYNPFASTFEQTDPTLNIGCDVIPNPVESASTKAAEHANALSPFGLSVPGSGTHVRENSAEVVSSRQKQPHREFTSSAPYDPLLDSIEPSSSSINKMDLGREANLSASNHNASKIVNIEVESKNMHGLGLVAESEVEEFGEVAADTEAGVVDNLSPEPLGAKDWSSDMPGDIDNDESVDKNKRTKDSRSMKLFKVAIADFVKEVLKPSWRQGNISREAFKTIVKKTVDKVSSSVPNNHIPKTPAKIKQYVQSSQKKVTKLVMVHNPLHFPYPLGEFTGDTAASRLFPPRRRTLLLPAFPHSPYLGNELRHRRPLPLEQRGSSASTGARADPTWSSMVLPESRPARGGVAGHGARPPPELEHIRPRARRRRLDLARESSRMQGSIIVFAHHVGIRNIRWSRGDQPRSLSCSLSCWLYVCVGGVGDRQEDDRQCFVTINTLTMAIVLYLLVGDLIGVGVVNNGRVVSNTFVGMLLPPLKSTAAAEPLLPQTGHVAAAACLDEGAIHIIVVETKENSIQE

SEQ ID NO: 3165 - protein, 309 aa, Oryza sativa
  unsure (1)..(309): unsure at all Xaa locations
IGCAQDGAVRGGRGVCALEMSNLSEPSKEATLNILLQQTSVYGVAAGYCLSASLLSIINKWAVMKFPYPGALTALQYFTSVVGVLLCGQLKLIEHDGLNLKXTMWKSLPAAVMFYISIFTNSELLLHANVDTFIVFRSAVPIFVAIGETFYLHQPWPSLKTWLSLSTILGGSVIYVFTDNQFTVTAYTWAVAYLASMSIDFVYIKHVVMTIGLNTWGLVLYNNLEAFMLFPLEMLLTGELNQMKGDNAKVTNWLSSDVILPVALSCLFGLSISFFGFSCRRAISATGFTVLGIVNKLLTVVINLLIWDX

SEQ ID NO: 3166 - protein, 451 aa, Oryza sativa
  unsure (1)..(451): unsure at all Xaa locations
MANSRASRFKMSNLSEPSKEAASADDSSAVQKTGAWSNTLNILLQQASVYGVAAGYCLSASLLSIINKWAVMKFPYPGALTALQYFTSVVGVLLCGQLKLIEHDGLNLRTMWKFLPAAVMFYISIFTNSELLLHANVDTFIVFRSAVPIFVAIGXETLYLHQPWPSLKTWLSLSTILGGSVIYVFTDNQVTVTAYTWAVAYLASMSIDFVYIKHVVMTIGLNTWGLVLYNNLEALMLFPLEMLLMGELNQMKGDSAKVTNWLSSDVILPVALSCLFGLSISFFGFSCRRAISATGFTVLGIVNKLLTVVINLLIWDKHASFVGTIGLLICMSGGVLYQQSTXXKPKAPKAEPKEENDEEQQKLLEMQQGLESSSIRSKRHLKPGRKFGYQLSKNPETYSNRILRIQYAVSLIIQGGYPFPCSIFVFAFRFVMKENYLLYSNCLYIMYSVLC

SEQ ID NO: 3167 - protein, 168 aa, Oryza sativa
  unsure (1)..(168): unsure at all Xaa locations
XDGKPEPQFSSGGYMXLYTRRNNMCTQKTEHDYLESIYEKYCESFEEYITYRVLPSLREKHDEFMLXELAKRWSNXHIVMASWLSRYPHNVDRYFILRRFLTQLSELGLTXLREPVYKRIXGQVQSAVTFLNDPEREGEQKDRDLIKKVLEISVENGVNIMAFSKNDX

SEQ ID NO: 3168 - protein, 117 aa, Oryza sativa
  unsure (1)..(117): unsure at all Xaa locations
MGMAQSSSSSSRPSDSEQLEEPSKPVMALDKAKEIVASSPVVVFSKTYCPFCARVKRLLAELAASYKAVELDVESDGSELQSALADWTGQRTVPCVFIKGKHIGGCDGEFLVLNLSX

SEQ ID NO: 3169 - protein, 112 aa, Oryza sativa
  unsure (1)..(112): unsure at all Xaa locations
MALDKAKEIVASSPVVVFSKTYCPFCARVKRLLAELAASYKAVELDVESDGSELQSALADWTGQRTVPCVFIKGKHIGGCDDTMAMHKGGNLVPLLTEAGAIATPSLXINTF

SEQ ID NO: 3170 - protein, 458 aa, Oryza sativa
MALASSSRLLHRFSSSSLPRPCRRRVPRPRGHSRFAVRWEHRAAAVVLLLPRALLGGGFQDADAAESDDEEEEDAHGVLRPLDADDVNLDLHAPPSGPERWDVLGLGQAMVDFSGMVDDEFLHRLGIQKGTRKVVNHEERGRVLRAMDGCSYKAAAGGSLSNSLVALSRLGSSRSTNYPELRIAMAGSVGSDPLGSFYRAKLRRANLHFLSKPVKDGTTGTVIVLTTPDAQRTMLAYQGTSSTLSYDSDLASLVSKSNVVIVEGYLFELPHTIEAIKQACEDAHKNGSLIAVTASDVSCIKRCYNDFWDIVTNYADILFANANEARAFCELSSTDSPMSAARYLSHSVPLVSVTDGVHGSYIGVKGEAIYIPPPPCVPIDTCGAGDAYASGILYGILRGSSDLKSIGLLASRVAAIVVAQQGTRLRVQDADRLAESFTLHLDNLEFCSDIETDHVSNF

SEQ ID NO: 3171 - protein, 675 aa, Oryza sativa
  unsure (1)..(675): unsure at all Xaa locations
PRIPVVDLEDGWRDVLAGVAKLKCILDGSNVVHFVPDEYMHLYTTVYNMCTQKPPNDYSQVLYDRYKQALDDHIESVVLPSLNEKHGVFLLREIVQRWEKHKLMVRWLRRFFDYLDRYYVTRRSLDSLKDLGWSSFRDLIDDEREGNLIDRPLLKNALDIYAEECLQKEKDRVANYLHSTTEPKLFAAALFELIDRRAEEILNKENSGCKVLLCDEKTEDLARMFRLFSRITDGLLPVSKIFKEHVIAEGMSLLKHATDAANSRKXXNGLPPKDFVRSVIELHDKYMAYVTNCFQSNSVFHKALKEAFEVICNKDVVGCSSAELFAAYCDSILKRGGSEKLSDEAIDESLEKVVKLLTYLSDKDLFVEFHRKKLGRRLLFDKNTNDEHERILLSKLKQFFGGQFTSKMEGMLKDITLAKEHQSSFEEYVSNNPESNPLIDLNVTVLTTGYWPTYKNSDINLPLEMVKCVEVFKEYYRSDKQHRKLTWIFSLGNCVVIGNFDAKPVEFVLNTYQAALLLLFNEADKLSYSDIVSQLKLSDDDAVRLLHSLSCAKYKILNKEPSNRVISPEDEFEFNSKFTDRMRRIKVPLPQIDEKKKVVDDVNKDRRFAIDASLVRIMKSRKVLGHQQLVAECVEQLSRMFKPDIKIIKRRIEDLISREYLERDSENAQTYKYLA

SEQ ID NO: 3172 - protein, 594 aa, Oryza sativa
MSPRIPVVDLEDGWRDVLAGVAKLKCILDGSNVVHFVPDEYMHLYTTVYNMCTQKPPNDYSQVLYDRYKQALDDHIESVVLPSLNEKHGVFLLREIVQRWEKHKLMIDDEREGNLIDRPLLKNALDIYVEIGDSQLNYYSDDFEQSFLNGTTDYYSKKAQTWILENSCPEYMLKAALFELIDRRAEEILNKENSGCKVLLCDEKTEDLARMFRLFSRITDGLLPVSKIFKEHVIAEGMSLLKHATDAANSRKDEKKGVVVGLPEQDFVRSVIELHDKYMAYVTNCFQSNSVFHKALKEAFEVICNKDVVGCSSAELFAAYCDSILKRGGSEKLSDEAIDESLEKVVKLLTYLSDKDLFVEFHRKKLGRRLLFDKNTNDEHERILLSKLKQFFGGQFTSKMEGMLKDITLAKEHQSSFEEYVSNNPESNPLIDLNVTVLTTGYWPTYKNSDINLPLEMVKCVEVFKEYYRSDKQHRKLTWIFSLGNCVVIGNFDAKPVEFVLNTYQVPLPQIDEKKKVVDDVNKDRRFAIDASLVRIMKSRKVLGHQQLVAECVEQLSRMFKPDIKIIKRRIEDLISREYLERDSENAQTYKYLA

SEQ ID NO: 3173 - protein, 746 aa, Oryza sativa
MNMSPRIPVVDLEDGWRDVLAGVAKLKCILDGSNVVHFVPDEYMHLYTTVYNMCTQKPPNDYSQVLYDRYKQALDDHIESVVLPSLNEKHGVFLLREIVQRWEKHKLMVRWLRRFFDYLDRYYVTRRSLDSLKDLGWSSFRDLVFDKLKSTVATIMIGMIDDEREGNLIDRPLLKNALDIYVEIGDSQLNYYSDDFEQSFLNGTTDYYSKKAQTWILENSCPEYMLKAEECLQKEKDRVANYLHSTTEPKLFAAALFELIDRRAEEILNKENSGCKVLLCDEKTEDLARMFRLFSRITDGLLPVSKIFKEHVIAEGMSLLKHATDAANSRKDEKKGVVVGLPEQDFVRSVIELHDKYMAYVTNCFQSNSVFHKALKEAFEVICNKDVVGCSSAELFAAYCDSILKRGGSEKLSDEAIDESLEKVVKLLTYLSDKDLFVEFHRKKLGRRLLFDKNTNDEHERILLSKLKQFFGGQFTSKMEGMLKDITLAKEHQSSFEEYVSNNPESNPLIDLNVTVLTTGYWPTYKNSDINLPLEMVKCVEVFKEYYRSDKQHRKLTWIFSLGNCVVIGNFDAKPVEFVLNTYQAALLLLFNEADKLSYSDIVSQLKLSDDDAVRLLHSLSCAKYKILNKEPSNRVISPEDEFEFNSKFTDRMRRIKVPLPQIDEKKKVVDDVNKDRRFAIDASLVRIMKSRKVLGHQQLVAECVEQLSRMFKPDIKIIKRRIEDLISREYLERDSENAQTYKYLA

SEQ ID NO: 3174 - protein, 421 aa, Oryza sativa
  unsure (1)..(421): unsure at all Xaa locations
MNNVEEKAASDSKDENEKTANDESGQDKVLKKPDKILPCPRCNSMDTKFCYYNNYNVNQPRHFCKNCQRYWTAGGTMRNVPVGAGRRKSKSSSLHYRHLLMAPDCMMGSRVEISKSMNPEAFASAHSTPIQPIGRNETVLKFGPEVPLCESMASVLNIQEQNGTNAAAVPTGENQEDNSCISSITSHNVLPENAAQVDKNSTPVYCNGVGPVPXQYYLGAPYMYPWNIGWNNVPMMVPGTSMPESASQSESCSTSSAPWMNMNSPMMPVASRLSAPPFPYPLVPPALWGCLSSWPATAWNIPWIRTNGGCMSPSSSSNSSCSGNGSPLGKHSRDSSLPLKEDKEEKSLWVPKTLRIDDPDEAAKSSIWATLGIKPGDPGIFKPFQSKGESKGQAASETRPARALKANPAALSRSQSFQETS

SEQ ID NO: 3175 - protein, 816 aa, Oryza sativa
MGEAAGDRVLSRLHSVRERIGDSLSAHPNELVAVFTRLVNLGKGMLQAHQIIAEYNNAISEADREKLKDGAFEDVLRSAQEGIVISPWVALAIRPRPGVWEYVRVNVSELAVELLTVPEYLQFKEQLVEEGTNNNFVLELDFEPFNASFPRPSLSKSIGNGVQFLNRHLSSKLFHDKESMYPLLNFLRAHNYKGMTMMLNDRIRSLSALQGALRKAEEHLSGLSADTPYSEFHHRFQELGLEKGWGDCAKRSQETIHLLLDLLEAPDPSTLEKFLGTIPMVFNVVIMSPHGYFAQANVLGYPDTGGQVVYILDQVRAMENEMLLRIKQQGLNITPRILIVTRLLPDATGTTCGQRLEKVLGTEHTHILRVPFRTENGIVRKWISRFEVWPYLETFTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADMSIYFPYSESRKRLTSLHPEIEELLYSEVDNNEHKFMLKDRNKPIIFSMARLDRVKNLTGLVELYGRNPRLQELVNLVVVCGDHGNPSKDKEEQAEFKKMFDLIEQYNLNGHIRWISAQMNRVRNGELYRYICDTKGAFVQPAFYEAFGLTVVESMTCGLPTFATAYGGPAEIIVNGVSGFHIDPYQGDKASALLVEFFEKCQEDPSHWTKISQGGLQRIEEKYTWKLYSERLMTLTGVYGFWKYVSNLERRETRRYLEMLYALKYRTMASTVPLAVEGEPSNK

SEQ ID NO: 3176 - protein, 376 aa, Oryza sativa
MVGPIQQDEGSHTCKRLEFWIEIPGVTDTATAWLVLSQNQSQGQQESSETDGRSIRHVATGRRRRLTWTTDTCQWRCTPVSCRCRRQQKQTQKEMERPSGGATSGGAWAHRPPPHRGDAFARAAPRPPNPTVAASVSVVRTACVCLCYCCCLRAAAATHTTDMEYYEQEEYATVTSAPPKRPAGRTKFRETRHPVYRGVRRRGPAGRWVCEVREPNKKSRIWLGTFATAEAAARAHDVAALALRGRGACLNFADSARLLRVDPATLATPDDIRRAAIELAESCPHDAAAAAASSSAAAVEAAAAAAPAMMMQYQDDMAATPSSYDYAYYGNMDFDQPSYYYDGMGGGGEYQSWQMDGDDDGGAGGYGGGDVTLWSY

SEQ ID NO: 3177 - protein, 585 aa, Oryza sativa
  unsure (1)..(585): unsure at all Xaa locations
LPRPARSLPKLPSSNGDISSLAPSSFMDRTSQWVSSPDIPADLLIRIADDVFPLHKAVMVPKCGYIRKAVAAARGGATATVDLDLSALPGAADAFDKVARYCYGANFEISVRNAAALLCAAAFLDMHPTDGGLARRVEEFLAKVGLRTLPGAVAVLRSCEGLLPAAEEIGVVQRSADAIALRICNEVLFPTRSPPEWWTAELAALSPASFHKVITALRCRRAEPEVLVAAATAYAELLLAEVLAXXDGHAADHSGMHRALVESVVAVAPSDDAPLPAAFLCHLLHVAITIGASAKTCRDLELRVAAVLDQATAGDLLTVALDSAGERVQNVDTVRRIITAFVERDSAASSGGANGRSRRACGGPRQTVAKTVDEVAAEIATEESLPISKFVGLAGAVPKEARATHDCLYRAVDIYLKAHPALEEMEREKVCSVMDPLKLSYQGRLHASQNNRLPLQAVLSALYYDRLKLRSGERGRRRVGRVWEWRDEGRRRRGRRGSRRRRKASLARENEALRSELARMRAYVSAMQQQSKGSSSSRGKKGSWLRTLSRLNPFKAGSKDTSGIVDGKTDAMNSVKSKRRRFSIS

SEQ ID NO: 3178 - protein, 225 aa, Oryza sativa
  unsure (1)..(225): unsure at all Xaa locations
RHEALVSRAATAAEEEKSKRRRRRCSPAXSTTTASSXADVGGGGGGSSAGLVLTADPKPRLRWTADLHDRFVDAVAQLGGPDKATPKTIMRTMGVKGLTLFHLKSHLQKYRLGKQSGKEMAEQSKDASYILGAQSGTNLSPTVPTPDLKESQELKEALRAQMEVQRKLHEQVEVQRHVQIRMEAYQNYIDTLLEKACNIVSEQLNGFSNMDVSKNYLKKNILLAX

SEQ ID NO: 3179 - protein, 356 aa, Oryza sativa
  unsure (1)..(356): unsure at all Xaa locations
MGDVATIRAVLAILQWWGFNVTVIIMNKWIFQKLEFKFPLTVSCVHFICSSIGAYIAIKILKMKPLIEVAPEDRWRRIFPMSFVFCINIVLGNVSLRYIPVSFMQTIKSFTPATTVILQWLVWRKYFEWRIWASLVPIVGGIMLTSITELSFNMFGFCAAIVGCLATSTKTILAESLLHGYKFDSINTVYYMAPFATMILSVPSDLCWXKGVAVINWLYTYDSIVPALIIITTSGVLAFCLNFSIFYVIHSTTAVTFNVAGNLKVAVAVLVSWMIFRNPISAMNAVGCAITLVGCTFYGYVRHLISQQSVNSSPRTPRSRMEMLPLVGDKQEKIXLATKLKQVDTQKRRELLVHDQ

SEQ ID NO: 3180 - protein, 125 aa, Oryza sativa
  unsure (1)..(125): unsure at all Xaa locations
MAFYMNLRRSKKNNGAMELFGDCSLDTVFDPVALSCGHIYCYLCSCSAASVTIVDGLKSAERKSKCPLCRQAGVFPNAVHLDELNMLLSYSCPEYWEKRIQMERVERVRLAKEHWESQCRAFLGX

SEQ ID NO: 3181 - protein, 127 aa, Oryza sativa
  unsure (1)..(127): unsure at all Xaa locations
MKFAKKYEKYMKGMDEELPGVGLKRLKKLLKKCXXLTSNPTRXDGSSAGRCPGHCSAVIGCFNEKAKKLLELHLASGFKKYTMWFTSKGHKSHGALIQQGKDLVTYAIINAVAMRKILKKYDKAWPX

SEQ ID NO: 3182 - protein, 197 aa, Oryza sativa
MKFAKKYEKIHYSKQGQEFKAQAQSLHIEILQSPWLCELMAFYMNLRRSKKNNGAMELFGDCSLVFDDDKPTISCNLFDSMRVDISLTCSICLDTVFDPVALSCGHIYCYLCSCSAASVTIVDGLKSAERKSKCPLCRQAGVFPNAVHLDELNMLLSYSSFSELYNYRFLETGPKARMFEEILIPREAAAVRSSPKQ

SEQ ID NO: 3183 - protein, 320 aa, Oryza sativa
  unsure (1)..(320): unsure at all Xaa locations
MKFAKKYEKYMKGMEXEELPGVGLKRLKKLLMKCRSDLQSHENDGSSAGRCPGHCSVCDGSFFPSLLNEMSAVVGCFNEKAKKLLELHLASGFKKYTMWFTSKGHKSHGALIQQGKDLVTYAIINAVAMRKILKKYDKIHYSKQGQEFKAQAQSLHIEILQSPWLCELMAFYMNLRRSKKNNGAMELFGDCSLVFDDDKPTISCNLFDSMRVDISLTCSICLDTVFDPVALSCGHIYCYLCSCSAASVTIVDGLKSAERKSKCPLCRQAGVFPNAVHLDELNMLLSYREYWEKRIQMERVERVRLAKEHWESQCRAFLGM

SEQ ID NO: 3184 - protein, 230 aa, Oryza sativa
  unsure (1)..(230): unsure at all Xaa locations
MAMSSRAGGTPQKPDHPPTRCRSQAKDSDVTHAASHGPARARVCDPHLNWPHGKMVMGLSVVAWLDGGXXEWRVVDDACPHRLAPLSEGRVDGKGRLQCAYHGWCFDGHGSCQFIPQAPALGPPVHKNSKACVASYPSVVQNNILWFYPRSEPEYCDVLKRKRPPYVPEIDDDDPSHFMVYGVRDLLYGYELLVENLMDPAHVPYAHKGLXWXAPKERRSSQICSSSVVX

SEQ ID NO: 3185 - protein, 603 aa, Oryza sativa
  unsure (1)..(603): unsure at all Xaa locations
MGWGIPAPTPPDTGRDVGARPPVLSAYDRSQTGQGRLTCVNQAAPHVRPHRIKCSEGRLGCRSFMTLNSASCSAHSPRHVVAGFLVGVVTSSPSLSSFALPSLWERRRFVVDRATRSXSLAPRRRLRQPRCTSTGWLSSMPAPSAETETVAAPHLERSEELGSDSRPPYLSGERTWTRCCGGKGTPHGKMVMGLSVVAWLDGGXXEWRVVDDACPHRLAPLSEGRVDGKGRLQCAYHGWCFDGHGSCQFIPQAPALGPPVHKNSKACVASYPSVVQNNILWFYPRSEPEYCDVLKRKRPPYVPEIDDDDPSHFMVYGVRDLLYGYELLVENLMDPAHVPYAHKGLFVEFDLEHGSPMKMRIEEASIDGFHSNRDWGYFKFVAPCTLYGTPFRTDLEADEVKKKKKKKPEVRVVLFTVPVAPGRSRFIWASRYKVGGWLDKILPRWFYHMTSNTILDSDTYLHVEDRNITTVGLDNWHKACYVPTSSDNLVIAYRNWFRKYCNHQIGWANPNPTVKQQLPQTPTRDQLLERYWSHVMQCTSCRAALKGMRALEITLQVAAVAVVGFLAAGKETAVMSESFAASRWLANFIEKTFYFQDYVHADK

SEQ ID NO: 3186 - protein, 125 aa, Oryza sativa
  unsure (1)..(125): unsure at all Xaa locations
VRLRIRSDSWSTTRPGESGVAEEGGAAAAAAVRRWVEAXGGRLVMDGGLATELEANGADLNDPLWSAKCLLSSPHLVRKVHFFFLEAGAHIIFTASYHATIHRFESKGFFLEPTRHLLSLSIAIX

SEQ ID NO: 3187 - protein, 262 aa, Oryza sativa
MSQPAELSREENVYMAKLAEQAERYEEMVEFMEKVAKTVDSEELTVEERNLLSVAYKNVIGARRASWRIISSIEQKEESRGNEDRCTLIKEYRGKIETELSKICDGILKLLDSHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDAAEEIKEAPKGESGDGQ

SEQ ID NO: 3188 - protein, 165 aa, Oryza sativa
  unsure (1)..(165): unsure at all Xaa locations
XYPINFEFDFGPVIEFLNMRLNNAGDPFMECNYGIHSKKFEIAVLDWFARLWELPKDQYWGYVTSGGTEGNMHGLLVGRELFPEGIIYTSCDSHYSIFKAAKMYRVQCIKIDTLFSGTTMKGAVDDLDEVVMILENCGFANRFYIHCDSALVGLMMPFIKQSSIX

SEQ ID NO: 3189 - protein, 217 aa, Oryza sativa
  unsure (1)..(217): unsure at all Xaa locations
XAAHRKKTMGXTLSLSLSHXPYEVFFSAGYPINFEFDFGPVIEFLNMRLNNAGDPFMECNYGIHSKKFEIAVLDWFARLWELPKDQYWGYVTSGGTEGNMHGLLVGRELFPEGIIYTSCDSHYSIFKAAKMYRVQCIKIDTLFSGEMDYADFRRKLLQNTRSPAIVNVNIGTTMKGAVDDLDEVVMILENCGFANRFYIHCDSALVGLMMPFIKQVX

SEQ ID NO: 3190 - protein, 254 aa, Oryza sativa
MVSPDTIRTAIGVVGNGTALVLFLSPVPTFIRIWKKGSVEQYSAVPYVATLLNCMMWVLYGLPAVHPHSMLVITINGTGMAIELTYIALFLAFSLGAVRRRVLLLLAAEVAFVAAVAALVLNLAHTHERRSMIVGILCVLFGTGMYAAPLSVMKMVIQTKSVEYMPLFLSLASLVNGICWTAYALIRFDLYITIPNGLGVMFAVAQLILYAIYYKSTPRKRKEADHVAMTDVVVDSAKNNPSSGAAAAAANGRY

SEQ ID NO: 3191 - protein, 893 aa, Oryza sativa; identical to SEQ ID NO: 1050

SEQ ID NO: 3192 - protein, 235 aa, Oryza sativa
  unsure (1)..(235): unsure at all Xaa locations
XARFDSESSLFSHCASEHRFDFYRVVKETGMDFYGCIKLINFVRSKGKVPWGDDVYLKPFLEDDSLLHSLSVFDDDDEXXDCGMPMEKGGCSAGNGSLAETCESNLKSIINDGSDVIDRFERTCTIESTDGECSGSLAQEPSDKQLKIARASAAARGIKSVDESYFGSYSSFGIHREMLGDKVRTEAYRDALLGNPSLMNGATVLDVGCGTGILSLFAAKAGASRVIAVDGSAKM

SEQ ID NO: 3193 - protein, 241 aa, Oryza sativa
  unsure (1)..(241): unsure at all Xaa locations
XARFDSESSLFSHCASEHRFDFYRVVKETGMDFYGCIKLINFVRSKVAENKCWSWQVFSSNSEQGKVPWGDDVYLKPFLEDDSLLHSLSVFDDDDEXXDCGMPMEKGGCSAGNGSLAETCESNLKSIINDGSDVIDRFERTCTIESTDGECSGSLAQEPSDKQLKIARASAAARGIKSVDESYFGSYSSFGIHREMLGDKVRTEAYRDALLGNPSLMNGATVLDVGCGTGILSLYATYRKX

SEQ ID NO: 3194 - protein, 289 aa, Oryza sativa
  unsure (1)..(289): unsure at all Xaa locations
XEEGEEGWDDWESDGDDAGGGGGGGGLLCLFCSARFDSESSLFSHCASEHRFDFYRVVKETGMDFYGCIKLINFVRSKVRQGFSFSXLEIELYTQGKVPWGDDVYLKPFLEDDSLLHSLSVFDDDDEXXDCGMPMEKGGCSAGNGSLAETCESNLKSIINDGSDVIDRFERTCTIESTDGECSGSLAQEPSDKQLKIARASAAARGIKSVDESYFGSYSSFGIHREMLGDKVRTEAYRDALLGNPSLMNGATVLDVGCGTGILSLFAAKAGASRVIAVDGSAKMVSVAX

SEQ ID NO: 3195 - protein, 248 aa, Oryza sativa
  unsure (1)..(248): unsure at all Xaa locations
XAALCPAYNADIHSGKPLARRHERLPVAPFFGPLADAPQPFPFSQAAADAAAAREEDADDDRSNEAEAASWLLPEPDDNSXXEDSAAAADAFFADXRRVPRRRPGLRPVHGRNQGXIGVPVAPPELDLTAGSLFYPEHSMAHSLSSSEVAIVPDALSAGSAAPPMVVXXGGEXXGKEREARLMRYREKRKNRRFDKTIRYASRKAYAETRPRIKGRFAKRTADADDDDEAPCSPAFSALAAYGVVPSF

SEQ ID NO: 3196 - protein, 501 aa, Oryza sativa
  unsure (1)..(501): unsure at all Xaa locations
MRASKSGFSHQSRKPSGHSLSPRCXLALLANLELSTKCFSALAILILLTNAQYFGLVGVTVPRATKLASSAPVVSVMKYCDIFRGEWVPDSDAPYYNHKTCYMIQEHQNCLKYGRPDLEFLKWRWRPSGCELPRFDPVQFLQFNRHKSLAFVGDSLARNHMQSLLCLLSQVAYPKDMSANPTTQNKVYHYRGYNFTVSMFWSPFLVKAREPDHDGPAHTGHWSLYLDEPDQSWVSEISRFDYVLVSAANWFSRPSLFYEKRRLVGCSFCSRQYGVPDLTLYYSQRRAWRVALKAINDLESLRGRVIVRMLSPMSHFENGTWDQGGNCKRTQPLRSNETVMEGRDLHFYTAQMEEYRAAEKVAEAKGRRMMLMDATAAMLMRPDGHPSRYGHLPNQKVQLYNDCIHWCLPGPIDIWNDMLFQMLLVXRDRSPIRHRXMRLLLHRQDCSCCCFKAVLTRIYSNFPNRFFFSLSFPFISFHFSFMLTRIFNGSSPERVNESVPP

SEQ ID NO: 3197 - protein, 447 aa, Oryza sativa
  unsure (1)..(447): unsure at all Xaa locations
MGCAASRLEDEEAVKMCRDRRDFIKQALEQRNRFASSHFAYIESLRRVSMALXXWFVAGDDHHELIFDPFISPLKRQDQTHRYQLKSNRDPWKQSVLSHITPQIIGGMDRXXFAAQSSPMRPSSYYTPPYDRPNYPPPSPQEPVRNSYYMSYDRPSYPAASPQEPTRTSYYASYDRPSYPPPSPQEQESSQWDFFWNPFSSLDSFAYXXRPRSSYDNVVTDDELARLQRVREEEGIPELEEEDDECQQHEQVHQKEEQVDDDDNDDSDDDDDDDDDDDDDGDDECDHSDERCMPSNGGACPVKTEVNGKQETKGFESKGVQCEPRNKVELEIKAHKKELMRNKVANAEXXTPGFTVYLNRRPASLAEAMKDIDSQFLGICDAAKEISVMLEASRAQYSTSNDLSGERLRIDYEKRLNHLRNQDVKGDEPSSVDKTRAALRSLHTRMK

SEQ ID NO: 3198 - protein, 481 aa, Oryza sativa
  unsure (1)..(481): unsure at all Xaa locations
MGCAASRLEDEEAVKMCRDRRDFIKQALEQRNRFASSHFAYIESLRRVSMALQWFVAGDDHHELIFDPFISPLKQQKPEXAWPPLWFIXEEDNSCLKVXLRSGPNPSVSVEEQPRPVETIRIESHYPTDNFGGMDRTSYYASYDRPSYPPPSPQEQESSQWDFFWNPFSSLDSFAYPRPRSSYDNVVTDDELARLQRVREEEGIPELEEEDDECQQHEQVHQKEEQVDDDDNDDSDDDDDDDDDDDDDGDDECDHSDERCMPSNGGACPVKTEVNGKQETKGFESKGVQXETPGFTVYLNRRPASLAEAMKDIDSQFLGICDAAKEISVMLEATKMLNPVALLRSASSRSSSSRFLLAPTSSIEDLYDNETNSCYSEESCSTMSGSHHSTLDRLYTWEKKLYKEVKAGERLRIDYEKRLNHLRNQDVKGDEPSSVDKTRAALRSLHTRMKVSIHTVQSISARIEVLRDEEMQPQLMELIRX

SEQ ID NO: 3199 - protein, 519 aa, Oryza sativa
  unsure (1)..(519): unsure at all Xaa locations
MGCAASRLEDEEAVKMCRDRRDFIKQALEQRNRFASSHFAYIESLRRVSMALQWFVAGDDHHELIFDPFISPLKQQKPEXAWPPLWFIXEEDNSCLKVXLRSGPNPSVSVEEQPRPVETIRIESHYPTDNFGGMDRTSYYASYDRPSYPPPSPQEQESSQWDFFWNPFSSLDSFAYPRPRSSYDNVVTDDELARLQRVREEEGIPELEEEDDECQQHEQVHQKEEQVDDDDNDDSDDDDDDDDDDDDDGDDECDHSDERCMPSNGGACPVKTEVNGKQETKGFESKGVQXETPGFTVYLNRRPASLAEAMKDIDSQFLGICDAAKEISVMLEASRAQYSTSNDLSAAKMLNPVALLRSASSRSSSSRFLLAPTSSIEDLYDNETNSCYSEESCSTMSGSHHSTLDRLYTWEKKLYKEVKAGERLRIDYEKRLNHLRNQDVKGDEPSSVDKTRAALRSLHTRMKVSIHTVQSISARIEVLRDEEMQPQLMELIRGLNRTNIIKQKHKQMQQKXADILNHT

SEQ ID NO: 3200 - protein, 129 aa, Oryza sativa
MGYLDEQFNQLEELQDESSPNFVEEVAALFFKDSSRLLTNIEQAIDKYPQDFYRLDSLVQQLKGSGSSIGALRMKNECSVFKVNCNDRNLEGSLQKMKREHATLKQKLESYFQLLRQVGPRDYAVSSRK

SEQ ID NO: 3201 - protein, 133 aa, Oryza sativa
LRRQIIFMKKNLFDQGYLDEQFNQLEELQDESSPNFVEEVAALFFKDSSRLLTNIEQAIDKYPQDFYRLDSLVQQLKGSGSSIGALRMKNECSVFKVNCNDRNLEGCRRSLQKMKREHATLKQKLESYFQVCC

SEQ ID NO: 3202 - protein, 356 aa, Oryza sativa
  unsure (1)..(356): unsure at all Xaa locations
VKSGDELXSAARSDDLPISPWLIAKVIALIASWYTLSTCLTLYNKEMLGKHMWKFPAPFLMNTVHFTMQAVASRVIVWFQHRGLEGAATMTWRDYFLRVVPTALATALDINLSNISLVFITVTFATMVHFTLYELXICSSNFHSSVCXFCLEKPSFNLLGIILIVSFGVLLTVAKETEFNLWGFVFIMLAAVMSGLRNPFTLMSYVTPVMAITTAILSIAMDPWHDVRASHFFDNSTHIIRSSLLMLLGGALAFFMVLTEYVLVSVTSAVTVTVAGIVKEAVTILVAVLFFNDTFTWLKGLGLGIIIFGVSLFNLYKYHRFKKGHRNKNCDKNPQTSSGASKYVILDXXDDMENQG

SEQ ID NO: 3203 - protein, 337 aa, Oryza sativa
  unsure (1)..(337): unsure at all Xaa locations
MQMSKVLGEQVGSGQLVWPVVIHGHYADAGDSAALLSGALNVPMIFTGHSLGRDKLEQLLKQGRQTRDEINTIYKIMRRIEAEELCLDASEIIITSTRQEIEQQWGLYDGFDLTMARKLRARIKRGVSCYGRYMPRMIAVPPGMEFSHIVPHDVDQDGEEANEDGSGSTDPPIWADIMRFFSNPRKPMILALARPDPKKNITTLVKAFGEHRELRNLANLTLIMGNRDVIDEMSSTNSAVLTSILKLIDKYDLYGQVAYPKHHKQSEVPDIYRLAARTKAAAYGLPMVATRNGGPVDIHRVLDNGILVDPHNQNEIAEALYKLVSDKQLWAQCRQNX

SEQ ID NO: 3204 - protein, 430 aa, Oryza sativa
  unsure (1)..(430): unsure at all Xaa locations
XWSYGEPTEMLSXKNSENFGHDIGESSGAYIVRIPFGPRDKYIPKEHLWPHIQEFVDGALVHIMQMSKVLGEQVGSGQLVWPVVIHGHYADAGDSAALLSGALNVPMIFTGHSLGRDKLEQLLKQGRQTRDEINTIYKIMRRIEAEELCLDASEIIITSTRQEIEQQWGLYDGFDLTMARKLRARIKRGVSCYGRYMPRMIVIPPGMEFSHIVPHDVDQDGEEANEDGSGSTDPPIWADIMRFFSNPRKPMILALARPDPKKNITTLVKAFGEHRELRNLANLTLIMGNRDVIDEMSSTNSAVLTSILKLIDKYDLYGQVAYPKHHKQSEVPDIYRLAARTKGVFINCAFIEPFGLTLIEAAAYGLPMVATRNGGPVDIHRVLDNGILVDPHNQNEIAEALYKLVSDKQLWAQCRQNGLKNIHQFSWPEX

SEQ ID NO: 3205 - protein, 190 aa, Oryza sativa
  unsure (1)..(190): unsure at all Xaa locations
PSFRRCKSDPEELAAVVALALCWEKXTSSGREYTVNDLSHADFDRLEIELAAVEMPELMAIRAEFGPSQALKGARISVSLHMTIQTAVLIETLTVLVSESLWCSWSIFSTHDHSAAVFFXDFRIIFRWMGETLDECXWITWRCLPCCAFRRRLLLXWDREHAYLFILYGVTPELTVVKDGSTAQTAATAT

SEQ ID NO: 3206 - protein, 442 aa, Oryza sativa
  unsure (1)..(442): unsure at all Xaa locations
FSFSFFWFQVSSPNFVFDFFYFFCSSRLVSTLYSSLFSRWCSSARSLVSKLLEASGGGIPGRARPPWRCXRCSSSWLSSVSRSSGGVGGGESKVSPENRAGERRGGGGRGGGGGXEERWSRLLPELLTEIMRRVDAGAERWPPRRDVVACACVCRAXWRDAAVSVVRPPLECGRITFPSSLKQPGPRDAPMHCFIRRNKKNSTFYLYLSLTQALTDKGKFLLAARRFRNGAHTEYIISYDCDDLFPGSNSYVGKLRSDFLGTKFIIYDSQPPYDGAKPSRSQSSRRFASKQINPNVSGGNYEVGQVSYKFNFLKSRGPRRMQCNIQCPVXARATASDPLKKLISTSSPLALRNKAPRWHEHLQCWCLNFHGRVTVXASVKNFQLVAPAGTSDPWGIADEETVILQFGKIEDDAFTMDYRQPLSAFQAFAICLTSFGTKLACE

SEQ ID NO: 3207 - protein, 354 aa, Oryza sativa
  unsure (1)..(354): unsure at all Xaa locations
MVMESAPEKLKLLLGVLALQCCLAGFHIVSRAALNMGISKIVFTVYRNCIALALLIPFAYFLEKKNRPPLTFSLLAQLFFLAFCGITCNQGFYLLGLHYLSPTYASAIQNTVPAITFALAASLRLEQVNINKRYGMAKVIGTVVSVGGATVITLYKGTPLMNFNILGANTVSQNVVLNWSVGCLFLLGNCIAWSGWMVLQTPVLKKYPARLSMLALTLAFGLVQFLAIAAFWENDIGKWRLHSGEELFTILYAGLVASGVALSLQIWCIDRGGALFTAIFQPVQTVMVAIMAAVILGDLLYTGGIIGAVLIVIGLYLVLWGKNEEKKSNSNQXXDLSRHLLSEESSRPTTVTSD

SEQ ID NO: 3208 - protein, 359 aa, Oryza sativa
  unsure (1)..(359): unsure at all Xaa locations
RXAWAAGARGGWCSWEWEDVAISAGLVAVQLAGAAYMVVLAPVLALGLDPLFLVTFGSLATGLFTLPFAINLERKRWPSHLNANHLLLRLFLLALGGVTVFQALMLHGMKKTSPAIASTMPNLAPVFIFVVAACLGFERVDLSCRYTRAKIAGTVLCLAGAVTMSVLQSPAAAAATRSSTGGGDWAVGCACLLGAVLVVSGTTVLQAATMVHFPAPFTLCSATSLAGAALTGAFQAATAAGGLSPGTPQISLQIILSLLLVAXCMQGGLVSSVCVMFQTWALEKKGPAAVSLFSPTQTVGSAIFSALFLGRVVPPASLLGMDFLFSGLYGVLWAKKKECQVDRMVVDRTVHDLEKPLFF

SEQ ID NO: 3209 - protein, 292 aa, Oryza sativa
  unsure (1)..(292): unsure at all Xaa locations
MAKSCTLVLLLVALVGLSLLVSPIACSRKLSKPKPKPKPSMXKPVVRAHNNYTGSPSVTVTTGWAAAGATYYGAPNGDGSDGGACGYQTAVGQRPFSSMIAAGSPSLYKGGKGCGACYEVKCTTNAACSGQPATVVITDECPGGICLAGAAHFDMSGTSMGAMAKPGMADKLRAAGILQVQYRRVPCKYSGVNIAFRVDQGANPFYFEVLIEFEDGDGDLNAVDLMEAGCGWTPMVQNWGALWRYNSNTGKALKAPFSLRLTSDSGKVLVANNVIPASWKPGVTYRSLVNYS

SEQ ID NO: 3210 - protein, 345 aa, Oryza sativa
MLAGSNCAFVQWYEAPREPAGMAAASSPAAAITCRAAVAWAPGQALVMEEVEVAPPEAMEIRVKVVSTSICRSDVTQWQSTDLFPRIFGHEASGVVESVGEGVTEFEVGDHVLTVFIGECMSCKHCVSGKSNMCQKLGLERRGVMHSDQKTRFSLRGKPVYHYCAVSSFSEYTVVHSGCAVKVGPTVPMDRICLLSCGVSAGLGAAWKVADISKGSSVVIFGLGTVGLSVAQGAKLRGASIIIGVDTNPEKQEKGKAFGVTDFINPEELNEPVQQVVKRLTNGGADYSFECGWGLTVTLGVPKAKPEVSAHYALLLSGRTLKGSLFGGWRPKSDLPLLVDKYANK

SEQ ID NO: 3211 - protein, 366 aa, Oryza sativa
  unsure (1)..(366): unsure at all Xaa locations
IFPVSHSYFSPDQLTCAAAVAWAPGQALVMEEVEVAPPEAMEIRVKVVSTSICRSDVTQWQSTDLFPRIFGHEASGVVESVGEGVTEFEVGDHVLTVFIGECMSCKHCVSGKSNMCQKLGLERRGVMHSDQKTRFSLRGKPVYHYCAVSSFSEYTVVHSGCAVKVGPTVPMDRICLLSCGVSAGLGAAWKVADISKGSSVVIFGLGTVGAKLRGASIIIGVDTNPEKQEKGKAFGVTDFINPEELNEPVQQVVKRLTNGGADYSFECVGDTGVVSTALQSCSDGWGLTVTLGVPKAKPEVSAHYALLLSGRTLKGSLFGGWRPKSDLPLLVDKYANKEIQVDDLVTHDLSFDYINKALELMLENKX

SEQ ID NO: 3212 - protein, 402 aa, Oryza sativa
  unsure (1)..(402): unsure at all Xaa locations
AGRESGGLTSPSAPTLAFVQWYEAPREPAGMAAASSPAAAITCRAAVAWAPGQALVMEEVEVAPPEAMEIRVKVVSTSICRSDVTQWQSTAQTDLFPRIFGHEASGVVESVGEGVTEFEVGDHVLTVFIGECMSCKHCVSGKSNMCQKLGLERRGVMHSDQKTRFSLRGKPVYHYCAVSSFSEYTVVHSGCAVKVGPTVPMDRICLLSCGVSAGLGAAWKVADISKGSSVVIFGLGTVGLSVAQGAKLRGASIIIGVDTNPEKQEKGKAFGVTDFINPEELNEPVQQVVKRLTNGGADYSFECVGDTGVVSTALQSCSDGWGLTVTLGVPKAKPEVSAHYALLLSGRTLKGSLFGGWRPKSDLPLLVDKYANKEIQVDDLVTHDLSFDYINKALELMLENKX

SEQ ID NO: 3213 - protein, 388 aa, Oryza sativa
MTDAPPPRSRPHPPSSSVAVPAAAAAVIAAALASSFLALLQPPRRAPVAAGSRVGMSKARVYADVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTEALNAYLNKYHIELDPQLEALVGRHSRKPWSKFINADNQHLVSPEAVDFLDKLLRYDHQDRLTAREAMAHPYFLQVRAAENSRARPQ

SEQ ID NO: 3214 - protein, 341 aa, Oryza sativa
AAICRREPRLPTPAATMAGQESLTLAGVLRGHNDMVTAIAAPIDNSPFIVSSSRDKSLLVWDITNPSTAYGVSYRRLTGHSHFVQDVVLSSDGQFALSGSWDGELRLWDLATGRTTRRFVGHTKDVLSVAFSVDNRQIVSAARDNTIKLWNTLGECKYTIGGDHGAGEGHTGWVSCVRFSPNPMAPTIVSGSWDRSVKVWNLTNCKLRTKLEGHNGYVNAVAVSPDGSLCASGGKDGTTLLWDLTEGKMLYKLDAGAIIHSLCFSPNRYWLCAATEDSVKIWDLESKLVMQDLKPEVQAFKSQMLYCTSLSWSADGSTLFAGYTDGTIRVWKVSGFGGYAI

SEQ ID NO: 3215 - protein, 361 aa, Oryza sativa
  unsure (1)..(361): unsure at all Xaa locations
AFPSSAAAICRREPRLPTPAATMAGQESLTLAGVLRGHNDMVTAIAAPIDNSPFIVSSSRDKSLLVWDITNPSTAVATDPEAAPPEYGVSYRRLTGHSHFVQDVVPXSSRRASSRLSGSWDGELRLWELATGRTTRRFVGHTKDVLAVAFSVDNRQIVSAARDNTIKLWNTLGECKYTIGGDHGAGEGHTGWVSCVRFSPNPMAPTIVSGSWDRSVKVWNLTNCKLRTKLEGHNGYVNAVAVSPDGXSLCASGGKDGTTLLWDLTEGKMLYKLDAGAIIHSLCFSPNRYWLCAATEDSVKIWDLESKLVMQDLKPEVQAFKSQMLYCTSLSWSADGSTLFAGYTDGTIRVWKVSGFGGYAI

SEQ ID NO: 3216 - protein, 235 aa, Oryza sativa
  unsure (1)..(235): unsure at all Xaa locations
PSYLPTLXXRDGGEEPRGGGGRAAAAAAVRMWVEASGGRVGMXFGLGTYLEVGGAYLNDPLWRGNCLLWSPHLVRKVHLDYLEAGANIIMTTSYQATIQGFESKGFSKERSEDLLAKSVEIAREARDMFLKEHXQDRPIQHPILVAASIGSYGAYLADGSEYSGDYGEAGTLEFLKDFHKRRLEVLAAAGPDLIAFETIPNKLEAQVCYSLLLTPGISCLSFNNVFLQNNLYWFX

SEQ ID NO: 3217 - protein, 370 aa, Oryza sativa
  unsure (1)..(370): unsure at all Xaa locations
MVGKSGVAEEGGAAAAAAVRRWVEAGGGRLVMDGGLATELEANGADLNDPLWSAKCLLSSPHLVRKVHLDYLEAGANIIITASYQATIQGFESKGFSKEQSEDLLAKSVEIAREARDMFLKEHSDRPIQHPILVAASIGSYGAYLADGSEYSGDYGEAGTLEFLKDFHKRRLEVLAEAGPDLIAFETIPNKLEAQAYVELLDECNISIPAWFSFNSKDGVHIVSGDSLIECATIANGCSKVGAVGINCTPPRFIHGLILSIRKVTDKPILIYPNSGERYDAEKKEWVESTGVSDGDFVSYVNEWCKDGAVLIGGCCRTTPNTIKAISRSLNQRHSSLHLPVAXSCTLLQVCYSCWYLNLMNISWRSLLAA

SEQ ID NO: 3218 - protein, 354 aa, Oryza sativa
  unsure (1)..(354): unsure at all Xaa locations
LLPELVEEVVRRVEASGGERWPARKDLVSCACVCRRWREAAAAVVRPLPESGRITFPSSLKQPGPKDFPIQCFVKRNKKKSMFYLYLGLLNGTMDKGKFLMAARRFRRGPHTEYVISLDADDLSQGSNAYVGKLRXLSRILXXXSFTFHCSCSLAPCVFFCFCCTIFRSDFWGTNFKIYDNQPPYDDAKTSSTRSSQRFGSTQICPQISAGNFNVGQISYKYNLLKSRGPRRMFCTMECPSTQETWENSLKTKSLRCTGTTXVLRNKAPRWHEHLQCWCLNFHGRVTVASVKNFQLVATADPSHPDSVGDEETVILQFGKVDSNIFTMDYRQPLSAFQAFAICLSSFGTKLACE

SEQ ID NO: 3219 - protein, 224 aa, Oryza sativa
  unsure (1)..(224): unsure at all Xaa locations
MSRRSYSACAARARRAAASPXAPPLPMKRHGAVAVAAAAAARAPVKLYXRGVRQRHWGKWVAEIRLPRNRTRLWLGTFDTAEEAALAYDSAAFRLRGESARLNFPELRRGGAHLGPPLHAGVDAKLHAICHGMDLPQPQPQTQSNATTTTMSTTATNTPSPFFSSESPVVKSEPVCSASESSSSADGDVSSTGSSDSEAPWDESESFLLHKYPSLEIDWDAILS

SEQ ID NO: 3220 - protein, 333 aa, Oryza sativa
MSKARVYTDVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDSLNSYLNKYRIELDPQLEALVGRHSRKPWSKFINADNQHLVSPEAIDFLDKLLRYDHQDRLTAREAMAHPYFLQGRAAENSRPRAQ

SEQ ID NO: 3221 - protein, 374 aa, Oryza sativa
MGRDQAAAAVMHEKVKLFIGVLALQFLLAGFHIVSRAALNMGISKIVFIVYRNLISLALLAPFAYFLEKKDRPPLTFSLLVEFFLLALCGITANQGFYLLGLYHLSPTYASAIQNTVPAITFAMAAVLRLEQVDLGKRHGVAKVVGTVVSIGGATVITLYKGLPLFNHNLNIKSLSSSSLILNWTLGCVFILGHCLSWSGWMVLQVPVLKRYPARLSVLSLTCIFGLLQFLVIAAFTEEDLSRWKVNSGSELFTILYAGLVASGVAFALQIWCIDRGGPLFTAVFQPVQTVAVAVMAAIILGDQLYSGGIIGAVLIVIGLYFVLWGKSEEKKSKNNNLQDQPVQGGGDDIRRHLLGQEDASRKDEEAAVTDELA

SEQ ID NO: 3222 - protein, 111 aa, Oryza sativa
  unsure (1)..(111): unsure at all Xaa locations
GDMDLSGEEHVPKARKPYTITKQREKWTDEEHRLFLEALQLHGRAWRRIQEHIGTKTAVQIRSHAQKFFSKVSNTGSGGASAAAAAAAIQIPPPRPKRKPAHPYPRKVDXA

SEQ ID NO: 3223 - protein, 282 aa, Oryza sativa
  unsure (1)..(282): unsure at all Xaa locations
LRNARFFASSFPSPPHLPPSRRPHQQHRGENSQRLRGLGGADFLALVWRSCGVWFGLGGVRFFQNGDGLFAGKRHGNRRKRCRRSRRRREHRGSSQELNYGDMDLSGEEHVPKARKPYTITKQREKWTDEEHRLFLEALQLHGRAWRRIQEHIGTKTAVQIRSHAQKFFSEVVRESSGSNTGXGRRVRPIQIPPPRPKRKPAHPYPRKVDGAAKKHVPALSLSEQEEGSPTSVLTAVGTEALGGGFSNNSSGSGSLAPSAAAEAAGGEEAVADGELTRLCLX

SEQ ID NO: 3224 - protein, 898 aa, Oryza sativa
  unsure (1)..(898): unsure at all Xaa locations
MDSPRFRAILRATSGRRKRAPDVKSFSHELNIRGPLLHPLQQRRCVNSPEEFIGAIRTKFIRLKEEVDAELGVFAGDLVGALDKADGDEERVALEDLLVVAQRCAEMSPEELWVKCECIVQGLDDRRQELTAGVLKQAHTRVLFILTRCTRLLQFRKEGGGYEQHVLSLHQLSDLGLYPFKVAGGSSELGRKSTSSLTELKERXSSGGGCWSTSNSPSTSPGRVISSDTGGDSPGSGGKISSWKKLPSPAEKTLHKVTEPTTEEKTTPTKKKAITRNKVAVDEIVERIDAASIHPDGLSXSWGLWAQQIIVDGKPRMICRICDFEIPMVCAEGHFIVCTLADRCDSKGLNTDQRLQRVAEGALTPASGSMPQSPLLTPRTSHAESQLTKHKAFVELENFQQVESLMTIARGIERIKNSEYNSLEDLSSYLEDLNAVIDTRKVDALVVETFGRRIAKLLQEKFIQLCGQIEDSNTDSLGSIDEXXGPMESSVSSRTSQMNGKFKDRTSIEDFEIIKPISRGAFGRVFLAKKRVTGDLFAIKVLKKADMIRKNAVESILAERDILISARNPFVVRFFYSFTCRENLYLVMEYLNGGDLYSLLRNLGCLDEDMARTYMAELVLALEYLHSMNVIHRDLKPDNLLISRDGHIKLTDFGLSKVGLINSTDDLSGPDVSNVLVGDHQPADAEQRAQKREQRQKQAAVGTPDYLAPEILLGMTHGPTADWWSVGVILFELLVGIPPFNAEHPQIIFDNIMNREIPWPQVPEELSFEAYDLIDKLLIENPVQRLGATGAGEAAFIPSTDDEYDTSYFACRHTWDDQVNVASNDYDDRSETSSMSCGSSHEEDADEFGSMEEFGAPSLSVKYSFSNFSFKNISQLASMNYDLITKHNEDPLQSSKSX

SEQ ID NO: 3225 - protein, 1013 aa, Oryza sativa
  unsure (1)..(1013): unsure at all Xaa locations
FNRNRDAMQSYIKLKPQTRTPRFRAILRATSGRRKRAPDVKSFSHELNIRGPLLHPLQQRRCVNSPEEFIGAIRTKFIRLKEEVDAELGVFAGDLVGALDKADGDEERVALEDLLVVAQRCAEMSPEELWVKCECIVQGLDDRRQELTAGVLKQAHTRVLFILTRCTRLLQFRKEGGGYEQHVLSLHQLSDLGLYPFKVAGGSSELGRKSTSSLTELKERXSSGGGCWSTSNSPSTSPGRVISSDTGGDSPGSGGKISSWKKLPSPAEKTLHKVTEPTTEEKTTPTKKKAITRNKVAVDEIVERIDAASIHPDGLSXSWGLWAQQIIVDGKPRMICRICDFEIPMVCAEGHFIVCTLADRCDSKGLNTDQRLQRVAEVLGRVLGCFESKSPQTAECNHNETARGSTSSLTESDGSMDHDILSHLLTVPSTELFSEVVASSSSNNSILRRGALTPASGSMPQSPLLTPRTSHAESQLTKHKAFVELENFQQVESLMTIARGIERIKNSEYNSLEDLSSYLEDLNAVIDTRKVDALVVETFGRRIAKLLQEKFIQLCGQIEDSNTDSLGSIDEXXGPMESSVSSRTSQMNGKFKDRTSIEDFEIIKPISRGAFGRVFLAKKRVTGDLFAIKVLKKADMIRKNAVESILAERDILISARNPFVVRFFYSFTCRENLYLVMEYLNGGDLYSLLRNLGCLDEDMARTYMAELVLALEYLHSMNVIHRDLKPDNLLISRDGHIKLTDFGLSKVGLINSTDDLSGPDVSNVLVGDHQPADAEQRAQKREQRQKQAAVGTPDYLAPEILLGMTHGPTADWWSVGVILFELLVGIPPFNAEHPQIIFDNIMNREIPWPQVPEELSFEAYDLIDKLLIENPVQRLGATGAGEVKAHPFFKDINWDMIARQQAAFIPSTDDEYDTSYFACRHTWDDQVNVASNDYDDRSETSSMSSFSKKHXQADEFGSMEEFGAPSLSVKYSFSNFSFKNISQLASMNYDLITKHNEDPLQSSNLRVCTPSTW

SEQ ID NO: 3226 - protein, 213 aa, Oryza sativa
IDCGVSIGTIFGIYMIKDKDNVTLDDVLQPGTDMLAAGYCMYGSSCTLVLSTGNGVNGFTLDPSLGEFILTHPNIKIPNRGKIYSVNEGSAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 3227 - protein, 159 aa, Oryza sativa
MDAAGAGAGGKLKKGAAGRKAGGPRKKAVSRSVKAGLQFPVGRIGRYLKKGRYAQRIGTGAPVYLAAVLEYLAAEVLELAGNAARDNKKNRIIPRHVLLAIRNDEELGKLLAGVTIAHGGVLPNINPVLLPKKTAEKAAAAGKEAKSPKKAAGKSPKKA

SEQ ID NO: 3228 - protein, 159 aa, Oryza sativa; identical to SEQ ID NO: 3227

SEQ ID NO: 3229 - protein, 319 aa, Oryza sativa
MWKMSQVDEWKPVIAMLFFDLISAVTTALLKKALAEGLDRLVLITLRQLVATIFLAPIAYFKERGKRPKLTLEILVYLFFSAALGAALSQYTFFYGLQYTTATFAITFTNMSPVITFLIAALLRVESLNMKNKAGAAKIIGTLMSFAGVMLLTLYKGVALTHQVVSSTKLTKKYPALYSSTAYMFLISSLQGGALTAAIQRRASVWVLTRTVEIVAVLYTGIMGSGVGYVLMTWCVEKRGPVFTSAFIPIIQIMVAIIDFFYLHENLYLGSVVGSILMILGLYILLWGKNRDTSAAASAKEAKEEEEDKEKQVKPLGPN

SEQ ID NO: 3230 - protein, 137 aa, Oryza sativa
  unsure (1)..(137): unsure at all Xaa locations
MAAAAEGEKKMITLKSSDGEEFEVEAVGMESQTIRHMIEDKCADNGIPLPNVNSKILSKVIEYCNKHVHASADDSTSSADLKNWXADFVKXAEFVQIYLDMIKGKTPEEIRKTFNIKKDLAPEEEEEIRRENQWAFE

SEQ ID NO: 3231 - protein, 156 aa, Oryza sativa
  unsure (1)..(156): unsure at all Xaa locations
EGEKKMITLKSSDGEEFEVEAVGMESQTIRHMIEDKCADNGIPLPNVNSKILSKVIEYCNKHVHASADDSTSSADLKNWXADFVKVDQATLFDLILAANYLNIKGWXLLDLSCXQTVADMIKGKTPEEIRKTFNIKKDLAPEEEEEIRRENQWAFE

SEQ ID NO: 3232 - protein, 465 aa, Oryza sativa
  unsure (1)..(465): unsure at all Xaa locations
KLTIKRVPTVVSNYQEDAAATAGERPRAGCGRDCLGDCCLPGESLPPKSGLIITSQIYTRQHYLRDGIADYASNKXLIPPFVFSNFVCLLQWEDRMARGLFRYDVTACETKVIPGNLGFVAQLNEGRHLKKRPTEFRVDRVLQPFDAAKFNFTKVGQEEVLFQFENGGGDDSFFVESSPISVADRAPNVVAINVGYIRTEVSPIEYGHVLLIPRVLDRLPQRIDQESFLLALHMAAEAASPYFRLGYNSLGAFATINHLHFQAYYLTVPFPVEKAATKRICTMNSGVKVSKLMNYPVRGLVFEGGNSLSDLANVVSSACIWLQDNNVPYNVLISDCGKKIFLFPQCYAEKQALGEVSQELLDTQVNPAVWEISGHIVLKRRSDYEEASEASAWRLLAEVSLSEERFEEVKAYIFDAAGLVQSDEEETSNLPFRGNASSGISEISHSSGDGLDNSGILSASNCFSG

SEQ ID NO: 3233 - protein, 467 aa, Oryza sativa
  unsure (1)..(467): unsure at all Xaa locations
MEMKLTIKRVPTVVSNYQEDAAATAGERPRAGCGRDCLXGDCCLPDSKLPLYAFKASPKKPSSQEDASNDEFFVNLLLGLWEDRMARGLFRYDVTACETKVIPGNLGFVAQLNEGRHLKKRPTEFRVDRVLQPFDAAKFNFTKVGQEEVLFQFENGGGDDSFFVESSPISVADRAPNVVAINVSPIEYGHVLLIPRVLDRLPQRIDQESFLLALHMAAEAASPYFRLGYNSLGAFATINHLHFQAYYLTVPFPVEKAATKRICTMNSGVKVSKLMNYPVRGLVFEGGNSLSDLANVVSSACIWLQDNNVPYNVLISDCGKKIFLFPQCYAEKQALGEVSQELLDTQVNPAVWEISGHIVLKRRSDYEEASEASAWRLLAEVSLSEERFEEVKAYIFDAAGLVQSDEEEVSEDEDATXXHACLHCPSXLSRKAASSFSETVEQVVGLVKRCAAFVFSSVFFSLHPLVA

SEQ ID NO: 3234 - protein, 654 aa, Oryza sativa
  unsure (1)..(654): unsure at all Xaa locations
DAKHRIXSHNRRVAALPDVDDFFWEKDPTPILDTIDAPIHLKNLSSKELKQLAGEVRSEISFIMSRKCQPCNTGHSVVELAIAIHYVFNAPMDKILWDAGQHTYAHKILTGRRSLFHTIKQRKGLSGFTSRFESEYDPFGAGHGCNSLSAGLGMAVARDLGGRKNRIVTVISNWTTMAGQVYEAMGHAGFLDSNMVVILNDSRHTLLPKADSQSKMSINALSSALSKVQSSKGFRKFREAAKGLSKWFGKGMHEFAAKIDEYARGMIGPHGATLFEELGLYYIGPIDGNNIDDLICVLKEVSTLDSTGPVLVHVITENEKDSDILKFLENGLSRTYNDCFVESLIAEAENDKHIVVVHGGMGIDRSIQLFQSRFPDRFFDLGIAEQHAVTFSAGLACGGLKPFCIIPSTFLQRAYDQIVEDVDMQKIPVRFAITSAGLVGSEGPTNSGPFDITFMSCLPNMIVMSPSNEDELIDMVATAAMVEDRPICFRYPKGAIVGTSGTLAYGNPLEIGKGEILAEGKEIAFLGYGDVVQRCLIARSLLFNFGIQATVANARFCKPLDIDLIRMLCQQHDFLITVEEGTVGGFGSHVSQFISLDGLLDGKIKWRPIVLPDRYIEHASLTEQLDMAGLTAHHIAATALTLLGRHRDALLLMK

SEQ ID NO: 3235 - protein, 732 aa, Oryza sativa
MPSRVCSFSISAVHCADKANILAALPDVDDFFWEKDPTPILDTIDAPIHLKNLSSKELKQLAGEVRSEISFIMSRKCQPCNTGHSVVELAIAIHYVFNAPMDKILWDAGQHTYAHKILTGRRSLFHTIKQRKGLSGFTSRFESEYDPFGAGHGCNSLSAGLGMAVARDLGGRKNRIVTVISNWTTMAGQVYEAMGHAGFLDSNMVVILNDSRHTLLPKADSQSKMSINALSSALSKVQSSKGFRKFREAAKGLSKWFGKGMHEFAAKIDEYARGMIGPHGATLFEELGLYYIGPIDGNNIDDLICVLKEVSTLDSTGPVLVHVITENEKDSGGEFNSEITPDEEGPPDSSQDILKFLENGLSRTYNDCFVESLIAEAENDKHIVVVHGGMGIDRSIQLFQSRFPDRFFDLGIAEQHAVTFSAGLACGGLKPFCIIPSTFLQRAYDQIVEDVDMQKIPVRFAITSAGLVGSEGPTNSGPFDITFMSCLPNMIVMSPSNEDELIDMVATAAMVEDRPICFRYPKGAIVGTSGTLAYGNPLEIGKGEILAEGKEIAFLGYGDVVQRCLIARSLLFNFGIQATVANARFCKPLDIDLIRMLCQQHDFLITVEEGTVGGFGSHVSQFISLDGLLDGKIKWRPIVLPDRYIEHASLTEQLDMAGLTAHHIAATALTLLGRHRDALLLMKLLTSSENSKFIITEPSQTGSINYSCKMLRKVFDFETEHTWAYDSNHEAN

SEQ ID NO: 3236 - protein, 414 aa, Oryza sativa
  unsure (1)..(414): unsure at all Xaa locations
VQPCVGVWSDKCRSKYGRRRPFILAGCLMICFAGPARALLADLSGPDQCNSANAIFCTWMAVGNVLGFSSGASGNWHKWFPFLMTRACCEACSNLKAAFLVAVVFLLFCMSVTLYFAEEIPLEPTDAQRLSDSAPLLNGSRDXXNNASNEPRNGALPNGHTDGSNVPANSNAEXTPIQTERMSKFSXDGPGAVLVNILTSMRHLPPGMYSVLLVMALTWLSWFPFFLFDTDWMGREVYHGDPNGNLSERKAYDNGVREGAFGLLLNSVVLGIGSFLVDPLCRLMGARLVWAISNFTVFICMLATAILSWISFDLYSSKLHHIIGANKTVKNSALIVFSLLGLPLSITYSVPFSVTAELTAGTGGGQGLATGVLNLAIVVPQELVSSRSLSYPSCQTLTDLLGSMDLAEQNTSRM

SEQ ID NO: 3237 - protein, 99 aa, Oryza sativa
  unsure (1)..(99): unsure at all Xaa locations
XIPLLITYSVPFSVTAELTAGTGGGQGLATGVLNLAIVVPQIVVSLGAGPWDALFGGGNVPAFALASVFSLGAGVLAVLKLPKLXXNSYRSAGFHGFGX

SEQ ID NO: 3238 - protein, 525 aa, Oryza sativa
  unsure (1)..(525): unsure at all Xaa locations
LVLWXVSAIIKFSFFFVSXPGMSNTPNTIVYXCPVIXLQVQPCVGVWSDKCRSKYGRRRPFILAGCLMICFAVTLIGFSADLGYILGDTTEHCSTYKGSRFRAAIIFVLGFWMLDLANNTVQGPARALLADLSGPDQCNSANAIFCTWMAVGNVLGFSSGASGNWHKWFPFLMTRACCEACSNLKAAFLVAVVFLLFCMSVTLYFAEEIPLEPTDAQRLSDSAPLLNGSRDXXNNASNEPRNGALPNGHTDGSNVPANSNAEDSNSNRENVEVFNDGPGAVLVNILTSMRHLPPGMYSVLLVMALTWLSWFPFFLFDTDWMGREVYHGDPNGNLSERKAYDNGVREGAFGLLLNSVVLGIGSFLVDPLCRLMGARLVWAISNFTVFICMLATAILSWISFDLYSSKLHHIIGANKTVKNSALIVFSLLGLPLSITYSVPFSVTAELTAGTGGGQGLATGVLNLAIVVPQIVVSLGAGPWDALFGGGNVPAFALASVFSLGAGVLAVLKLPKLPNSYRSAGFHGFG

SEQ ID NO: 3239 - protein, 81 aa, Oryza sativa
  unsure (1)..(81): unsure at all Xaa locations
AAQGLGELIDVPSEKTLNEVGVPITGTLMQILGDRFPPQVKSDILSTLTMIISKGGLALKTLLAQLETTFVKCLQDNNRSX

SEQ ID NO: 3240 - protein, 396 aa, Oryza sativa
  unsure (1)..(396): unsure at all Xaa locations
MAASAAPLSRVSPGGSAATSSSSTPPPPPDGGGGGYFRFDLLGGSPDEDGCSSPVMTRQLFPSPSAPPLTMPMPAAAGEGPWPRRAADLGVAQSQRSPAGGKKSRRGPRSRSSQYRGVTFYRRTGRWESHIWDCGKQVYLGGFDTAHAAARAYDRAAIKFRGLDADINFNLNDYEDDLKQMRNWTKEEFVHILRRQSTGFARGSSKYRGVTLHKCGRWEARMGQLLGKKYIYLGLFDSEIEAARAYDRAAIRFNGREAVTNFDPSSYDGXXVLPETDNEVVDGDIIDLNLRISQPNVHELKSDGTLTGFQLNCDSPEASSSVVTQEVPMEKRPELGPQSFPTSWSWQMQGSPLPLLPTAASSGFSTGTVADAARSPSSXXPIHFPATTXFYFPPTA

SEQ ID NO: 3241 - protein, 427 aa, Oryza sativa
  unsure (1)..(427): unsure at all Xaa locations
MVLDLNVESPGGSAATSSSSTPPPPPDGGGGGYFRFDLLGGSPDEDGCSSPVMTRQLFPSPSAPPLTMPMPAAAGEGPWPRRAADLGVAQSQRSPAGGKKSRRGPRSRSSQYRGVTFYRRTGRWESHIWDCGKQVYLGGFDTAHAAARAYDRAAIKFRGLDADINFNLNDYEDDLKQMRNWTKEEFVHILRRQSTGFARGSSKYRGVTLHKCGRWEARMGQLLGKKYIYLGLFDSEIEAARAYDRAAIRFNGREAVTNFDPSSYDGXXVLPETDNEAVVDGDIIDLNLRISQPNVHELKSDGTLTGFQLNCDSPEASSSVVTQPISPQWPVLPQGTSMSQHPHLYASPCPGFFVNLRLQEVPMEKRPELGPQSFPTSWSWQMQGSPLPLLPTAASSGFSTGTVADAARSPSSXXPIHFPATTXFYFP

SEQ ID NO: 3242 - protein, 103 aa, Oryza sativa; identical to SEQ ID NO: 683

SEQ ID NO: 3243 - protein, 341 aa, Oryza sativa
MASEGVLLGMGNPLLDISAVVDDAFLTKYDVKLNNAILAEEKHLPMYDELASKGNVEYIAGGATQNSIRVAQWMLQTPGATSYMGCIGKDKFGEEMKKNAQAAGVTAHYYEDEAAPTGTCAVCVVGGERSLVANLSAANCYKSEHLKKPENWALVEKAKYIYIAGFFLTVSPDSIQLVAEHAAANNKVFLMNLSAPFICEFFRDAQEKVLPFVDYIFGNETEARIFAKVRGWETENVEEIALKISQLPLASGKQKRIAVITQGADPVVVAEDGQVKTFPVILLPKEKLVDTNGAGDAFVGGFLSQLVQQKSIEDSVKAGCYAANVIIQRSGCTYPEKPDFN

SEQ ID NO: 3244 - protein, 369 aa, Oryza sativa
MVMMVDPPNGMGNQGKHYYTMWQTLFEIDTKVVPIKPIGRGAYGIVCSSINRATNEKVAIKKINNVFDNRVDALRTLRELKLLRHLRHENVIALKDIMMPVHRRSFKDVYLVYELMDTDLHQIIKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSEADIEFIDNPKARKYIKTLPYTPGIPLTSMYPQAHPLAIDLLQKMLVFDPSKRISVTEALEHPYMSPLYDPSANPPVQVPIDLDIDENLGVDMIREMMWQEMLHYHPEVVAGVNM

SEQ ID NO: 3245 - protein, 258 aa, Oryza sativa
  unsure (1)..(258): unsure at all Xaa locations
MEHLPVEVIGNILAHLSAARDVMVASGVCRKWRTACRKHPRSLSFNSDDFPRDMTTRQLEIVITQTIFQTMGLQCLSIHIDRTHEFSAAPVIAWLMYTRETLRSLSYNVRTNPNVNILEKCGRQKLEVLDLDHNTITGVEPSYQRFTCLKSLSLRHVSISALDLSLLVAACPKIESLALDFLEVVTSDPQSTMELTSHTLKSLFAKSVGVDKIILDTDNLEVLNLNALTLDLFELIGKGTLKHLKIDDVSVTHMDIGX

SEQ ID NO: 3246 - protein, 342 aa, Oryza sativa
  unsure (1)..(342): unsure at all Xaa locations
PSVAASAAEAQNPNAFTCELPHSIYALAFSXLRARXLAAGSFLEDLHNRVSLLSFDPVHPTAASFRALPALSFDHPYPPTKLQFHPRAASAXXHLLASSSDALRLWXLPRSTISPPSVLDNRKTSASEFCAPLTSFDWNEAEPRRIGTASIDTTCTIWDIERGVVETQLIAHDKAVHDIAWGENGIFASVSADGSVRVFDLRDKEHSTIFYESPRPDTPLLRLAWNRYDFHYMATLLMDSSAVVVLDMRAPGVPVAELHRHRACANAVAWAPQATRHLCSAGDDGQALIWELPATPGAVPAEGIDPVMVYDAGAEINQLQWAAAYPEWISIAFENKVQLLRV

SEQ ID NO: 3247 - protein, 342 aa, Oryza sativa; identical to SEQ ID NO: 3246
  unsure (1)..(342): unsure at all Xaa locations

SEQ ID NO: 3248 - protein, 249 aa, Oryza sativa
  unsure (1)..(249): unsure at all Xaa locations
FGVTCSIIKEQAPQSLSCQAHTPSASSLLPFLLSPCSLFLLFFQSSSMAVAIEAPFHVLAVDDSLPDRKLIERLLKTSSFQVTTVDSGSKALEFLGLHDHEDSPISTXXSDQQEVGVNLIITDYCMPGMTGYDLLKKIKESSYLRDIPVVIMSSDNIPSRINRCLEEGADEFFLKPVRLSDMSKLKPHILKSRCKEHYQQEQHLQSNSESNNSSNPTSENSSSSTSTNSHKRKAVDEEILPHTIRPRHS

SEQ ID NO: 3249 - protein, 131 aa, Oryza sativa
  unsure (1)..(131): unsure at all Xaa locations
XSSSPVPTFPFPLPRAMASAADEGTAAPRAAVSHVIFDMDGLLLDTEGFYTEVQEKILARYGKVFDWSLKAKMMGKKATESARIFVDQCGLDGHLTPEQFLEERESMLQELFPFAPSCLSVTFDHHFMQMX

SEQ ID NO: 3250 - protein, 224 aa, Oryza sativa
  unsure (1)..(224): unsure at all Xaa locations
SSINKRFSLAGATALVTGGSKGIGRAIVEELASFGATVHTCARNQAELSRCQEEWTAKGLAVTVSVCDVAVRADREALAGRVSAMFDGKLSILVNNAGTAYLKPAADLTPEETSRLMTTNFESCFHLSQLFYPLLKDSGRGSIVNISSVASVLAFHSLPIYSAAKGAMNQVTRNLACEWASDGIRVNSVAPGYIQTPLLTAYLATXXXXXXXXXXXQRVRIQEX

SEQ ID NO: 3251 - protein, 382 aa, Oryza sativa
  unsure (1)..(382): unsure at all Xaa locations
MMKPQHGGMAGHGGGRTRSPFLTSYALTLAFITFVSVLYFKDFSCSTNPSSPALLPTAARSPAPAPRATTMAFAVGAAAAAGCDVGVGEWVYDEAARPWYEEEECPYIQPQLTCQAHGRPDTAYQHWRWQPRGCSLPSFNATLMLEMLRGKRMMFVGDSLNRGQYXSLVCLLHRSIPESSKSMETFDSLTVFRAKNYNATIEFYWAPFLAESNSDDAVVHRIADRIVRGTALEKHARFWKGADILVFNSYLWWMTGQKMKILQGSFEDKSKDIVEMETEEAYGMVLNAVVRWVENNMNPRNSRVFFVTMSPTHTRSKDWGDDSDGNCYNQTTPIRDLSYWGPGTSKGLMRVIGEVFSTSKVPVGIVNITQLFQYRKDAHTQX

SEQ ID NO: 3252 - protein, 249 aa, Oryza sativa
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTIKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 3253 - protein, 251 aa, Oryza sativa
MAEELVLDTAIRDWVLVPLSVVMVLIGVLRYFVAKLMRSPSASPSPDPKLVKEGQVVIRARNLRINSQYIPAKAFKSRKVYYTNEENGLLHVPKEEAQKAQAAMFSDPNMAMDMMKKNLSMIVPQTLTFAWVNFFFSGFVAAKIPFPLTPRFRGMLQNGIDLSTVDVSYVSSRSWYFLNLFGLRGLFSLILGEENANDDAQKMMQMGGGFGGNPTMGLAAEKDNLDIIQHDWALPKMEHHAEEVLRKLLKK

SEQ ID NO: 3254 - protein, 249 aa, Oryza sativa; identical to SEQ ID NO: 3252

SEQ ID NO: 3255 - protein, 373 aa, Oryza sativa
GAMMISRQLVLTYLYLLIYVCLSSGVILFNKWVLSPKYFKFPFPITLTMIHMAFSGVVTFFLVRVFKVVAPVKMTFQIYATCVIPISAFFASSLWFGNTAYLYISVAFIQMLKALMPVATFIMAVLCGTDKLRWDLFLNMVLVSVGVVVSSYGEIHFNIIGTLYQVTGIFAEALRLVLTQVLLQKKGLTLNPITSLYYIAPCSFIFLFVPWFLLEKPEMDVSQIQFNYWIFFFNAVAAFALNISIFLVIGRTGAVTIRVAGVLKDWILIALSTIIFPESIITSLNIIGYAVALSGVVMYNYLKMKDVRANQLPADIAPDRATKDSNDETTVGSLASEGAGVDEEAPLIPSSRLSYVTRTQTGNHRRCKAFYRC

SEQ ID NO: 3256 - protein, 331 aa, Oryza sativa
TEPQEEREVNRAPEAGAMMISRQLVLTYLYLLIYVCLSSGVILFNKWVLSPKYFKFPFPITLTMIHMAFSGVVTFFLVRVFKVVAPVKMTFQIYATCVIPISAFFASSLWFGNTAYLYISPARPQMLKALMPVATFIMAVLCGTDKLRWDLFLNMVLVSVGVVVSSYGEIHFNIIGTLYQVTGIFAEALRLVLTQVLLQKKGLTLNPITSLYYIAPCSFIFLFVPWFLLEKPEMDVSQIQFNYWIFFFNAVAAFALNISIFLVIGRTGAVTIRVAGVLKDWILIALSTIIFPESIITSLNIIGYAVALSGVVMYNYLRWKMQSDQLPVISL

SEQ ID NO: 3257 - protein, 503 aa, Oryza sativa
  unsure (1)..(503): unsure at all Xaa locations
MDALSLLLLPAARPARPALHLRDAAAAAAAARVPPPRLPWSRAVARRLLSTSVAAVAAETPRAEDAPSASGKEERFDWLDQWYPVAPVCDLDPGAPHGKTVLGLRIVAWFDRTTAAADGGGGEWRVFDDSCPHRLAPLSEGRVDDKGRLQCVYHGWCFDGRGACQFIPQAPALGPAVHKNSKACVASYPCVVQNNILWFYPRSEPEYKEILQRKRPPYIPQIDDPSFVTVYGVRDLPYGYDVLVENLMDPAHVPYAHXRGGGPLKMEIEETNVEGFLSMLDRGFFKMIRARRRRRSNPQXMLVFLCIPVSPGRSRLVWAFPRNVGVWMDKIIPRWYYHIGQNAILDSDIYLLHIEERNFATVGLDNWQKACYVPTSSDNMIITFRNWFRKYCKHQIGWATPITNQLPPTPSKDQLLDRYWSHVMQCTSCSGALKKMKALEVALQVASVAVVGFLAVAKGTVVTSVVQRSAVVAAAVLCFAASRWLANFIEKNFYFQDYVHAYK

SEQ ID NO: 3258 - protein, 456 aa, Oryza sativa
  unsure (1)..(456): unsure at all Xaa locations
MDALSLLLLPAARPARPALHLRDAAAAAAAARVPPPRLPWSRAVARRLLSTSVAAVAAETPRAEDAPSASGKEERFDWLDQWYPVAPVCDLDPGAPHGKTVLGLRIVAWFDRTTAAADGGGGEWRVFDDSCPHRLAPLSEGRVDDKGRLQCVYHGWCFDGRGACQFIPQAPALGPAVHKNSKACVASYPCVVQNNILWFYPRSEPEYKEILQRKRPPYIPQIDDPSFVTVYGVRDLPYXDDQGKEKKKKQPTVMLVFLCIPVSPGRSRLVWAFPRNVGVWMDKIIPRWYYHIGQNAILDSDIYLLHIEERNFATVGLDNWQKACYVPTSSDNMIITFRNWFRKYCKHQIGWATPITNQLPPTPSKDQLLDRYWSHVMQCTSCSGALKKMKALEVALQVASVAVVGFLAVAKGTVVTSVVQRSAVVAAAVLCFAASRWLANFIEKNFYFQDYVHAYK

SEQ ID NO: 3259 - protein, 572 aa, Oryza sativa
  unsure (1)..(572): unsure at all Xaa locations
TPSSKLTLTKGNKSWSSTAVPAALELVDPPGCRXIRHEAPRAPRSTSATPPPPPPPPASRRRSRAVARRLLSTSVAAVAAEDAAGGGPRRRGRGRGERFDWLDQWXPVAPVCDLDPGAPDGKTVLGLRIVAWFDRTTAAADGGGGEWRVFDDSCPHRLAPLSEGRVDDKGRLQCVYHGWCFDGRGACQFIPQAPALGPAVHKNSKACVASYPCVVQNNILWFYPRSEPEYKEILQRKRPPYIPQIDDPSFVTVYGVRDLPYGQLLIMASSXXANFAMXXVQIAMLSCVTDSXNIHLLYTVEFDKEGGGPLKMEIEETNVEGFLSMLDRGFFKFVAPCTFYGSPLQTPSQAXXFKLIEPSYKISIKQPTVMLVFLCIPVSPGRSRLVWAFPRNVGVWMDKIIPRWYYHIGQNAILDSDIYLLHIEERNFATVGLDNWQKACYVPTSSDNMIITFRNWFRKYCKHQIGWATPITNQLPPTPSKDQLLDRYWSHVMQCTSCSGALKKMKALEVALQVASVAVVGFLAVAKGTVVTSVVQRSAVVAAAVLCFAASRWLANFIEKNFYFQDYVHAYK

SEQ ID NO: 3260 - protein, 294 aa, Oryza sativa
MEQYEKEEKIGEGTYGVVYRARDKVTNETIALKKIRLEQEDEGVPSTAIREISLLKEMHHGNIVRLHDVIHSEKRIYLVFEYLDLDLKKFMDSCPEFAKNPTLIKSYLYQILRGVAYCHSHRVLHRDLKPQNLLIDRRTNALKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQDLATIVPTLDPAGLDLLSKMLRYEPNKRITARQALEHEYFKDLEMVQ

SEQ ID NO: 3261 - protein, 96 aa, Oryza sativa
  unsure (1)..(96): unsure at all Xaa locations
PTYVSGKASPANASCEENAYMAXLAYPAERYKEMRQFMDMAANTTDVLELTVQERNLLSRAYKNMTCARMALWRIISSIEQKEDSPRHAASVASIX

SEQ ID NO: 3262 - protein, 143 aa, Oryza sativa
  unsure (1)..(143): unsure at all Xaa locations
XXAPRRRRLCRRRTTSARSATTASGSPARPTAPIVCGEVQHYNRIFGGTPRNLTQRLQDLPFFIRRLFRELLDPQRTLPLVFRARMVMMVALSAIYVLSPIDILPENVLGLFGFFDDFLVLLIVFLHLAAVYRSLLLYRHGGH

SEQ ID NO: 3263 - protein, 573 aa, Oryza sativa
MATTDATIAHIMDEQEDIKVKASKCWNPIRPPATLLISNGRQISIQAPFSAREYLMESSRSPLSNGSNLITKFHPSQPQMKKQGATSPVMGLWACNFVWDPGPSGAHWLTASLVSCDVAAVLVVHDRVKLVLCLREAMLLLHLHRLCRRREKIVRVGGGSPMLCWDLGQWAFEGKKSTRILRWSNRGNEHSEFEFTVRSVLLPGRQPGLRPHLPQEQVRLLLLLRVGGGGARSDWLVDRLIDRAMAVAVEEIVRRAGGCAVIDGGFATQLEALGADINDPLWSAACLITKPHLIKEVHMQYLEAGADVIISSSYQATIPGFLARGMLLEEAEGLLRRSIELALEARDEFWKSTLRKSKPVYNRALVAASIGSYGAYLADGSEYSGSYGEDITAEKLKDFHRRRLQVLASAGPDLIAFEAIPNKMEAQALVELLEEENIQVPSWICFSSVDGKNLCSGESFAECLQFLNASDKVTIVGVNCTPPQFIEGIIRELKKQTKKAIAVYPNSGEIWDGRAKRWLPAQCFGHKSFDALAKRWQEAGASLVGGCCRTTPSTIRAVSKVLKGKTSYSATQI

SEQ ID NO: 3264 - protein, 187 aa, Oryza sativa
  unsure (1)..(187): unsure at all Xaa locations
ISKLSMIPVVCLMEWVLNSKHYTTKVISAVVVVAAGVGICTVTDVEVNAKGFICACVAVFCTSLQQIXXFILLSCSLAVFCNMSQYLCIGRFSATSFQVLGHMKTVCVLILGWILFDSALTVKNILGMLLAVMGMVVYSWAVETEKKASAPIPRNKSDMLDDSEDVPLKARVSGLPSSDLEEGEMKS

SEQ ID NO: 3265 - protein, 404 aa, Oryza sativa
  unsure (1)..(404): unsure at all Xaa locations
PCGSSRVRHRGPGGRPRDPSRAVPCPALPPPRVAARSSSSSEGEESRGGVRRRRRGEMEAEKKPPAVSDVGAWAMNVVSSVGIIMANKQLMSSSGYAFSFATTLTGFHFTVTALVGWISNATGYSVSKHVPLWELVWFSLVXNTXITGMNLSXMXNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQXGFLLXLGPFAEXNXNGRWLLKXQIFQLGATFFILLSCSLAVFCNMSQYFCIGRFSATXSFQFLGHMKTVCVLILGWILFDSALTVKNILGMLLAVMGMVVYSWAVETRKKASAPIPRNKSDMLDDSEDVPLKARVSGLPSSDLEEGEMKS

SEQ ID NO: 3266 - protein, 239 aa, Oryza sativa
  unsure (1)..(239): unsure at all Xaa locations
XPEMDGFEATRRIRVMERDLNERTPILAMTADVIQATHEECLKSEMDGYVVIMKPLRASMLQVSLRRALGGVDKVHCRNGVVGNSTLGSLLHKKQIIVVDDNIVNLKVAAGALKKYGAEVTCADSGKKXAITLLKPPHNFDACFMDIQMPEMDGFEATRRIRVMERDLNERIERGEAPPECASIQRWRTPILAMTADVIQATHEECLKSEMDGYVSKPFEGEQLYSEVARFFHNHDQVE

SEQ ID NO: 3267 - protein, 281 aa, Oryza sativa
  unsure (1)..(281): unsure at all Xaa locations
MGQQQQQENLTLLPMSSSSAAAAADAAAAASAGRLFTAGLVASWYASNIGVLLLNKFLLSTYGFRYPVFLTACHMSACALLSYAAAAASAAAPRAARPRRSRGQLARVALLGAVFCASVVAGNVSLRYLPVSFNQAVGATTPFFTAVLAYAVAARREACATYAALIPVVAGVVIATGVRRPRFLTGSALIALPTCNANLICXXEKLNPMELLGYMAPVAVVLLIPATFIMERNVLRIHVSLATSAAPFVWNSRSHSCISWRSHCSNSXVEPSEVSKMVLLL

SEQ ID NO: 3268 - protein, 470 aa, Oryza sativa
  unsure (1)..(470): unsure at all Xaa locations
MGQQQQQENLTLLPMSSSSAAAAADAAAASSPAASAGRLFTAGLVASWYASNIGVLLLNKFLLSTYGFRYPVFLTACHMSACALLSYAAAAASAAAPRAARPRRSRGQLARVALLGAVFCASVVAGNVSLRYLPVSFNQAVGATTPFFTAVLAYAVAARREACATYAALIPVVAGVVIATGGEPSFHLFGFIMCIGATAARALKTVLQGILLSSEEEKLNPMELLGYMAPVAVVLLIPATFIMERNVLTXXLTMFNALLDXXYQVLGNAKGAVAVVVSILIFRNPVTFMGMLGYGITVAGVVLYGEAKKRSKAGMFSFAVSAAAAAAAATTGQGWGIRRPDGLEPFPWVSASALVGAWSLLFLREGDNEEDRVLKLSDVWLIFPTVEAVEAPETTELKLSTELLGEMLGDTRLLLPPVGILFLDALAGILPIEAAVAAADDDNDDGKAPDFEVEQLLVEPSEVSKMVLLL

SEQ ID NO: 3269 - protein, 341 aa, Oryza sativa
  unsure (1)..(341): unsure at all Xaa locations
MGQQQQQENLTLLPMSSSSAAAAADAAAASSPAASAGRLFTAGLVASWYASNIGVLLLNKFLLSTYGFRYPVFLTACHMSACALLSYAAAAASAAAPRAARPRRSRGQLARVALLGAVFCASVVAGNVSLRYLPVSFNQAVGATTPFFTAVLAYAVAARREACATYAALIPVVAGVVIATGGEPSFHLFGFIMCIGATAARALKTVLQGILLSSEEEKLNPMELLGYMAPVAVVLLIPATFIMERNVLTMVTALAREDPSFIWILLCNSSLAYFVNLTNFLVTKHTSPLTLQVLGNAKGAVAVVVSILIFRNPVTFMGMLGYGITVAGVVLYGEAKKRSKX

SEQ ID NO: 3270 - protein, 507 aa, Oryza sativa
  unsure (1)..(507): unsure at all Xaa locations
XINPLGSTPQQGILINGQFPGPRIDCVTNDNIIVNVFNNLDEPFLLTWNGIKQRKNSWQDGVLGTNCPIPPGANYTYKFQAKDQIGTFVYFPSVAMHRAAGGFGALNVYQRPAIPVPYPPPAGDFTLLVGDWYKAGHKQLRQALDAGGGGALPPPDALLINGMPSAAAFVGDQGRTYLFRVSNVGVKTSVNVRIQGHSLRLVEVGGAHPVQNVYDSLDVHVGQSVAFLVTLDKAAQDYAVVASARFSPGASPLMATGTLHYSSAVSRAPGPLPAPPPEQAEWSMNQARSFRWNLTASAARPNPQGXSFHYGTIATSRTLVLANSAPVLAGQRRYAVNGVSFVVPDTPLKLVDNYNIANVIGWDSVPARPDGAAPRSGTPVVRLNLHEFIEVVFQNTENELQSWHLDGYDFWVVGYGNGQWTENQRTTYNLVDAQARHTVQVYPNGWSAILVSLDNQGMWNLRSANWDRQYLGQQLYMRVWTPQQSFSNEYSIPTNAILCGRAAGLGH

SEQ ID NO: 3271 - protein, 97 aa, Oryza sativa
  unsure (1)..(97): unsure at all Xaa locations
MDLEASHGKVSXTRRCHPAVPLGTMRHXGRALDQGGASSSPSPSTAVAAPVYAPTPRDRALRTPHSGYHYDGTARPFFEGWNFKVSIPECRQSFCFX

SEQ ID NO: 3272 - protein, 375 aa, Oryza sativa
MSSATDGAASRLGVAGALGMSVTSSVAIVICNKYLISTLGFFFATTLTSWHLMVTFCTLYVAQRLRFFEAKPIDAQTVISFGLLNGISIGLLNLCLGFNSVGFYQMTKLAIIPFTMLLETIFLSKKFSRSIKISLMVLLLGVGIASVTDLQLNLLGSIIAVLTIAATCVSQILTNQIQRRLKVSSTQLLYQSSPYQSAVLLVTGPFVDKLLTNRDVFAFTYTFQVVAFIVLSCSIAVCVNFSTFLVIGTTSPVTYQVLGHLKTCLILSFGYVLLRDPFTFRNVAGILVAIFGMGLYSFFSVSESRDKKLADGPSPPLPISSSQVHPPYMAEMKDSEPLLGGGGGAAAKSSPWNEVKGLQSFDEVPRTAKSAFSRP

SEQ ID NO: 3273 - protein, 1043 aa, Oryza sativa
MEASAGLVAGSHNRNELVLIRGHEEPKPLRALSGQVCEICGDEVGRTVDGDLFVACNECGFPVCRPCYEYERREGTQNCPQCKTRYKRLKGSPRVPGDEDEEDIDDLEHEFNIDDEKQKHSHITEAMLHGKMSYGRGPDDGDGNRLPPIITGARSVPVSGEFPISNSHGHGEFSSSLHKRIHPYPVSEPGSAKWDEKKEVSWKERMDDWKSKQGIVAGGAPDPDDYDADVPLNDEARQPLSRKVSIASSKVNPYRMVIILRLVVLGFFLRYRILHPVPDAIPLWLTSIICEIWFAVSWILDQFPKWYPIDRETYLDRLSLRYEREGEPSLLSAVDLFVSTVDPLKEPPLVTANTVLSILAVDYPVDKVSCYVSDDGASMLTFESLSETAEFARKWVPFCKKFSIEPRAPEFYFSQKVDYLKDKVHPNFVQERRAMKREYEEFKVRINALVAKAQKVPAEGWIMKDGTPWPGNNTRDHPGMIQVFLGHSGGHDTEGNELPRLVYVSREKRPGFQHHKKAGAMNALIRVSAVLTNAPFMLNLDCDHYINNSKAIREAMCFLMDPQVGRKVCYVQFPQRFDGIDVHDRYANRNTVFFDINMKGLDGIQGPVYVGTGCVFRRQALYGYNPPKGPKRPKMVTCDCCPCFGRKKRKHGKDGLPEAVAADGGMDSDKEMLMSQMNFEKRFGQSAAFVTSTLMEEGGVPPSSSPAALLKEAIHVISCGYEDKTDWGLELGWIYGSITEDILTGFKMHCRGWRSVYCMPKRAAFKGSAPINLSDRLNQVLRWALGSVEIFFSRHSPLLYGYKNGNLKWLERFSYINTTIYPFTSLPLLAYCTLPAVCLLTGKFIMPPISTFASLFFIALFISIFATGILEMRWSGVSIEEWWRNEQFWVIGGVSAHLFAVVQGLLKVLAGIDTNFTVTSKATGDEDDEFAELYAFKWTTLLIPPTTLLILNIIGVVAGVSDAINNGSEAWGPLFGKLFFAFWVIVHLYPFLKGLMGRQNRTPTIVVIWSVLLASIFSLLWVRIDPFTIKARGPDVRQCGINC

SEQ ID NO: 3274 - protein, 1217 aa, Oryza sativa
MICCVPSVTAEDASGRLPYKQCADSRKLDFLGRIISSVCVSHSSVLIYSSNQLERTSVLTKLILKQAQPDNNGSSCICSSSSSSQRTHAGLLSSPPSRQRATMQSKQATHNPFASLGGNGDAAPNQPATVSHTRRRLLDPSSPARARTNSHPSPLDPSHPPKPPLPYSPCHKRPQLVAGRCCAAMEASAGLVAGSHNRNELVLIRGHEEPKPLRALSGQVCEICGDEVGRTVDGDLFVACNECGFPVCRPCYEYERREGTQNCPQCKTRYKRLKGSPRVPGDEDEEDIDDLEHEFNIDDEKQKHSHITEAMLHGKMSYGRGPDDGDGNRLPPIITGARSVPVSGEFPISNSHGHGEFSSSLHKRIHPYPVSEPGSAKWDEKKEVSWKERMDDWKSKQGIVAGGAPDPDDYDADVPLNDEARQPLSRKVSIASSKVNPYRMVIILRLVVLGFFLRYRILHPVPDAIPLWLTSIICEIWFAVSWILDQFPKWYPIDRETYLDRLSLRYEREGEPSLLSAVDLFVSTVDPLKEPPLVTANTVLSILAVDYPVDKVSCYVSDDGASMLTFESLSETAEFARKWVPFCKKFSIEPRAPEFYFSQKVDYLKDKVHPNFVQERRAMKREYEEFKVRINALVAKAQKVPAEGWIMKDGTPWPGNNTRDHPGMIQVFLGHSGGHDTEGNELPRLVYVSREKRPGFQHHKKAGAMNALIRVSAVLTNAPFMLNLDCDHYINNSKAIREAMCFLMDPQVGRKVCYVQFPQRFDGIDVHDRYANRNTVFFDGPVYVGTGCVFRRQALYGYNPPKGPKRPKMVTCDCCPCFGRKKRKHGKDGLPEAVAADGGMDSDKEMLMSQMNFEKRFGQSAAFVTSTLMEEGGVPPSSSPAALLKEAIHVISCGYEDKTDWGLELGWIYGSITEDILTGFKMHCRGWRSVYCMPKRAAFKGSAPINLSDRLNQVLRWALGSVEIFFSRHSPLLYGYKNGNLKWLERFSYINTTIYPFTSLPLLAYCTLPAVCLLTGKFIMPPISTFASLFFIALFISIFATGILEMRWSGVSIEEWWRNEQFWVIGGVSAHLFAVVQGLLKVLAGIDTNFTVTSKATGDEDDEFAELYAFKWTTLLIPPTTLLILNIIGVVAGVSDAINNGSEAWGPLFGKLFFAFWVIVHLYPFLKGLMGRQNRTPTIVVIWSVLLASIFSLLWVRIDPFTIKARGPDVRQCGINC

SEQ ID NO: 3275 - protein, 165 aa, Oryza sativa
  unsure (1)..(165): unsure at all Xaa locations
LSSRSSNGASSGCSXAALAACILAVAATLAGADDPYRFFTWNVTYGSINPLGSTPQQGILINGQFPGPRIDCVTNDNIIVNVFNNLDEPFLLTWNGIKQRKNSWQDGVLGTNCPIPPGANYTYKFQAKDQIGTFVYFPSVAMHRAAGGFGALNVYQRPAIPVPYX

SEQ ID NO: 3276 - protein, 227 aa, Oryza sativa
MAARRPGSPAPRWAPWPLLAAAAVLLLLSAAPRTARALRFDLESGHTKCISDEIKVNSMVVGKYHVVGPDPNYPLPDSHRISLRVTSPYGNSVHYAENVPSGNFAFTATEAGDYLACFWAPDHKPPVSIGFEFDWRSGVAAKDWSNVAKKGQVDVMEMELKKLEETIKSIHEEMFYLREREEEMQNLNKQTNSRMAWLGFLSLGICLSVAGLQLWHLKTFFERKKLL

SEQ ID NO: 3277 - protein, 321 aa, Oryza sativa
  unsure (1)..(321): unsure at all Xaa locations
MEDQSLKPIRCKAAVCRAASEPLIVEEIVVDPPKAYEIRIKIICTSLCHTDVTLWHKVDPAFPRILGHEAYGVVESVGENVEGLAAGDTVVPTFMGQCDSCASCAAEWTNQCTAVPFTMGPGMRRDGTTRFWDGEGKPLSDTVAVTSFSQYTVVDVNQVVKVDPAVPPKIACLLGCCGGTGKEFGVTDFVNPSQLGDKSVSEVINAMTDGGADYSFECIGISSVMTEAGRGKTIILGVEKDSQPLCLPSFEFLFGKCVMGSLFGGAKPKTDIPILAEKCMNKELELEKLVTHEVGLTEINTAFDLLLQGKSLRCIIWMDKX

SEQ ID NO: 3278 - protein, 362 aa, Oryza sativa
  unsure (1)..(362): unsure at all Xaa locations
MEDQSLKPIRCKAAVCRAASEPLIVEEIVVDPPKAYEIRIKIICTSLCHTDVTLWHKVDPAFPRILGHEAYGVVESVGENVEGLAAGDTVVPTFMGQCDSCASCAAEWTNQCTAVPFXXMGPGMRRDGTTRFWDGEGKPLSDTVAVTSFSQYTVVDVNQVVKVDPAVPPKIACLLGCCGGTVQTQLRSGVGAAWRLAKVQPGSSVVVFGLGSVGLAVVQGAKMCGATKIIGVDLNPNKEEVGKEFGVTDFVNPSQLGDKSVSEVINAMTDGGADYSFECIGISSVMTEARRIFAAGIGKTIILGVEKDSQPLCLPSFEFLFGKCVMGSLFGKEPEMHHMDGQVTQLGVGMLFLFRFXIWLIX

SEQ ID NO: 3279 - protein, 429 aa, Oryza sativa
  unsure (1)..(429): unsure at all Xaa locations
AHPLQRYTIHLQRSDLHSSLVLLLLLLNSSRRYMIDTYRRRRCXAAVCRAASEPLIVEEIVVDPPKAYEIRIKIICTSLCHTDVTLWHKVYVRYPAFPRILGHEAYGVVESVGENVEGLAAGDTVVPTFMGQCDSCASCAAEWTNQCTAVPFTMGPGMRRDGTTRFWDGEGKPLSDTVAVTSFSQYTVVDVNQVVKVDPAVPPKIACLLGCCGGTGVGAAWRLAKVQPGSSVVVFGLGSVGLAVVQGAKMCGATKIIGVDLNPNKEEVGKEFGVTDFVNPSQLGDKSVSEVINAMTDGGADYSFECIGISSVMTEAVRSTKSGRGKTIILGVEKDSQPLCLPSFEFLFGKCVMGSLFGGAKPKTDIPILAEKCMNKELELEKLVTHEVGLTEINTAFDLLLQGKSLRCIIWMDKXWPQLGVGMLFLFRF

SEQ ID NO: 3280 - protein, 659 aa, Oryza sativa
  unsure (1)..(659): unsure at all Xaa locations
TALCDSTQEVRESAGLAFSTLXYKSAGLQAIDEIVPTLLRALEDDETSATALDGLKQILSVRTAAVLPHILPKLVQPPLSSFNAHALGALAEVAGPGLNSHIGTVLPALILAMDDEDADVQNSARKAAETVVLVIDEEGIETLIPELLKGVNDSQASMRRGSAYLIGFLFKNSKLYLADEAPDIMSTLITLLSDTDKATVSACFWKLAELLAPVPREQLXPTHIKXLVRDAVSTARDKERRRRKGVPILVPGLCLPKALQPFLPIFQQGLISGSAETKEQAAEGLGELIDVTSEKTLKGAPGPRTRPLVRILGDRFPWQVKSAILSTLTIIISKGGLALKPFLPQLQTTFVKCLQDNNRSVRTRAASALGKLSALSTRVDPLVSDLLSMLQSGDDAVKESVLSALKGVVRHAGKSVSPVVRSRGCDLLKDLLQADADDVRSSAAKAIGTLCQYMEENETSDLVQTLLNMGTLPDWCTRHGALLTFCSISMHCSSKLCRSMSFPSIVDLLKDSLKDDKFPVREASTKTLGRLLCYQLQSEASTXXQLIQLLALALRDDSSEVRRRSLSRLKAAAKINNPALATHLSILGPAIAEALKDTNTPVRVAAERCALHVFQLTKGADNVTIAQKHLNMTGLEVRKIAKLPEESDGSESSDDDKRK

SEQ ID NO: 3281 - protein, 608 aa, Oryza sativa
  unsure (1)..(608): unsure at all Xaa locations
MSRSVQLAVAAGDQVDPDSLRLHQLGYKQELKRGLSALSNFAFSFANISVMMGVTTTYNTGLRYGGPVSMTLGWLVVAVFNCCVALSMAEICSAYPTSGGLYYWSAKLAGKQWASLASWVTGWFNVVGQWAAIASVDFSLAQLLQVIILLSTGGGNGGGYMASKYTVLAIYAFILILHGIINSLPIEWLSLFGHVGAIWNAAGIFVLTILIPAVAKDRPNIEFVFTHLNTENGMGIHDKAYILAVGLLMSQYSVIGYDTSAHMVEETKNADRSGPIGIITSVLFATVFGWIYLLALTSVVTDIPYLLSPSNDAGGYAIAQALYTAFHRRYGSGVGGIVCLGAVAVAVFLCGIACVTSNSRMAYAFSRDGAMPLSRVWYRVNKHEVPLNVVWLGVAVAFVMALTSLGSQVAFQAMGSIATLGMYIAYALPVFFRVTTARRSFVPGPFHLGRYGVVVGWAGVVWVATVTVLFSLPVAYPVANKETFNYTPVAVGGVLLLSVXAVRPSFYCRPLLSPRPEGAAGGGYTRVRDGGFFPSRLQRLRVWRRVRILHHRRRLLPARRRPRPLRLRLPRRPAVCASLPSLHASSRSLLRSPPEICRPCQPLRRGLL

SEQ ID NO: 3282 - protein, 743 aa, Oryza sativa
  unsure (1)..(743): unsure at all Xaa locations
XSRLIARYXXDGEDTGFAPVDLLIYTGDALGESSLITEHTELLLLAGGYGAEMIXGHASDDGSAMLTFESLVETAXFARRWVPFCKKYSIEARAPEFYFXQKIDYLKDKIHPSFVKERRAMKRDYEEYKVRINALVAKAQKTPEEGWIMQDGTPWPGNNPRDHPGMIQVFLGETGARDFDGNELPRLVYVSREKRPGYQHHKKAGAMNALVRVSAVLTNAPYILNLDCDHYVNNSKAVREAMCFMMDPSVGRDVCYVQFPQRFDGIDRSDRYANRNVVFFDVNMKGLDGLQGPVYVGTGCCFYRQALYGYGPPSLPALPKSSVCSWCCCCCPKKKAEKSEKEMHRDSRREDLESAIFNLREIDNYDEYERSMLISQMSFEKSFGLSSVFIESTLMENGGVPESANPSTLIKEAIHVISCGYEEKTEWGKEIGWIYGSVTEDILTGFKMHCRGWRSIYCMPIRPAFKGSAPINLSDRLHQVLRWALGSVEIFLSRHCPLWYGYGGGRLKWLQRLSYINTIVYPFTSLPLIAYCCLPAICLLTGKFIIPTLSNAATIWFLGLFISIIVTSVLELRWSGIGIEDWWRNEQFWVIGGVSAHLFAVFQGILKMIAGLDTNFTVTAKATDDTEFGELYVFKWTTVLIPPTSILVLNLVGVVAGFSDALNSGYESWGPLFGKVFFAMWVIMHLYPFLKGLMGRQNRTPTIVVLWSVLLASVFSLLWVKIDPFIGSSXXTTTTNSCANFDC

SEQ ID NO: 3283 - protein, 455 aa, Oryza sativa
  unsure (1)..(455): unsure at all Xaa locations
LRSLARSSSSSSSGPLSSEMGAKDSKPSYSYSSSYDHGNSSSGYNSRYPAYPANASSSQNTXXYAPSMENYVQPETHARLQRKYSRIGDDYRSLNQVTEALAQAGLESSNLIVGIDFTKSNEWTGKLSFNRRCLHDIGNTPNPYEQAISIIGRTLSAFDEDNLIPCFGFGDASTHDQEVFSFYPENRPCNGFEEALERYREIVPTLRLAGPTSFAPMIETAIGIVDSTGGQYHVLLIIADGQVTRTRHTQSGQLSPQERDTIDAIVKASQFPLSIVLVGVGDGPWDMMHQFDDNIPARSFDNFQFVNFTDIMSKSIAADRKEAEFALSALMEIPTQYKATLDLQLLGRRQRIQPRIPLPPPMRNAYSRSTSFDQHSGVYSRSSSFGPQTTCGYHXXPDTYTSESSLEGRLLCAICMDKSKDLAFGCGHQTCYECGKNLVRCPMCQQHITTRIRLY

SEQ ID NO: 3284 - protein, 116 aa, Oryza sativa
  unsure (1)..(116): unsure at all Xaa locations
LGKGFIRVRKPYTITKQREKWTEEEHDKFLEALKLYGRSWRQIQEHIGTKTAVQIRSHAQKFFSKVIXXSFMYQLIPGSNNAIEIPPPRPKRKPLHPYPRKCANSGSDANPATAQL

SEQ ID NO: 3285 - protein, 179 aa, Oryza sativa
  unsure (1)..(179): unsure at all Xaa locations
MGELGSGPPLEXEGESMLQELFPSCAVLPXVVRLIPHLHANGVPMAVXTGSHKRHFALKTQNHKEMFTLMHHVVMGDDPDVKTGKPSPDIFLAAMRRFEGNIEPSNCLVFEDAPSGVAAAKNAGMYAVMVPDSRLDVSYHKGADQVLSSLLDFKPGEWGLPPFTDXTKKFEDWEVPMNK

SEQ ID NO: 3286 - protein, 808 aa, Oryza sativa
MAAKLARLHSLRERLGATFSSHPNELIALFSRYVNQGKGMLQRHQLLAEFDALIEADKEKYAPFEDILRAAQEAIVLPPWVALAIRPRPGVWDYIRVNVSELAVEELSVSEYLAFKEQLVDGHTNSNFVLELDFEPFNASFPRPSMSKSIGNGVQFLNRHLSSKLFQDKESLYPLLNFLKAHNHKGTTMMLNDRIQSLRGLQSSLRKAEEYLMGIPQDTPYSEFNHRFQELGLEKGWGDCAKRVLDTIHLLLDLLEAPDPANLEKFLGTIPMMFNVVILSPHGYFAQSNVLGYPDTGGQVVYILDQVRALENEMLLRIKQQGLDITPKILIVTRLLPDAVGTTCGQRVEKVIGTEHTDILRVPFRSENGILRKWISRFDVWPFLETYTEDVANEIMREMQAKPDLIIGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSPGADMSVYFPYTEADKRLTAFHPEIEELLYSEVENDEHKFVLKDKNKPIIFSMARLDRVKNMTGLVEMYGKNAHLRDLANLVIVCGDHGNQSKDREEQAEFKKMYGLIDQYKLKGHIRWISAQMNRVRNGELYRYICDTKGVFVQPAFYEAFGLTVIEAMTCGLPTIATCHGGPAEIIVDGVSGLHIDPYHSDKAADILVNFFEKCKQDSTYWDNISQGGLQRIYEKYTWKLYSERLMTLTGVYGFWKYVSNLERRETRRYIEMFYALKYRSLASAVPLAVDGESTSK

SEQ ID NO: 3287 - protein, 382 aa, Oryza sativa
MAEQANQPTVLQKFGGQFHLGSSFSEGVRARNICPSVSSYDRRFTTRSYMTQGLVNGGINVPMMSSSPIFANAPAEKGGKNFMIDFLMGGVSAAVSKTAAAPIERVKLLIQNQDEMIKAGRLSEPYKGIGDCFGRTIKDEGFASLWRGNTANVIRYFPTQALNFAFKDYFKRLFNFKKDKDGYWKWFGGNLASGGAAGASSLFFVYSLDYARTRLANDAKAAKGGGERQFNGLVDVYRKTLKSDGIAGLYRGFNISCVGIIVYRGLYFGMYDSLKPVVLTGSLQDNFFASFALGWLITNGAGLASYPIDTVRRRMMMTSGEAVKYKSSMDAFSQILKNEGAKSLFKGAGANILRAIAGAGVLSGYDQLQILFFGKKYGSGGA

SEQ ID NO: 3288 - protein, 360 aa, Oryza sativa
  unsure (1)..(360): unsure at all Xaa locations
MEQGGEAGTGGGLGNLRALLAILQWWGFNVTVIIINKWIFQKLDFKFPLTVSCVHFICSSIGAYIAIHVLKAKPLIQVEPEDRWRRIFPMSFVFCINIVLGNVSLRYIPVSFMQTIKSFTPATTVILQWLVWSKHFEWRIWASLVPIVGGILLTSITELSFNMFGFCAAMVGCLATSTKTILAESLLHGYKFDSINTVYYMAPFATMILALPAVLLEGGGVVTWFYTHDSIASALVIIIGSGVLAFCLNFSIFYVIHSTTAVTFNVAGNLKVAVAVLVSWLIFRNPISPMNAIGCAITLVGCTFYGYVRHLIPQQQAVAPGTGSPTTSQTNSPRSRMEMLPLVGDKQEKVXQKNTLCTMQ

SEQ ID NO: 3289 - protein, 304 aa, Oryza sativa; identical to SEQ ID NO: 773

SEQ ID NO: 3290 - protein, 178 aa, Oryza sativa
  unsure (1)..(178): unsure at all Xaa locations
RRKSLQIPPEFRSISPSRFPEMDVGVGGKAAKKAVGRKLGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPVLLPKKTAEKAXXKPAKASKDKAAKSPKKQARS

SEQ ID NO: 3291 - protein, 359 aa, Oryza sativa
  unsure (1)..(359): unsure at all Xaa locations
MAHDEAVATQKIGKTTSPPKDQPTPCPFPDWSAVQAYYGPGVLPPTYFAPAIASGHAPPPYMWGPQPIMPPPFGTPYAAMYPHGGAYPHPLMPMMANPLSMEPAKSASSKEKGSNKKLKEVDGAAVSTGSGDSKKTMTSSGDYSAEGSSDVNDQKNSGXQLKSLPGAETSAAAKMENALPPSHILGSTAILPNHSFPAQVIRPSATNVANSRALGTPISPPPGXXDERELKREKRKQSNRESARRSRLRKQAETEDLATQVESLTAENTSLRSEISRLSESSEKLRLENSALMGKLKDPAASTPSLQKTTTASSPRVVENFLSMIDNTNKTSVRHTEHAEPKLRQLLGSGPATDVVAAS

SEQ ID NO: 3292 - protein, 378 aa, Oryza sativa
  unsure (1)..(378): unsure at all Xaa locations
MAHDEAVATQKIGKTTSPPKDQPTPCPFPDWSAVQAYYGPGVLPPTYFAPAIASGHAPPPYMWGPQPIMPPPFGTPYAAMYPHGGAYPHPLMPMMANPLSMEPAKSASSKEKGSNKKLKEVDGAAVSTGSGDSKKTMTSSGDYSAEGSSDVNDLKVGKTGRKRRLDDGAGAETSAAAKMENALPPSHILGSTAILPNHSFPAQVIRPSATNVANSRAXGTPISPPTGVMXPSHTGVSTELLIKDERELKREKRKQSNRESXARRSRLRKQAETEDLATQVESLAAEPTSLRSEISRLSESSEKLRLENSALMGKLKDPAASTPSLQKTTTASSPRVVENFLSMIDNTNKTSVRHTEHAEPKLRQLLGSGPATDVVAAS

SEQ ID NO: 3293 - protein, 344 aa, Oryza sativa
GLQGSSLPCSGGIHPRILAARLLQQHRAGSSSRSDGRFVRWFPFLMTRACCEACANLKAAFLVAVVFLGLSTAVTMVFAREVALDPVAAAKRNEGEASGLLAVFKGMKNLPVGMPSVLIVTGLTWLSWFPFILFDTDWMGREIYHGRPDGSPAEVTAFQEGVRQGAFGLLLNSIVLGISSFLIEPMCRRLGARAVWVMSSAVVCVAMAAVSVLSAWSLGDFGGSVQDAARAPAEEGGVRASALALFVFLGLPFAVLCSVPFAVTAQLAASRGGGQGLCTGVLNISIVVPQMAIALGAGPWDELFGEGNIPAFAMASVFAAAAAAAGVVLLPKVSVRSVSMAGGH

SEQ ID NO: 3294 - protein, 127 aa, Oryza sativa
  unsure (1)..(127): unsure at all Xaa locations
XYQRESEFYKVEAILRPWRVPYVSSVSIVCVTAVNRVLPALELLGSEFAEDTFIDKVKMEIVVSKDQVEAVVDKIIEKARTGEIGDGKIFLIPVSDVIRIRTGERGERAERMAGGLADKLSSAMPIS

SEQ ID NO: 3295 - protein, 221 aa, Oryza sativa
  unsure (1)..(221): unsure at all Xaa locations
MMKKCPSELQLEAFIREEAGAGDRKPGVLSPGDGAXSTLDGSGGGHQLWWPESVRTPPRAAAAFXATADERTPASISDDPKPTTSANHAPESDSDSDCDSLLEAERSPRLRGTKSTETKRIRRMVSNRESARRSRRRKQAQLSELESQVEQLKGENSSLFKQLTESSQQFNTAVTDNRILKSDVEALRVKVKMAEDMVARAAMSCGLGQLGLAPLLSSRKX

SEQ ID NO: 3296 - protein, 406 aa, Oryza sativa
MPTRLHARPASPSAAAASSAREINAGPVSPATSPPTPPPHPAWPGSNNQRTRLAGPPAHPRPPTGSLADSDDDIAFAAFTVWAPHVGATGGHARLRWIRPRRALHGGRRKAMMKKCPSELQLEAFIREEAGAGDRKPGVLSPGDGARKSGLFSPGDGEMSVLDQSTLDGSGGGHQLWWPESVRTPPRAAAAFSATADERTPASISDDPKPTTSANHAPESDSDSDCDSLLEAERSPRLRGTKSTETKRIRRMVSNRESARRSRRRKQAQLSELESQVEQLKGENSSLFKQLTESSQQFNTAVTDNRILKSDVEALRVKVKMAEDMVARAAMSCGLGQLGLAPLLSSRKMCQALDMLSLPRNDACGFKGLNLGRQVQNSPVQSAASLESLDNRISSEVTSCSADVWP

SEQ ID NO: 3297 - protein, 128 aa, Oryza sativa
IISSLFSGRIVWEKVSPALQRAVQSQMSLLSTPFIDTNDLFETGNTGGMSRDLINRIPKTTFSAATNPDQETDTCCAVCLQDFGASQFVRVLPHCQHTFHARCIDNWLFRHASCPLCRAGVHIDHIHM

SEQ ID NO: 3298 - protein, 692 aa, Oryza sativa
MAVAVAAAAAVSRQWTRVRTLGRGASGAEVFLAADDASGELFAVKSVGAAGAAALRREQGVMAGLSSPHVVPCIGGRVGRDGSYQMFLEFAPGGSLADVAARCGGRMEECAVGEYAVDVARGLAYLHGMGLVHGDVKARNVVIGGDGRAKLADFGCARWADSGRPIGGTPAFMAPEVARGEEQSPAADVWALGCTVIEMATGRAPWSDMDDVLAAVHRIGYTEAVPEVPGWLSADAKDFLARCLQRRPIDRSTAAQLLEHPFVASAAGDGKPEAAKSKWVSPKSTLDAALWESDTDEEEDDELSQSTAERIGSLACAASSLPDWDSDDGWIDVISTPTEESCETTTSPADEETTTDLNGDIRTAEFELPHIDVDSGNGNTTHNVGEANAQHIISPSNLVFDQHRQQHMGPCPFSKGERERADGERRTRGRTEEKELTKGAHFTISVASYYCERACVRASLRLLPPVGIRHGNGICYYCQLRCDGVTVRFVIRPPVVFFLSLSTCNSPRRGLLLDPVVRFWMAFSDVCKTAKRLRVDFIISRRDDTTRTGRRRPFYHKSERFERKSYARHFWRSQRHPRITHTSIEIARFGFGRRLRKRVNTIPVATASRTTLKAVDAITPSSWAPGPQCHFPRTGTAAPRRSTNGAARSIDRSSEGILKVRRDLPDHRMCISIAVLAAQLKPAHGIGVIMTD

SEQ ID NO: 3299 - protein, 318 aa, Oryza sativa
  unsure (1)..(318): unsure at all Xaa locations
XWARPCDGCXAAPSVVYCRADAAYLCASCDARVHAANRVASRHERVRVCEACERAPAALACRADAAALCVACDVQVHSANPLPAITIPATSVLAEAVVATATVLGDKDEEVDSWLLLSKDSDNNNNNNNNNDNDNNDNNNSNSSNNGMYFGEVDEYFDLVGYNSYYDNRIENNQDRQYGMHEQQEQQQQQQEMQKEFAEKEGSECVVPSQITMLSEQQHSGYGVVGADQAASMTAGVSAYTDSISNSMSLHFSSMDREARVLRYREKKKARKFEKTIRYETRKAYAEARPRIKGRFAKRSDVQIEVDQMFSTAALSDX

SEQ ID NO: 3300 - protein, 346 aa, Oryza sativa
  unsure (1)..(346): unsure at all Xaa locations
XGEGGGGGEGSGCPWARPCDGCXAAPSVVYCRADAAYLCASCDARVHAANRVASRHERVRVCEACERAPAALACRADAAALCVACDVQVHSANPLPAITIPATSVLAEAVVATATVLGDKDEEVDSWLLNNDNNNSNSSNNGMYFGEVDEYFDLVGYNSYYDNRIENNQDRQYGXXKEGSECVVPSQITMLSEQQHSGYGVVGADQAASMTAGVSAYTDSISNSVSSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 3301 - protein, 342 aa, Oryza sativa
MNYNFGGNVFDQEVGVGGEGGGGGEGSGCPWARPCDGCRAAPSVVYCRADAAYLCASCDARVHAANRVASRHERVRVCEACEQAPAALACRADAAALCVACDVQVHSANPLARRHQRVPVAPLPAITIPATSVLAEAVVATATVLGGKDEEVDSWIILSKDSNNNNNNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSISLINGGGYSTRQHGDRYAKFQHPDTCWSNQSLLRSLASDVPSLQLHGQGGQGAQVQGEEEGQEV

SEQ ID NO: 3302 - protein, 407 aa, Oryza sativa
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVYSANPLARRHQRVPVAPLPAITIPATSVLAEAVVATATVLGDKDEEVDSWLLLSKDSDNNNNNNNNNDNDNNDNNNSNSSNNGMYFGEVDEYFDLVGYNSYYDNRIENNQDRQYGMHEQQEQQQQQQEMQKEFAEKEGSECVVPSQITMLSEQQHSGYGVVGADQAASMTAGVSAYTDSISNSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 3303 - protein, 395 aa, Oryza sativa
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVHSANPLPAITIPATSVLAEAVVATATVLGDKDEEVDSWLLLSKDSDNNNNNNNNNDNDNNDNNNSNSSNNGMYFGEVDEYFDLVGYNSYYDNRIENNQDRQYGMHEQQEQQQQQQEMQKEFAEKEGSECVVPSQITMLSEQQHSGYGVVGADQAASMTAGVSAYTDSISNSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 3304 - protein, 174 aa, Oryza sativa
  unsure (1)..(174): unsure at all Xaa locations
MGGCCCSSTRSASVGAPVYIYHQQNPASTIVAIDKNLDTSTPDTYRAPPTPLPYDVGLVLKDNPDLEKTGIKRKIHEHKESLMMDDNESLQKCVSEDKPDEEDVCPICLEEYDEENPRSMTKCEHHFHLCCILEWMERSETCPVCDQITMINAIKLLNTSLPISYKKKKKKXXR

SEQ ID NO: 3305 - protein, 103 aa, Oryza sativa
  unsure (1)..(103): unsure at all Xaa locations
XHXRCSNVRRMALSALNGAAHDNFLAIMVQAAIVGTASADCMNDGSTPVRLAAERYAMHSLQMAQVTENVQAXYKYITGLDARQLAKYPEESDGQDSVDNASG

SEQ ID NO: 3306 - protein, 81 aa, Oryza sativa
  unsure (1)..(81): unsure at all Xaa locations
XKALKFAQGVVGXVADKGSVLRFIPLSMQAVKQGFQDLGASSLQSAHELLRSETIKLEVRTGAAQVEGGIHGLVSYEKKAF

SEQ ID NO: 3307 - protein, 886 aa, Oryza sativa
MSMVNWALEILNQDRNQSVLKDYLTFHCFIHIAHLYICLQVDIAAGGWHSTALTKEGEVYAWGRGEHGRLGFGDDKSSHMVPQKVELLAGEDIIQVSCGGTHSVALTRDGRMFSYGRGDHGRLGYGRKVTTGHPMEVPIDLPPPGTSGGDSGGQWQASPYPTPTTSCPWSIWAAKLRSDGAYRVCFVHTARASESHSRRSDLAGDAVAATPPPCASSSALLNPLAAFARSVTLTPASTEGRVGSGGCRDGRDGRRRGAAGVSLPSDCCPPSSYAPPPAHSPREDDALPSLRSQCICVVYVVDNSKTQATKPRSKSISSAESVQAMRSSEESSSDEDDEILSELKEKWDAIENKSSVLFYGGGAIIAVWLSSIVVKAVDSVPVLPNILELVGLGYSGWFVYRYLLFKLHPKSIPFVFILEKSYTPTTYHLNVKYDLVQLTVARPTCHHTKKRVSHELGGGRVYPPPTARTEANQTRQLYPPLTRGPRRDPSPTCHPLSSLARRTRGATPLAPVPSLPAIKAPVFPTPPLRRTKSIRIHETTRTRPASPPPPPKENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTGGSGRISSSHCFAFGASVVVLRCRSCPRKVDAQVPNSESTHKKKKWAHLVPCDMNNVPYIYNLLSYWKKPDRRFNRKKPEPEIFVVRFKTLNRTGHARDSL

SEQ ID NO: 3308 - protein, 256 aa, Oryza sativa
MSREENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTEDGGDEVKEASKGDACEGQ

SEQ ID NO: 3309 - protein, 556 aa, Oryza sativa
  unsure (1)..(556): unsure at all Xaa locations
PAAPISLCRAPPNVTARARXPQVRCGPLAPPSPTTRVAMVPSPSSSSPPRAPRAPRSTSATPPPPPPPPAPSASGKEERFDWLDQWYPVAPVCDLDPGAPHGKTVLGLRIVAWFDRTTAAADGGGGEWRVFDDSCPHRLAPLSEGRVDDKGRLQCVYHGWCFDGRGACQFIPQAPALGPAVLSSSSSSSSPLLHLKSIKINRGQVHKNSKACVASYPCVVQNNILWFYPRSEPEYKEILQRKRPPYIPQIDDPSFVTVYGVRDLPYGYCLAASLIQNIHLLYTVEFDKEGGGPLKMEIEETNVEGFLSMLDRGFFKFVAPCTFYGSPLQTPSQAXXFKLIEPSYKISIKQPTVMLVFLCIPVSPGRSRLVWAFPRNVGVWMDKIIPRWYYHIGQNAILDSDIYLLHIEERNFATVGLDNWQKACYVPTSSDNMIITFRNWFRKYCKHQIGWATPITNQLPPTPSKDQLLDRYWSHVMQCTSCSGALKKMKALEVALQVASVAVVGFLAVAKGTVVTSVVQRSAVVAAAVLCFAASRWLANFIEKNFYFQDYVHAYK

SEQ ID NO: 3310 - protein, 132 aa, Oryza sativa
MHADVVARRIENLENMCDERARMLQDQFNKTFEDFTARTTFERPLMSGVAYALKVLHSERELFEQKLGWKIKKMETEDQSLVHDYNPEKLQPSPVQDEYAPVIFSQETVKHIISVDMMSGKNSLSNVLLHRL

SEQ ID NO: 3311 - protein, 189 aa, Oryza sativa
  unsure (1)..(189): unsure at all Xaa locations
TPSVKISRKWSKRALLLGVLVGLCSSVWIFSSMHADVVARRIENLENMCDERARMLQDQFNVSMNHVHALAILVSTFHHGKNPSAIDQKTFEDFTARTTFERPLMSGVAYALKVLHSERELFEQKLGWKIKKMETEDQSLVHDYNPEKLQPSPVQDEYAPVIFSQETVKHIISVDMMSGKRDAHNHYIX

SEQ ID NO: 3312 - protein, 161 aa, Oryza sativa
MAAPDVDYRCFVGGLAWATDNRSLEAAFSTYGEILESKIINDRETGRSRGFGFVTFSSEQAMRDAIEGMNGKELDGRNITVNEAQSRRSGGGGGGGYGQRGGGGGYGGGGYGGGGGGGGYGQRREGGYGGGGGYGGGRGGGGYGGGYGSRGGGNSDGNWRN

SEQ ID NO: 3313 - protein, 263 aa, Oryza sativa
DAWADAWADAWADAWGPARAARLSILLSLSLECEKSSPFSAPPFLLCTSPLLSWSSPSCVLCSSLKKPSDLWFLAFLSFLNTAVQMASLTPEAEAPGGGALLAAGDDVTAANLLAAAVATEGPVFDMPDFKMGGKKSDDAAPTDAGDEDGGDDDGDEDGDFGEGEEDVSEGEGYDNPKGIDNNKKRGEPEENGEEDEEEPEGQEGGGGDDDDDDDDDNEDDDDDDDGGEDDDGVDEEEEDQDNEDDEEDDDEDSLQPPKKRKK

SEQ ID NO: 3314 - protein, 244 aa, Oryza sativa
MDGVLLTGPCHVDPTCSSLREIKKYPKTKTIRSSSLTPPPTSRRPPLPVHESRDSRPPPSFRFLNRPPPLEEEMAAAAAVCGTERVAEVSASASAAAFVAFSAAAAERFLAVLALAMEAVNGGADIFNEDQHAIYKLLGRIKSESTPENKDGSDDDDDDDEDDDEDDEGGDDDDAEEDFSGDEGGEDEDDDDDDPEANGDGGSDDEDDDDDDGGDEDGEDDDDEDDDDEEDDDDEDQPPSKKKK

SEQ ID NO: 3315 - protein, 460 aa, Oryza sativa
  unsure (1)..(460): unsure at all Xaa locations
XSXLLACSFPNLKSLVLVGCQGFSTDGLATVATNCRFMKELDLQESLVEDRDSRWLGCFPKPSTLLESLNFSCLTGEVNSPALEILVARSPNLRSLRLNRSVPLDVLARILCRRPRLVDLCTGSFVRGNIVGAYAGLFNSFQHCSLLKSLSGFWDATSLFIPVIAPVCKNLTCLNLSSAPMVRSAYLIEFICQCKKLQQLWVLDHIGDEGLKIIASSCIQLQELRVFPANANARXXSTVTEEGLVAISAGCKXKLQSVLYFCQRMTNSALITVAKNCPRFTSFRLCVLDPGSADAVTGQPLEEGFGAIVQSCKGLRRLCLSGLLTDTVFLYIGMYAERLEMLSVAFAGDTDDGMTYVLNGCKNLKKLEIRDSPFGDSALLAGMHQYEAMRSLWLSSCNVTLGGCKSLAASMANLNIEVMNRAASINEADNANDAKKVKKLYIYRTVAGPRGDAPEFISTF

SEQ ID NO: 3316 - protein, 446 aa, Oryza sativa
MAARPEVVSALSPPAGGGAMGGVRYHRCCPPRAHLWRKGDHLPLHHAKIPARCSEIKVHTVLQASDALSSTREWSRSHLVTMTGLVACAVLVVPSADAVDALKTCTCLLKECRIELAKCIANPSCAANVACLNTCNNRPDETECQIKCGDLFENTVVDEFNECAVSRKKCVPQKSDVGEFPVPDPSALVKNFNMADFNGKWYISSGLNPTFDTFDCQLHEFRVEGDKLIANLTWRIRTPDSGFFTRTAIQRFVQDPAQPAILYNHDNEFLHYQDDWYIISSKVENKEDDYIFVYYRGRNDAWDGYGGAVLYTRSKVVPESIVPELERAAKSVGRDFSTFIRTDNTCGPEPPLVERIEKTVEQGEKTIIREVQEIEGEIEGEVKELEEEEVTLFKRLTDGLMEVKQDLMNFFQGLSKEEMELLDQMNMEATEVEKVFSRALPIRKLR

SEQ ID NO: 3317 - protein, 446 aa, Oryza sativa
MAARPEVVSALSPPAGGGAMGGVRYHRCCPPRAYLWRKGDHLPLHHAKISARCSEIKAHTVLQGSDALSSIREWSRSHLVTMTGLVACAVLVVPSADAVDALKTCTCLLKECRIELAKCIANPSCAANVACLNTCNNRPDETECQIKCGDLFENTVVDEFNECAVSRKKCVPQKSDVGEFPVPDPSALVKNFNMADFNGKWYISSGLNPTFDTFDCQLHEFRVEGDKLIANLTWRIRTPDSGFFTRTAIQRFVQDPAQPAILYNHDNEFLHYQDDWYIISSKVENKEDDYIFVYYRGRNDAWDGYGGAVLYTRSKVVPESIVPELERAAKSVGRDFSTFIRTDNTCGPEPPLVERIEKTVEQGEKTIIREVQEIEGEIEGEVKELEEEEVTLFKRLTDGLMEVKQDLMNFFQGLSKEEMELLDQMNMEATEVEKVFSRALPIRKLR

SEQ ID NO: 3318 - protein, 86 aa, Oryza sativa
  unsure (1)..(86): unsure at all Xaa locations
FEHHHRQGDTSYAQMFTDVGVYYAPGAVLXRGEGFNXALDVHKFEQLLVXNHXLPPQYXVXSXVNGKDFWRXFDASHXXXHXRQKX

SEQ ID NO: 3319 - protein, 732 aa, Oryza sativa
MATHERKTIDLEQGWEFMQKGITKLKNILEGKPEPQFSSEDYMMLYTTIYNMCTQKPPHDYSQQLYEKYRESFEEYITSMVLPSLREKHDEFMLRELVKRWSNHKVMVRWLSRFFHYLDRYFISRRSLPQLSEVGLSCFRDLVYQEIKGKVKSAVISLIDQEREGEQIDRALLKNVLDIFVEIGLTSMDYYENDFEDFLLKDTADYYSIKAQTWILEDSCPDYMLKAEECLKREKERVAHYLHSSSEQKLLEKVQHELLTQYASQLLEKEHSGCHALLRDDKVDDLSRMYRLFSRITRGLEPVSQIFKQHVTNEGTALVKQAEDAASNKKVFVRKIIELHDKYVAYVTDCFQGHTLFHKALKEAFEVFCNKGVSGSSSAELLATFCDNILKKGGSEKLSDEAIEDTLEKVVRLLAYISDKDLFAEFYRKKLARRLLFDKSANDEHERSILTKLKQQCGGQFTSKMEGMVTDLTVARDHQAKFEEFISTHSELNPGIALAVTVLTTGFWPSYKSFDINLPAEMVKCVEVFKEFYQTRTKHRKLTWIYSLGTCNINAKFEAKTIELIVTTYQAALLLLFNGVDRLSYSEIVTQLNLSDDDVVRLLHSLSCAKYKILSKEPNNRSISPNDVFEFNSKFTDKLRRLKIPLPPVDEKKKVVEDVDKDRRYAIDASIVRIMKSRKVLGHQQLVMECVEQLGRMFKPDFKAIKKRIEDLITRDYLERDKDNPNVYRYLA

SEQ ID NO: 3320 - protein, 159 aa, Oryza sativa
  unsure (1)..(159): unsure at all Xaa locations
XVYIYHQQXPASTIVAIXKNLDTSTPDTYRAPPTPLPYDVGLVLKDNPDLEKTGIKRKIHEHKESLMMDDNESLQKCVSEDKPDEEDVCPICLEEYDEENPRSMTKCEHHFHLCCILEWMERSETCPVCDQPXVALVDPLLKLMLIQSVWQKSFDGEAQ

SEQ ID NO: 3321 - protein, 158 aa, Oryza sativa
  unsure (1)..(158): unsure at all Xaa locations
MKGVKSKGAIKSDAMLCVKSKGVDNAAAKGRKGKAGKDPNXFKRAPSAFFDFMEEFRKEFQENNPMNKSVAGVGKTTGDRSKSLIEVHKAPYVSMANKXLKAEYNXAIAAYDKGESTARRYPTKYDRIDHEEESDKLKSEVIDEYDDEVSAXVVDYDE

SEQ ID NO: 3322 - protein, 598 aa, Oryza sativa
  unsure (1)..(598): unsure at all Xaa locations
MAVMTDVSTTGTALRTPAAGAVKEGDVEKLRFIDEMTTNVDAVQERVLGEILGRNAGTEYLTKCGLDGATDRAAFRAKVPVVSYDDLQPYIQRIANGDRSPILSTHPVSEFLTSSGTSAGERKLMPTIMDELGRRQLLYSLLMPVMNLYVPGLDKGKGLYFLFVKSETKTPGGLTARPVLTSYYKSDHFKNRPYDPYHNYTSPTAAILCADAFQSMYAQMVCGLCQRNDVLRLGAVFASGLLRAIRFLQLNWEQLADDIESGELTPRVTDPSVREAVAAILLPDPELAKLIRAECSKGDWAGIITRVWPNTKYLDVIVTGAMAQYIPTLEFYSGGLPMACTMYASSECYFGLNLRPMCDPSEVSYTIMPNMGYFEFLPVDESAASGDATQLVDLARVEVGREYELVITTYAGLNRYRVGDVXLRVTXFRFVRRKNVLLSIESDKTDEAELQRAVERASALLRPHGASVVEYTSQACTKRIPGHYVIYWELLTKGAGATVVDADTLGRCCLEMEEALNTVYRQSRVADGSIGPLEIRVVRPGTFEELMDYAISRGASINQYKVPRCVTFPPIVELLDSRVVSSHFSPALPHWTPARRSE

SEQ ID NO: 3323 - protein, 194 aa, Oryza sativa
  unsure (1)..(194): unsure at all Xaa locations
XAVDDDDDKEEAAADDREKKVDIAAADPEKPRAPKAQVVGWPPVRSYRKNILAVQADKGKDAADGGGDKSGAGAGAAAFVKVSMDGAPYLRKVDLKMYKSYLELSKALEKMFSSFTIGNCGSHGVNGMNESKIADLLNGSEYVPTYEDKDGDWMLVGDVPWEMFVESCKRLRIMKGSEAIGLAPRAMEKCKNRS

SEQ ID NO: 3324 - protein, 486 aa, Oryza sativa
MGGGGKCKRGKRGKIAAKRRRGQCCSSSSSSGGARRRARERESEESLGEMGECRGGGGGGDGLIKLFGKTIPVQPDAKDVQQHSGSSSSSTESDVQETAAVAVADPSPRSEVVDGESPPQPGGEAASHQQQQKEMKLKKPDKILPCPRCSSMDTKFCYFNNYNVNQPRHFCKHCQRYWTAGGAMRNVPVGAGRRKNKNATAAAHFLHRVRACAAAAAMPAAPHDATNATVLSFGGGGGGHDAPPVTLDLADKMTRLGKEGLVAHARNADAAAACSEVSSNRDDEQIGNTVAKPANGLQQHPPPPHHHHHSAMNGGGIWPYYTSGIAIPIYPAAPAYWGCMIPPPGAWSLPWPATVQSQAISSSSPPTSATPSVSSFTLGKHPREGGDHEARDHHGNGKVWVPKTIRIDNADEVARSSIRSLFAFRGGDKADDNNDDDGTGVHKLATTVFEPKRDSKTAKHPAITSLPLLHTNPVALTRSATFQEGS

SEQ ID NO: 3325 - protein, 387 aa, Oryza sativa
MEAAVDGRWTRVRTLGRGASGAVVSLAADDRSGALFAVKSAAAAAAAEQLVREGRILSGLRSPHVLPCLGFRAEAGGECQLFLEFAPGGSLADVVARSGGRLDECAIRAYAADVARGLAYLHGMSLVHGDVKGRNVVVGADGRAKIADFGCARTVGSDRPIGGTPAFMAPEVARGEEQEPAADVWALGCTVIEMATGRAPWSDMEDILSAVRRIGYTDAVPEVPEWLSAEAKDFLARCFARNPRERWTSSQLLEHPFLASAGCSVKTGEAAPQWVSPKSTLDVAFWESDTDDEEDDMPASPAERIKALACPCSALPDWDSDEGWIQVLNESSEACDTAVAKVEAEGKGRVLIEALETINESSGGDAECVDPEGTYMQFAPSDQVRNC

SEQ ID NO: 3326 - protein, 369 aa, Oryza sativa
MDGAPVAEFRPTMTHGGRYLLYDIFGNKFEVTNKYQPPIMPIGRGAYGIVCSVMNFETREMVAIKKIANAFNNDMDAKRTLREIKLLRHLDHENIIGIRDVIPPPIPQAFNDVYIATELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQYPRRTFASMFPRVQPAALDLIERMLTFNPLQRITVEEALDHPYLERLHDIADEPICLEPFSFDFEQKALNEDQMKQLIFNEAIEMNPNIRY

SEQ ID NO: 3327 - protein, 468 aa, Oryza sativa
  unsure (1)..(468): unsure at all Xaa locations
XVLPCNLXRKNPELQELVPLLSSPHSSLLSSRGGCEGGGPHRRRRRRTSSVTLSHRYGPCSPADPNSGEKRPTDEELLRRDQLRADYIRRKFSGSNGTAAGEDGQSSKVSVPTTLGSSLDTLEYVISVGLGSPAVTQRVVIDTGSDVSWVQCEPCPAPSPCHAHAGALFDPAASSTYAAFNCSAAACAQLGDSGEANGCDAKSRCQYIVKYGDGSNTTGTYSSDVLTLSGFDVVRGFQFGCSHANAGMDDKTDGFIGLGGDAQSPVSQTAARYGKSFFYCLPATPASSGFLTLGAPASXAAAAARRGXATTPMLRSKKVPTYYFAALEDIAVGGKKLGLSPSVFAAGSLVDSGTVITRLPPAAYAALSSAFRAGMTRYARAEPLGILDTCFNFTGLDKVSIPTVALVFAGGAVVDLDAHGMVSGGCLAFAPTRDDKAFGTIGNVQQRTFEVLYDVGGGVFGFRVGACX

SEQ ID NO: 3328 - protein, 262 aa, Oryza sativa; identical to SEQ ID NO: 951

SEQ ID NO: 3329 - protein, 191 aa, Oryza sativa
LTIGKAAPPAPQKLYRGVRQRHWGKWVAEIRLPRNRTRLWLGTFDTAEEAALTYDQAAYRLRGDAARLNFPDNAASRGPLDAAVDAKLQAICDTIAASKNASSRSRGGAGRAMPINAPLVAAASSSSGSDHSGGGDDGGSETSSSSAAASPLAEMEQLDFSEVPWDEAEGFALTKYPSYEIDWDSLLNNNN

SEQ ID NO: 3330 - protein, 404 aa, Oryza sativa
MAKQLRRVRTLGRGASGAVVWLASDDDSGELMAVKSASAGGAAAQLRREGRVLSGLCSPHIVPCLGSRAAAGGEYQLFLEFAPGGSLADEAARNGGCLPEPAIRAYAADVARGLAYLHGNSLVHGDVKARNVVIGSDGRARLTDFGCARVMDSAGPIGGTPAFMAPEVARGEEQGPAADVWALGCTIIEMATGRAPWSDMDDILAAVHRIGYTNAVPEVPGWLSAEAKDFLDGCFERNASDRSTAAQLLEHPFVASAAALDRWPEPAKQERASPKSTLHDAFWDSDTDDEDDEMPTGAAERIGALACAASALPDWDSDEGWIEVHDEVSFAAVTPPASDADYFVWAELSDPEMEQFAVAADGVNHVPRNEAEAIESSIRQGSYLHLMFPAIRIGVVSERQSIPF

SEQ ID NO: 3331 - protein, 159 aa, Oryza sativa
  unsure (1)..(159): unsure at all Xaa locations
MKGGKSTGAAKPRAKXSVNTTDXEKPAEKGKNIKAAKDPNKPKRAPXGFFHFMQEFRKELKENNPKNTTVAAAGKEAVXDRSKSLTEADNAPYVAKANKLKAEYNKDIAAYNKVYSTAKNAPDKEEEEDDEEESDKSKSHVXNDEEDDQGSEEDEDYDY

SEQ ID NO: 3332 - protein, 180 aa, Oryza sativa
  unsure (1)..(180): unsure at all Xaa locations
MVLTIMEAKGKDAWGLLLVLLLGQLVAFSMAVSSFTSSLIATLGVDAPLTQSFFAYLLLTLVYVPILLKRRQKLQIPWYWYLALAFIDVQGNYLVVKAYQYSYITSVTLLDCWTVVWVVILTWYALGTRYSFWQIVGAGTCVAGIALVLXLDSKSADGQDPSKIPLLGDAPVLAATYFLX

SEQ ID NO: 3333 - protein, 362 aa, Oryza sativa
MMVVDTVSASTSLVAHHLFDQRSKANHHLRGTLHVVSSRPLPTHFAVRRLVAGAHRQHQPRLREWPVKALAMMMVVDTGVTKKASPHRESGGPIDPKLHNPLLRLKRMGCGWLEVIFEWQGVIVEDDAELERQAWFTLAQEEGKSPPLAFVLKRIEGMKSEQAISEGLCWSRDPSELRRLSSRKEEIRCTLRGTVYQMRNGSREFMSTLANYKIPLAVATTRPRKVIEEAIDAVGVRSFFDAVVAAEDVYRGKPDPEMFLYAAQLLSFIPERCIVFGNSNSAVEAAHDARMKCVAVASKHPIYELNAADLVVKQLDELSVVDLKNLADIESPEFGMEPEPEMEEEEDEESPSTSVGVDDLFW

SEQ ID NO: 3334 - protein, 206 aa, Oryza sativa
  unsure (1)..(206): unsure at all Xaa locations
MPGAAAAGYADQTECTSGEPCKRIREECKPKISKLYVHADPSDLSLVVKDGYQWRKYGQKVTKDNPCPRAYFRCSFAPGRPVKKQVQRSAEDNTILVATYEGEHNHGQPPPPLQSAAQNSDGSGKSAGKPPHAPAAAPRAPVVPHRQHEPVVVNGEQQAAAASEMIRRNLAEQMAMTLTRDPSFKAALVTALSGRILELSPTKDXR

SEQ ID NO: 3335 - protein, 328 aa, Oryza sativa
  unsure (1)..(328): unsure at all Xaa locations
MENGGGGGGDGGKSDVPADANEHCPGTXSEEAGKADACAGCPNQQICATAPKGPDPDLVGIVERMATVKHKILVLSGKGGVGKSTFSAQLSFALAEMDCQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPILGVVENMSGLRQELLTMVACSEVFDSSKGGAEKMCNEMGVPFLGKVPMDPQLCKAAEEGRSCFVDQKCSASAPALKSIVKKLIENQDXVNF

SEQ ID NO: 3336 - protein, 556 aa, Oryza sativa
MATVAVFFPLPVAKEAFYNTPVGRWPYVGFLRLRQLASSKQRSTAMSRSVGVTMDAAGADADQARLHQLGYRQELKRGLSLVSNFAFSFSIISVLTGVTTTYGTGLRYGGPVSMTLGWLVVAAFNGCVALSMAEICSAYPTSGGLYYWSAKLAGKEWAPLASWVTGWFNIMGQWACTTSVDFSLAQLLQVIILLATGGANGGGYMASKYVVLAIYSAILILHGLINSLPIRWLSWFGQLGAFWNVAAVAKERVSPEFIFTHFNAENGAGIHDKAYILAAGLLMSQYSLIGYDTSAHIIEETKNADWSGPIGIITSVALSTMFGWIYLIALTSIMTDIPYLLNPSNDAGGYAIAQALYTSFHRRYGTGAGALACLGVIAVAIFLCGSACITSNSRMGYAFSRDGAMPLSRVWHRVDSREVPLNVVWLSVAVAFVMALTSLGSQVAFQAMVSIATLGLLIACALPVFFRVTTARRSFVRGPFHLGKYGVIVGWVGVVWVATVTVLFSLPVAYPVAKETFNYTPVAVGGVLLLSLVAWVLHARFWFQGPVTNVDTYNVP

SEQ ID NO: 3337 - protein, 238 aa, Oryza sativa
MGEEAPEEYELGGGEDERVMEWETGLPGADELTPLSQPLVPAGLAAAFRIPPEPGRTLLDVHRASAATVSRLRRASSSSSSSFPAFASKGAGTGADEAESGGGADGGNGNTNNSSSKRARLVWTPQLHKRFVEVVAHLGMKNAVPKTIMQLMNVEGLTRENVASHLQKYRLYVKRMQGLSNEGPSPSDHIFASTPVPHASLHDQVPSPYHPHPHHHSYNNAAYAATVSSYHHYHHANH

SEQ ID NO: 3338 - protein, 531 aa, Oryza sativa
MKRCQSSRPTAAVAAVVAAVSMIIVLVSGTAIPSAAAAAAVEHTFVVSQVNMTHLCKEMAFTVVNGQLPGPTIEVTEGDSVTVHVVNKSPYNLTIHWHGVYQLLNCWNDGVPMITQRPIQPNHNFTYRFNVAGQEGEWWEKDLPQVDRNMTNGYFDDYSSGSTINGKLGDLFNCSGVLEDGYVLDVEPGKTYLLRIINAALFSEYFLKIAGHRFTVVASDANYLTPYSTDVVVIAPGETLDAIVVADAPPSGRYYIAAQPIQAPPPDTQTPEYATRGTLQYSSNSRNSSAAAMPEMPHQHDTMRSFYFRGNLTAGARLHRHGRRRVPARADESLFVTLGLGSVCRHGGASCKRGGNLKESIVVANVNNVSFHIPAAAATPILEAHYYHRLHAGAGEEEEELAERPPRAYNYTDQALTPFGPEEMRLEATSRAVVTRRFRHGATVDVVFQSTAMLQGDSNPMHLHGHDVFLLAQGIGIYDAARDEGKFNLVNPPRKNTVLVPNLGWAAVRFVADNPGAYRSIGFSCAHALYT

SEQ ID NO: 3339 - protein, 182 aa, Oryza sativa
  unsure (1)..(182): unsure at all Xaa locations
MLAKSGSLRXLTLLGXRMWNFASSAWGSGLGKKNTPKHPVXXGDCSDDEASSCTSREEGLECPICWESFNIVENVPYVLWCGHTMCKNCILGLQWAIIKVPTVPIQLPFFVSCPWCNLLSLRIIYKGNLAFPRKNYFLLWMVEGMNGERARSRSAIHSXXNKLHGLSVAVGQVEWKLFESHX

SEQ ID NO: 3340 - protein, 516 aa, Oryza sativa; identical to SEQ ID NO: 1208

SEQ ID NO: 3341 - protein, 377 aa, Oryza sativa
  unsure (1)..(377): unsure at all Xaa locations
XGGTLSHSLQPHPNRGPTTPKTITAPPPPPPQPQPQAAKKSRRGPRSRSSQYRGVTFYRRTGRWESHIWDCGKQVYLGGFDTAHAAARAYDRAAIKFRGVEADINFNLSDYEEDMRQMKSLSKEEFVHVLRRQSTGFSRGSSKYRGVTLHKCGRWGARMGQFLGKKYIYLGLFDSEVEAARAYDKAAIKCNGREAVTNFEPSTYDGELPTDAAAQGADVDLNLSISQPAASQQSPKRDSGSLGLQIHHGSFEGSEFKRAKNDAAPSELASRPHRFPLLTXXIRQSGLPNLRGSCSKLGMEADPAPPHTLPLPFFSSSSSSPSSSSAAASSGFSNATTAAAAQHTATLRFDPTAPSSSSSSRHHHHHXXKGKKPSPPL

SEQ ID NO: 3342 - protein, 241 aa, Oryza sativa
  unsure (1)..(241): unsure at all Xaa locations
VWRGHRAGGRGVELDAAVAAAASRGGARVQHPEELGVGVGRERRPQPQAAKKSRRGPRSRSSQYRGVTFYRRTGRWESHIWDCGKQVYLGGFDTAHAAARAYDRAAIKFRGVEADINFNLSDYEEDMRQMKSLSKEEFVHVLRRQSTGFSRGSSKYRGVTLHKCGRWEARMGQFLGKKYIYLGLFDSEVEAARAYDKAAIKCNGREAVTNFEPSTYDGELPTDAAAQGNMPGSRQIFFFLX

SEQ ID NO: 3343 - protein, 150 aa, Oryza sativa
  unsure (1)..(150): unsure at all Xaa locations
MPVPLAPYPTPPVPFTPPNGAQSQLVCSGCRNLLMYPAGATSVCCAVCSTVTAVPAPGTEMAQLVCGGCHTLLMYIRGATSVXQCSCCHTVDLAMQADQVAHADCGNCRMLLMYQYGARSVKCAVCNFVTSVGASPGTDQKPSSXTAEVP

SEQ ID NO: 3344 - protein, 431 aa, Oryza sativa
  unsure (1)..(431): unsure at all Xaa locations
MDSARSWFQKFQPRDKSKSPAVAASHGKDPGKPPIDDXXPSSATKQRVAAAKQYIENHYKTQMKSLQDRKERRWMLERKLQDAEVPVEEQNNILKHLEKKETEYMRLQRHKMGVEDFELLTIIGRGAFGEVEHVKAERNLLAEVDSAFIVKLYYSFQDEEYLYLIMEYLPGGDMMTLLMRKDTLTEDEARFYIAETVLAIESIHKHSYIHRDIKPDNLLLDRSGHLKLSDFGLCKPLDSSNFPNLNEPDYTSTKGTNDSSSRLSSSALKRTQQEQLSHWQKNRRMLAYSTVGTPDYIAPEVLLKKGYGMECDWLVSYXXIVNWRSHLKFPEEAKLSPEAKDLISKLLCNVEQRLGTKGAHEIKAHPWFRGLPWERLYQMKAAFIPEVNSELDTQNFEKFEEMLPSKDANFVGYTYKNFEIVNDDEVAGIGX

SEQ ID NO: 3345 - protein, 496 aa, Oryza sativa
  unsure (1)..(496): unsure at all Xaa locations
MDSARSWFQKFQPRDKSKSPAVAASHGKDPGKPPIDDXXPSSATKQRVAAAKQYIENHYKTQMKSLQDRKERRWMLERKLQDAEVPVEEQNNILKHLEKKETEYMRLQRHKMGVEDFELLTIIGRGAFGEVRLCREKASKNVYAMKKLKKSEMLRRGQVEHVKAERNLLAEVDSAFIVKLYYSFQDEEYLYLIMEYLPGGDMMTLLMRKDTLTEDEARFYIAETVLAIESIHKHSYIHRDIKPDNLLLDRSGHLKLSDFGLCKPLDSSNFPNLNEPDYTSTKGTNDSSSRLSSSALKRTQQEQLSHWQKNRRMLIVNWRSHLKFPEEAKLSPEAKDLISKLLCNVEQRLGTKGAHEIKAHPWFRGLPWERLYQMKAAFIPEVNSELDTQNFEKFEETGAQIQSSSKSGPWRKMLPSKDANFVGYTYKNFEIVNDDEVAGIEETDNKDEVVDMESCSRPVGDKSSQVEDKSCNGDKAMDGSXLSRXQIVLHVLLMRM

SEQ ID NO: 3346 - protein, 555 aa, Oryza sativa
  unsure (1)..(555): unsure at all Xaa locations
MDSARSWFQKFQPRDKSKSPAVAASHGKDPGKPPIDDXXPSSATKQRVAAAKQYIENHYKTQMKSLQDRKERRWMLERKLQDAEVPVEEQNNILKHLEKKETEYMRLQRHKMGVEDFELLTIIGRGAFGEVRLCREKASKNVYAMKKLKKSEMLRRGQVEHVKAXRNLLAEGDSAFIVKLYYSFQDEAYLYLIMEYLPGGDMMTLLMRKDTLTEDEARXYIAETVLAIESIHKHSYIHRDIKPDNLLLDRRGHLKLSDFGLCKPLDSSNFPNLYEPDYTSTKGTNDSSSRLSSSALKRTQQEQLSHWQKNRRMLAYSTVGTPDYIAPEVLLKKGYGMECDWWSLGAIMYEMLVGYPPFYSEDPMSTCRKIVNWRSHLKFPEEAKLSPEAKDLISKLLCNVEQRLGTKGAHEIKAHPWFRGLPWERLYQMKAAFIPEVNSELDTQNFEKFEETGAQIQSSSKSGPWRKMLPSKDANFVGYTYKNFEIVNDDEVAGIAELKKKSSKSKRPTIKTLFESMDEDXXPVQGSFLNMLPHKEGQPSSHSTIPPEQYQPRHK

SEQ ID NO: 3347 - protein, 104 aa, Oryza sativa
  unsure (1)..(104): unsure at all Xaa locations
MKGAKSKGAAKPDAKLAXVKSKGAEKPXAAFGRXKGKAGKDPNKPKRAPLPFVVFMEEFRXEFXEKNPKNKSVAAXGKAAGDRWKSLTXADXAPSVAPAPXLXA

SEQ ID NO: 3348 - protein, 157 aa, Oryza sativa
MKGAKSKGAAKPDAKLAVKSKGAEKPAAKGRKGKAGKDPNKPKRAPSAFFVFMEEFRKEFKEKNPKNKSVAAVGKAAGDRWKSLTEADKAPYVAKANKLKAEYNKAIAAYNKGESTAKKAPAKEEEQHHQEESDKSKSEVNDEDDHEGSEEDEDDDE

SEQ ID NO: 3349 - protein, 515 aa, Oryza sativa
MSRSGVVAMDAAGADADQARLHQLGYRQELKRGLSLVSNFAFSFSIISVLTGVTTTYGTGLRYGGPVSMTLGWLVVSAFNGCVALSMAEICSAYPTSGGLYYWSAKLAGKEWAPLASWVTGWFNIVGQWACTTSVDFSLAQLLQVIILLATGGANGGGYMASKYVVLAIYSVILILHGLINSLPIHWLSWFGQLGAFWNVAENGMGIHQKAYILAVGLLMSQYSVIGYDTSAHMIEETKNADWSGPMGIITSVGLSTMFGWIYLIALTSIMTDIPYLLNPSNDAGGYAIAQALYTSFHRRYGTGAGALACLGVIAVAIFLCGSACITSNSRMGYAFSRDGAMPLSRVWHRVDSREVPLNVVWLSVAVAFVMALTVNSKSIAAAAAVNFSSCSDLVVFSWQSLGSQVAFQAMVSVTTLGLYIAYALPVFFRVTTARKSFVPGQFHLGRYGLMVGWMAVVWVATVTVLFSLPVAYPVAKETFNYTPVAVGGVLLLSLVAWVFHARFWFQGPVTNVDA

SEQ ID NO: 3350 - protein, 238 aa, Oryza sativa; identical to SEQ ID NO: 1175

SEQ ID NO: 3351 - protein, 143 aa, Oryza sativa
  unsure (1)..(143): unsure at all Xaa locations
LPGPTLEVREGDTVVINVVNHAQYNVTIHWHGIRQFRTGWADGPEFVTQCPIKPGGSYKYRFTIEGQEGTLWWHAHSSWLRATVYGALIIRPRENKTYPFEKPAREVPLILGEWWDADPXQVIREAQRTGAAPNISDAYTINX

SEQ ID NO: 3352 - protein, 54 aa, Oryza sativa
  unsure (1)..(54): unsure at all Xaa locations
XIPSFIPPKVCPLIGTAFPTIHHTTYPHNYGHYTVWMDWMFGPLREPEDILKKD

SEQ ID NO: 3353 - protein, 175 aa, Oryza sativa
  unsure (1)..(175): unsure at all Xaa locations
SLNCAKCPPEENVYMVKLADQAERYVDMGEYMGKVAKTAYVEEVTVEECNLLSVAXKSEIGDLRASCRNGSSIEHKEEARGNDEHGTLFMDXRDQIEYELSKICDGVLKLLVSLLVPSSTAAQYTVLYLMMKVDYHRYLAXFKTGAERHGAVEITMRAYKDAQDIALXSDLXSHP

SEQ ID NO: 3354 - protein, 173 aa, Oryza sativa
MAAPDVDYRCFVGGLAWATDNRSLEAAFSTYGEILESKIINDRETGRSRGFGFVTFSSEQAMRDAIEGMNGKELDGRNITVNEAQSRRSGGGGGGGYGQRGGGGGYGGGGYGGGGGGGGYGQRREGGYGGGGGYGGGRGGGGFGGGFGGGYGGGYGGGYGSRGGGNSDGNWRN

SEQ ID NO: 3355 - protein, 516 aa, Oryza sativa
MAAGDQAADDPDSLRLLQLGYKQELKRGLSTLSNFAFSFANISVLTGVTATYNTGLRYGGPVSMTLGWLVVALFNGCVALSMAEICSAYPTSGGLYYWSAKLAGKEWASLASWVTGWFNIVGQWAAIASVDFSLAQLLQVIILLSTGGANGGGYMASKYVVLVICAVILILHGVINSLPIQWLSLFGQIGAIWNAAGVFVLVILIPAVAKDRPSVEFVFTHLNTDNGMGIHSKAYILAVGLLMSQYSVLGYDTSAHMVEETKNADRSGPIGIITSVVCATVFGWIYLLALTTAVTDIPYLLSPGNDAGGYAIAQALYTAFHRRFGSGAGGIACLGAVAVAIFLCGIACVTSNSRMAYAFSRDGAMPLSRVWYRVNKHEVPLNVVWLAVAVAFFMALTSLGSQVAFQALGSIATLGMYIAYALPVFFRVTTARRSFVPGPFNLGKYGVLVGWVGVVWVATVTVLFSLPVAYPVANKETFNYTPVAVGGVLLLSVGAWVLHARFWFQGPITNTSDGPI

SEQ ID NO: 3356 - protein, 518 aa, Oryza sativa
  unsure (1)..(518): unsure at all Xaa locations
XVQLAVAAGDQVDPDSLRLHQLGYKQELKRGLSALSNFAFSFANISVMMGVTTTYNTGLRYGGPVSMTLGWLVVAVFNGCVALSMAEICSAYPTSGGLYYWSAKLAGKEWASLASWVTGWYQLLWQWAAIASVDFSLAQLLQVIILLSTGGANGGGYMASKYVVLVICAVILILHGVINSLPIQWLSLFGQIGAIWNAAGVFVLVILIPAVAKDRPSVEFVFTHLNTDNGMGIHSKAYILAVGLLMSQYSVLGYDTSAHMVEETKNADRSGPIGIITSVVCATVFGWIYLLALTTAVTDIPYLLSPGNDAGGYAIAQALYTAFHRRFGSGAGGIACLGAVAVAIFLCGIACVTSNSRMAYAFSRDGAMPLSRVWYRVNKHEVPLNVVWLAVAVAFFMALTSLGSQVAFQAMGSIATLGMYIAYALPVFFRVTTARRSFVPGPFHLGRYGVVVGWAGVVWVATVTVLFSLPVAYPVANKETFNYTPVAVGGVLLLSVGAWVLRARFWFQGPITNVDTHC

SEQ ID NO: 3357 - protein, 207 aa, Oryza sativa
  unsure (1)..(207): unsure at all Xaa locations
XDFERRPGRYMAKLAEQAERYEEMVEFMEKVAKTTDVGELTVEERNLLSVAYKNVIGARRASWRIISSIEQKEESRGNEAYVASIKEFKSGAEGKEAAENTLVAYKSAQDIALADLPTTHPIRLGLALNFSVFYYEILNSPDRACNLAKQAFDDAIAELDTLGEESYKDSTLIMQLLRDNLTLWTSDNAEDGGDEIKEAAKPEGEGH

SEQ ID NO: 3358 - protein, 149 aa, Oryza sativa
  unsure (1)..(149): unsure at all Xaa locations
XPSSTAARXSKVFYXLKMKXDYHRYLRIXXDGAERKEAAESTMVAYKAAQDIALADLAPTHPIRLGLALNFSVFYYEILNSPDKACNLAKQAXDEAISELDTLGEESYKDSTLIMQLLRDNLTLWTSDLTEDGGDEVKEASKGDACEGQ

SEQ ID NO: 3359 - protein, 939 aa, Oryza sativa
MESGVPPCAACGDDAHAACRACSYALCKACLDEDAAEGRTTCARCGGEYGAPDPAHGQGAVVEEEVEESHEPAAGGVRERVTMASQLSDHQDEGVHARTMSTHARTISSVSGVGSELNDESGKPIWKNRVESWKEKKKEKKASAKKAAAKAQAPPVEEQIMDEKDLTDAYEPLSRIIPISKNKLTPYRAVIIMRLVVLGLFFHYRITNPVYSAFGLWMTSVICEIWFGFSWILDQFPKWCPINRETYVDRLIARYGDGEDSGLAPVDFFVSTVDPLKEPPLITANTVLSILAVDYPVEKISCYVSDDGSAMLTFESLAETAEFARRWVPFCKKYSIEPRAPEFYFSQKIDYLKDKIHPSFVKERRAMKRDYEEYKVRINALVAKAQKTPEEGWIMQDGTPWPGNNPRDHPGMIQVFLGETGARDFDGNELPRLVYVSREKRPGYQHHKKAGAMNALVRVSAVLTNAPYILNLDCDHYVNNSKAVREAMCFMMDPSVGRDVCYVQFPQRFDGIDRSDRYANRNVVFFDVNMKGLDGLQGPVYVGTGCCFYRQALYGYGPPSLPALPKSSVCSWCCCCCPKKKAEKSEKEMHRDSRREDLESAIFNLREIDNYDEYERSMLISQMSFEKSFGLSSVFIESTLMENGGVPESANPSTLIKEAIHVISCGYEEKTEWGKEVLRWALGSVEIFLSRHCPLWYGYGGGRLKWLQRLSYINTIVYPFTSLPLIAYCCLPAICLLTGKFIIPTLSNAATIWFLGLFISIIVTSVLELRWSGIGIEDWWRNEQFWVIGGVSAHLFAVFQGILKMIAGLDTNFTVTAKATDDTEFGELYVFKWTTVLIPPTSILVLNLVGVVAGFSDALNSGYESWGPLFGKVFFAMWVIMHLYPFLKGLMGRQNRTPTIVVLWSVLLASVFSLLWVKIDPFIGSSETTTTNSCANFDC

SEQ ID NO: 3360 - protein, 156 aa, Oryza sativa
LAIRPDWRKLGVSFFFLFLVQGSEKFRTGGGAHIRESVPPNHMEDYPSGRSKAAIGFLRRGGGFSSRNQSTEERTIQNYDGPGITTRLNPMKTRLSDNQERPRYLRDSFRSSTSMAIHGSSSKVPLRKFGDERRQTLLAGVDIAESSSRNAGTSGG

SEQ ID NO: 3361 - protein, 522 aa, Oryza sativa
  unsure (1)..(522): unsure at all Xaa locations
MGTPRGLRNAGSSSSACRFLAAFAVLLALPTLTAGLTRHYTFNVQMTNVTRLCVTKSIPTVNGQFPGPKLVVREGDRLVVKVHNHMNYNVSFHWHGILQLRNGWADGPSYITQCPIQGGGSYVYDFTVTGQRGTLWWHAHFSWLRVHLYGPLVILPKRGEGFPFPRPYKELPPIMFGEWFNADTEAVINQALQTGAGPNISDAYTFNGLPGPTYNCSSKDTYKVKVQPGRTYLLRLINSALNDELFFGIANHTLTVVEADANYVKPFTAKTLVISPGQTMNLLLTTAPNPGSPVYAMAIAPYTNTQGTFDNTTAVAVLEXRPDSSERHRKQQPPLAAXLPRYNDTNAVANFSSKFRSLATARYPARVPRAVDRHVLFTVGLGTDPCPSNQTCQGPNGTKFAASINNNSFVRPRGTSIQGAESHPLHMHGFNFFVVGQGFGNYDPVNDPANYNLVDPVERNTVSVPTGGWVAVRFLADNPGVWLMHCHFDVHLSWGLSMAWLVNDGPLPSQKMLPPPSDLPKC

SEQ ID NO: 3362 - protein, 159 aa, Oryza sativa
RPVDDSPPAYPAIAGPRIRTTTTERASQQNALRSRRNFQDSAVSVRTRRPPWGARFRISEEREDGMISQRDSSIGNQQSDQVHSSSEEAPTESSSRPFSAELPHAIYSSRGEGSNAFTARRRRSSSLYEERPPQTFHDLFRERNGRRHISIEGIAEVIL

SEQ ID NO: 3363 - protein, 199 aa, Oryza sativa
  unsure (1)..(199): unsure at all Xaa locations
MASGTDEKAKMEGLTSAAAFVEGGIQDACDDACSICLEAFCESDPSTLTGCKHEFHLQCILEWCQRSSQCPMCWQPISLKDPTSQELLEAVERERNVRTNQTRNTTIFHHPALGDFEVQHHLAAAAAMGRSPPLGSREGHRGRSGSHGGPQVVGFPADPDMPSAGTDCSSMXNGKKNQGQVFTGINNGFGDPIAQKKPX

SEQ ID NO: 3364 - protein, 187 aa, Oryza sativa
  unsure (1)..(187): unsure at all Xaa locations
MAAPDVEYRCFVGGLAWATDDRSLEAAFSTFGEILESKIINDRETGRSRGFGFVTFSSEQAMRDAIEGMNGKELDGRNXITVNEAQSRRSGGGGGGGYGQRGGGGGYGGGGYRWGGGGGGYRQRREGGYGGGGGYRGGRGGGGFGGGVRXSRGGGNFDGNLETERWGPLGQVIHLSNRASLIIVPCV

SEQ ID NO: 3365 - protein, 167 aa, Oryza sativa
  unsure (1)..(167): unsure at all Xaa locations
MAAPDVEYRCFVGGLAWATDDRSLEAAFSTFGEILESKIINDREXTGRSRGFGFVTFSSEQAMRDAIEGMNGKELDGRNITVNEAQSRRSGGGGGGGYGQRGGGGGYGGGGGYGGGGGGGGYGQRREGGYGGGGGYGGGRGGGGYGGGYGGGYGXRGGGNSDGNWRN

SEQ ID NO: 3366 - protein, 161 aa, Oryza sativa
  unsure (1)..(161): unsure at all Xaa locations
MAAPDVEYRCFVGGLAWATDDRSLEAAFSTYGEILESKIINDRETGRSRGFGFVTFSSEQAMRDAIEGMNGKELDGRNITVNEAQSRRSGGGGGGGYGQRGGGGXYGGGGYGGGGGGGGYGQRREGGYGGGGGYGGGRGGGGYGGGYGSRGGGNSDGNWRN

SEQ ID NO: 3367 - protein, 281 aa, Oryza sativa
MAASTPAASRERRWSLAGKTALVTGGTKGIGRAIVEELAGFGVRVHTCSRHDADLQDCLRRWNAADGGGLGGGAAAPVTASVCDVSVRGDREALVAAARAALGGRLDILVNNVGQTLFGAAAACAAEDYARIMATNLESCFHLAQLAHPLLLGAGGAAASVVNISSVAGFIAYPALSVYSATKGAMNQLTRSLAAEWARDGIRVNCVAPGGVRTDIAGSSGVALEPGAARAMEEREAARVVMGRIGEPEEVASLVAFLCMPAAPYITGQVICVDGGRTITA

SEQ ID NO: 3368 - protein, 532 aa, Oryza sativa
MAAGDQAADDPDSLRLLQLGYKQELKRGLSTLSNFAFSFANISVLTGVTATYNTGLRYGGPVSMTLGWLVVALFNGCVALSMAEICSAYPTSGGLYYWSAKLAGKEWASLASWVTGWFNIVGQWAAIASVDFSLAQLLQVIILLSTGGANGGGYMASKYVVLVICAVILILHGVINSLPIQWLSLFGQIGAIWNAAGVFVLVILIPAVAKDRPSVEFVFTHLNTDNGMGIHSKAYILAVGLLMSQYSVLGYDTSAHMVEETKNADRSGPIGIITSVVCATVFGWIYLLALTTAVTDIPYLLSPGNDAGGYAIAQALYTAFHRRFGSGAGGIACLGAVAVAIFLCGIACVTSNSRDGAMPLSRVWYRVNKHEVPLNVVWLAVAVAFFMALTVNYYIPSCTRCCFCSSCVRCSDTSLGSQVAFQALGSIATLGMYIAYALPVFFRVTTARRSFVPGPFNLGKYGVLVGWVGVVWVATVTVLFSLPVAYPVANKETFNYTPVAVGGVLLLSVGAWVLHARFWFQGPITNTSDGPI

SEQ ID NO: 3369 - protein, 117 aa, Oryza sativa
MEGDSFSGMANGGQVDNKLIQTFHKSFVQVQSILDQNRMLINEINQNHESRAPDNLTRNVGLIRELNNNIRRVVGLYADLSASFARTMDASSEGDSSGTLRSSDGAGRTGQKRVRPG

SEQ ID NO: 3370 - protein, 347 aa, Oryza sativa
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 3371 - protein, 177 aa, Oryza sativa
  unsure (1)..(177): unsure at all Xaa locations
XYNIDWIAFCNHNLDDISNEMIAKLCIIPVLCILEILFDKVRYSRNTKLSIVLVLVGVAVCTVTDVSVNSKGLLAAVIAVWSTALQQHYVHHLQKKYSLGSFNLLGHTAPAQAASLLILGPFVDFWLTNRRVDTFNYTTIVTPYAAMDCIQVIAXHQTSYHVINRSICQQHNTATLX

SEQ ID NO: 3372 - protein, 266 aa, Oryza sativa
  unsure (1)..(266): unsure at all Xaa locations
XGLRNRHEGLNQTLVPCTEPVKFLQIYSRGSTIQMALSRSVEVAVPADPAGDGDRDKIRLRQLGYKQELKRGLSVLSNFAFSFSIISVMAGVTTTYSTGLRYGGPVSMTLTRPVVSAFNGCMALSMAEICSAYPTSGGLYYWSAKLAGNDWAPFASWITGWFNITGQWAATTSVDFALAQLVQVIVLLSTGGANGGGYMASNYVVLAIYGAMLVIHGAINSLPIQCLSWFGQLGAFWNAAGVFVLVALIPAVATERASVEFIFTHF

SEQ ID NO: 3373 - protein, 106 aa, Oryza sativa
  unsure (1)..(106): unsure at all Xaa locations
XMGDVSATETAIVYGLEPVWGAAFAWFLLGERWDNAAWVGAALVLCGSLTVQLFGSAPEKSKKVKTRSCNTLETPLKRQDYLSLSAIPVDSRKNIGSRLERKDKTL

SEQ ID NO: 3374 - protein, 79 aa, Oryza sativa
  unsure (1)..(79): unsure at all Xaa locations
XPLTTLYQSSTPDGAHSSVAIYVLXSCKVRAGYXDVGKGCAAALKQAGARVIVTEIDPICALQALMEGLQVLXTLEDVV

SEQ ID NO: 3375 - protein, 767 aa, Oryza sativa
MAILSALGTEVFIPVAAAVGVAFAVAQWLLVARVKVNPAHAAAAAASGGSKNGGYGDYLIEEEEGLNDHNVVVKCHEIQTAISEGATSFLFTEYQYVGIFMSIFAVVIFLFLGSVEGFSTKSQPCTYSKDKYCKPALFNALFSTASFLLGAITSLVSGYLGMKIATFANARTTLEARKGVGKAFIIAFRSGAVMGFLLASSGLVVLYIAINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLITTLFATDFFEIKAVKEIEPALKKQLIISTALMTVGIAIISWLALPAKFTIFNFGAQKEVTNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNSIPGLMEGTGKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATHGGLLFKWF

SEQ ID NO: 3376 - protein, 253 aa, Oryza sativa
MGRGKVQLKRIENKINRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIISRKERSLQEENKALQKELVERQKNVRGQQQVGQWDQTQVQAQAQAQPQAQTSSSSSSMLRDQQALLPPQNICYPPVMMGERNDAAAAAAVAAQGQVQLRIGGLPPWMLSHLNA

SEQ ID NO: 3377 - protein, 188 aa, Oryza sativa
HEAHSFSLLLLLPTPTPWPAAVASHRFLSVAEAGAAFRWTPSQLDPKMLSLQNEIFITSGGDRDLINRILSKSKTETVPENKDDGESDDDNDEEGDDEDAENQGDDDAGDEDASEEEGNDEDEDGDPEANGEGGSDDDDGGEDDDDEDEDGDDDEGEGEGEDDDEDEEEEEEEDDDDDVPQPPAKKRK

SEQ ID NO: 3378 - protein, 252 aa, Oryza sativa
  unsure (1)..(252): unsure at all Xaa locations
LAAGAARRTGGERDSERCLRSGSGRRRXPSGEAPVNSLDDGCLMHIFSFLSPIPXVRFVRSLTITLIFADRYNTALVCHRWRFLACHPRLWLRVERPIRNTIEPGVYPNLESAVSAARPGDTILIAAGGTHVARNIQIKKPLCIIGGGELPDDTVLTCSRGSDKSGRLTIEECLLQCEQNPLDYLSFPIISTAIEYDSFSSLKEQGHGVTVVRTRIEGGAKAVRTNGTLALQHVRAIYSRSSVFFWFEVGER

SEQ ID NO: 3379 - protein, 149 aa, Oryza sativa
  unsure (1)..(149): unsure at all Xaa locations
XLTIRAELGCCLLHRSGRLTIEECLLQCEQNPLDYLSFPIISTAIEYDSFSSLKEQGHGVTVVRTRIEGGAKAVRTNGTLALQHVRAIYSRSSVFFWFEVGERXGIHVNLXGHGHVSYPVSTLGIVCLLFVVTYDKYFLFGSTGTLVTS

SEQ ID NO: 3380 - protein, 501 aa, Oryza sativa
MVVSVAATDSDTAQPVQYSTFFASRYVRDPLPRFRMPEQSIPREAAYQIINDELMLDGNPRLNLASFVTTWMEPECDKLIMDSVNKNYVDMDEYPVTTELQNRCVNMIAHLFNAPIKEDETAIGVGTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNNLLTEKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYKNIMQNCMENTAILREGIEATGRFEILSKEAGVPLVAFSLKDSGRYTVFDISEHLRRFGWIVPAYTMPANAEHVAVLRVVIREDFSRSLAERLVSDIVKILHELDAHSAQVLKISSAIAKQQSGDDGVVTKKSVLETEREIFAYWRDQVKKKQTGIC

SEQ ID NO: 3381 - protein, 218 aa, Oryza sativa
LSATREKGNLFTSHLVGFFLELMIPFVKKAPRVSFKKPIGSVSVSGHKFVGCPMPCGVQITRLEHINRLSSNVEYLASRDATIMGSRNGHAPIFLWYTLNRKGYRGFQKEVQKCLRNAHYLKDRLKEAGIGAMLNELSSTVVFERPKDEEFVRRWQLACEGNIAHVVVMPSVTIDKLDYFLNELTEKRATWYQDGSCQPPCLAKDVGEENCLCSIHKK

SEQ ID NO: 3382 - protein, 320 aa, Oryza sativa
  unsure (1)..(320): unsure at all Xaa locations
XKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAGLVGVPXHKDAVFKTHPMNFLNERTLKGXTFFGNYKPRTDLPNVVELYMKKELEVEKFITHSVPFSXINTAFDLMHKGEGIRCIIRMENLEXFTGXIPXANDXGDAPAAEAKKEDKVEEKEESDDDMGFSFV

SEQ ID NO: 3383 - protein, 354 aa, Oryza sativa
  unsure (1)..(354): unsure at all Xaa locations
ASSLSKSDKKKVLDFAAWSFNITTSVGIIMVNKALMATHGFSFATTLTGLHFVTTTLMTIVFRWLGLSQPSHLPLPDLIKFVIFSNLSIVGMNVSLMWNSVGFYQIAKLCMIPASCLLEVVFDHVHYSRDTKLSIMVVLIGVAVCTVTDVSVNAKGLAAAVIAVWSTALQQYYVHFLQRKYSLNSFNLLGHTAPAQAGSLLLVGPFVDFLLTGKRVDHFGFTSIALFFLTLXXCVIAIGVNLSQFICIGRFSAVSFQVLGHMKTVLVLSLGFLFFGKEGLNFQVVLGMILAVVGMIWYGNASAKPGGKERRSVLPVRSEKPNGALDEKDGSEKXYVTCDLYDNFFCEVFLVMQV

SEQ ID NO: 3384 - protein, 211 aa, Oryza sativa
  unsure (1)..(211): unsure at all Xaa locations
MLVLGKVQLKRIENKINRQVTFSKRMSGLLKKANEISVLCDAEVALIIFSTKGKLYEYATDSCMDKILERYERYSYAEKVLISPEFDTHGNWCHEYRKLKAKVETIQKCQKHLMGEDPESLNLKELQSLEQHLENSLKHITSRKSQLMLESINXLQRKEKSLEEENKVLPKELGGKXQKVHKQQXLLWDPSNPYTSFLLISSFLNEGRPFX

SEQ ID NO: 3385 - protein, 192 aa, Oryza sativa
  unsure (1)..(192): unsure at all Xaa locations
XGGVRRDGERRXGGGGGGVGKEQDRFLPIANIGRIMRRAVPENGKIAKDSKESVQECVSEFISFITSEASDKCLKEKRKTINGDDLIWSMGTLGFEDYVEPLKLYLRLYRETEGDTKXXSRASELPVKKDVVLNGDPGSSFEGMXDEECDTDWHANGIXEGEPSFLGKERSSILLCCKQDASKVPIPCYHEC

SEQ ID NO: 3386 - protein, 141 aa, Oryza sativa
  unsure (1)..(141): unsure at all Xaa locations
MAEEKHHHHLFHHKKDDEPATGVDSYGEGVYTSETVTTEVVAGGQDEYERYKKEEKQHKHKQHLGEAGALAAGAFALYEKHEAKKDPENAHRHKITEEIAVTXAAVGXAGGYAFXHEHHETKKDHTSAEESTGEKKHHLFG

SEQ ID NO: 3387 - protein, 181 aa, Oryza sativa
MSVETERSSTESSAASGLDFEDTALTLRLPGSLAAAAAPDPDRKRSSPSSSDAADAADNSSPLAAAADAPPAPKARVVGWPPVRSFRKNALAAKFVKVAVDGAPYLRKVDLEAYSGYDQLLRALQDKFFSHFTIPIDGRKVAGKFADDERKLVDAVNGTEYVPTYEDKDGDWMLVGDVPWK

SEQ ID NO: 3388 - protein, 202 aa, Oryza sativa
  unsure (1)..(202): unsure at all Xaa locations
MARKLRARIKRGVSCYGRYMPRMIAVPPGMEFSHIVPHDVDQDGEEANEDGSGSTDPPIWADIMRFFSNPRKPMILALARPDPKKNITTLVKAFGEHRELRNLANLTLIMGNRDVIDEMSSTNSAVLTSILKLIDKYDLYGQVAYPKHHKQSEVPDIYRLAARTKVLDNGILVDPHNQNEIAEALYKLVSDKQLWAQCRQNX

SEQ ID NO: 3389 - protein, 611 aa, Oryza sativa
  unsure (1)..(611): unsure at all Xaa locations
GLLGLCGGSISLCSLGGSEILPAALQEQPVVDEAPWATRLAYAGVXATRPVTREYRETWSAAQAWSHQRIRFPHQLMTPLDWNSYKRWHAYHSRTSLPARGGFKRPFPPPSPAKHIRALLARGHGSVKPNEASIPESGEPGVALDKGFGFSRHFAAKYELGREVGRGHFGYTCAATCKKGELKGDDVAVKVIPKAKMTTAIAIEDVRREVRILSSLAGHSNLVQFYDAYEDEENVYIVMELCKGGELLDRILARGGKYSEEDAKVVMRQILSVASFCHLQGVVHRDLKPENFLFSSKDENSAMKVIDFGLSDFVKPDERLNDIVGSAYYVAPEVLHRSYGTEADMWSIGVIVYILLCGSRPFWARTESGIFRAVLKADPSFEEAPWPTLSAEAKDFVRRLLNKDYRKRMTAAQALCHPWIRGTEEVKLPLDMIIYRLMRAYISSSSLRRAALRALAKTLTTDQIYYLREQFELIGPNKSDLITLQNLKTALMKNSTNAMKDSRVVDFVNTISNIQYRKLDFEEFSAAAISVYQMEGLETWEQHARQAYEFFDKEGNRPIVIDELASGLGLGPSVPLHVVLQDWIRHPDGKLSFLGFMKLLHGVSSRTIPKT

SEQ ID NO: 3390 - protein, 299 aa, Oryza sativa
  unsure (1)..(299): unsure at all Xaa locations
MDAQYNPRTVEEVFRDFKGRRAGLVRALTADVEDFFRQCDPEKENLCLYGFPNEHWEVNLPAEEVPPELPEPALGINFARDGMQEKDWLSMVAVHSDAWLLSVAFYFGARFGFDKNDRKRLFGMINDLPTIFEVVSGKSKAKPPSAFNQSNSKSKSSNKTKSSEPRAKHPKPQPQPPVKNESGKEERGPNIQEGGGGGGGSGREEEHGETLCGACGESYGADEFWICCDICEKWFHGKCVKITPAKAEHIKQYKCPSCSGGNGGGGGVSGNGKRARPCRSRRRCILNKXILSDLVLVQX

SEQ ID NO: 3391 - protein, 235 aa, Oryza sativa
  unsure (1)..(235): unsure at all Xaa locations
MHFPTSPFSSVEHSDSSLSSSKMSPDADAAAAAAAGGEGAAAAGVGTAGEGRGVIRWDSLLPRRSLRVLLVEHDDSTRQVVTALLRKCGYRVAAVADGMKAWGVMRERAYAFDLVLTKVTMPTLLAIELLXFIVLKNECKNIPVIMMSSQDSIGTVLGSLLEGALDLLLXPVRMMLLRDLRLLVGSRQALXSPNNGRAKLCGGLSSACQAGQWVDDARXHSDEESDAQSSGSKRX

SEQ ID NO: 3392 - protein, 330 aa, Oryza sativa
  unsure (1)..(330): unsure at all Xaa locations
MAEEAAAGGLYYCHMCASTVSAVAAAEGEVEIKCPYCHSGFVEEIESARGVATGGGGAISSVWAPIIDGMVGGGGGDSVRRHRRSRRLADAAGADDGYYRDLALLDFSESRRRTAALLLLMQEFRERQLQRLESATATISAAAAEAGAVVGTSRDAEGVALADYFLGPGLDALMQRVGDGDAGRQGTLPAKKEAVESMPTVEVAAGGDCDSACAVCLEDYAAGERATEMPCRHRFHAKCIVPWLKMHSSCPVCRFQLPTDDDDDSSKSARGGAAHSGGGRRLSQPAPRVDGGXGLGRLPAVMQELRSILSQPSPASTSGSSSHAQQHSDE

SEQ ID NO: 3393 - protein, 239 aa, Oryza sativa
  unsure (1)..(239): unsure at all Xaa locations
XPTFDTFDCQLHEFRVEGDKLIANLTWRIRTPDSGFFTRTAIQRFVQDPAQPAILYNHDNEFLHYQDDWYIISSKVENKEDDYIFVYYRGRNDAWDGYGGAVLYTRSKVVPESIVPELERAAKSVGRDFSTFIRTDNTCGPEPPLVERIEKTVEQGEKTIIREVQEIEGEIEGEVKELEEEEVTLFKRLTDGLMEVKQDLMNFFQGLSKEEMELLDQMNMEATEVEKVFSRALPIRKLR

SEQ ID NO: 3394 - protein, 483 aa, Oryza sativa
  unsure (1)..(483): unsure at all Xaa locations
MATSGGEDPSGSASSSASALDSLPFSSGNPRIEETRGVVLLHPXXPPAASSSSLLPVGRKPRVCVPGVPNHLTYADFGRFCASWASHILETRIIRIDGVEDQYGVLIKFDTQSFTDSFYMSFNGNRFSSLEGNVCRVRFVEDVHYTXNSIEHAHSSVTSSAEQXPTCPVCLERLXDQDPGGILTTICNHSFYYSCMSKWADSSCPVCRLVTTSTVHSLLPYYLIISALIFRVICGHVGRGRYKGGHAIEHWKETQHCYSLELETQKVWDYAGDNYVHRLIQSKTDGNLVEYNFYGDHSVDGMCSTCNGDAGISEALLDSKMEAIVEEYNDLVTSQLEKQRNYYESLLLEVKEDNEKEIAAATEKAVGIKVQKLQAKLDKCMEETGFLNDIHENLVKNMEMWRERIQKVKEREQAAIRLKDEKIEKLEEELRDLIAHFERQNTVAEASESMSSDINGSTILSVPSESSASSNSSIRNXDXDLLP

SEQ ID NO: 3395 - protein, 302 aa, Oryza sativa
  unsure (1)..(302): unsure at all Xaa locations
MGGGGGVEADCDRIRGPWSPEEDQALRRLVDLHGARNWTAIGREIPGRSGKECRLRWCNQLSPRVERRAVMEDEDARSPRADAGLRDGCAGTARLLPGRTDNAVTNHWDASLKRKLATATDGGEIDRPCKRVSPAPGSPTGSDRSDLSHGXAAEAAPAAEVFRPVPRPXXASTPSARRTSCGRRGGGTXNADHAVAAPPSSLSRSRFRHPSHRSHFQELPSPSRSPSPPPSPPAASPSAYPFNADLVSAMQEMIRTEVRNYMAGVGLRAGCGPGAVAESFMPQLVDGVMRAAAERVGVVTRQ

SEQ ID NO: 3396 - protein, 141 aa, Oryza sativa
GDEVSKQGLLFLNFKEKITIANDDAGFQLGVIGSLALSVASSVAIVICNKALISTLGFPFATTLTSWHLMMTFCTLHVAQRLHFFEPKAIDGQTVILFGLLNGTSIGLSNLSLGFNSIGFYQMTKLGIIPFTVLLETNLLK

SEQ ID NO: 3397 - protein, 211 aa, Oryza sativa
  unsure (1)..(211): unsure at all Xaa locations
GDEVSKQGLLFLNFKEKITIANDDAGFQLGVIGSLALSVASSVAIVICNKALISTLGFPFATTLTSWHLMMTFCTLHVAQRLHFFEPKAIDGQTVILFGLLNGTSIGLLNLSLGFNSIGFYQMTKLAIIPFTVLLETIFLKKRFSESIKLSLLVLLLGVGIASVTDLKLNLLGSVLSGLAIETTCVAQILTNTIQKRLKVFSTHLLYQSGX

SEQ ID NO: 3398 - protein, 243 aa, Oryza sativa
  unsure (1)..(243): unsure at all Xaa locations
XHASGYEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTEDGGDEVKEASKGDACEGQ

SEQ ID NO: 3399 - protein, 702 aa, Oryza sativa
MATHERKTIDLEQGWEFMQKGITKLKNILEGKPEPQFSSEDYMMLYTTIYNMCTQKPPHDYSQQLYEKYRESFEEYITSMVLPSLREKHDEFMLRELVKRWSNHKVMVRWLSRFFHYLDRYFISRRSLPQLSEVGLSCFRDLVYQEIKGKVKSAVISLIDQEREGEQIDRALLKNVLDIFVEIGLTSMDYYENDFEDFLLKDTADYYSIKAQTWILEDSCPDYMLKAEECLKREKERVAHYLHSSSEQKLLEVDDLSRMYRLFSRITRGLEPVSQIFKQHVTNEGTALVKQAEDAASNKKVFVRKIIELHDKYVAYVTDCFQGHTLFHKALKEAFEVFCNKGVSGSSSAELLATFCDNILKKGGSEKLSDEAIEDTLEKVVRLLAYISDKDLFAEFYRKKLARRLLFDKSANDEHERSILTKLKQQCGGQFTSKMEGMVTDLTVARDHQAKFEEFISTHSELNPGIALAVTVLTTGFWPSYKSFDINLPAEMVKCVEVFKEFYQTRTKHRKLTWIYSLGTCNINAKFEAKTIELIVTTYQAALLLLFNGVDRLSYSEIVTQLNLSDDDVVRLLHSLSCAKYKILSKEPNNRSISPNDVFEFNSKFTDKLRRLKIPLPPVDEKKKVVEDVDKDRRYAIDASIVRIMKSRKVLGHQQLVMECVEQLGRMFKPDFKAIKKRIEDLITRDYLERDKDNPNVYRYLA

SEQ ID NO: 3400 - protein, 127 aa, Oryza sativa
  unsure (1)..(127): unsure at all Xaa locations
XDKKDDEPATGVDSYGEGVYTSETVTTEVVFFGQYEYKRYKKEEKQHKLKQHLCEACALDDGAFVLYEKHEAMKDPDNAHRHKITYEIAATAAVGACGYTLHEHHEKKXDHKIAVVFTGENKHHLLC

SEQ ID NO: 3401 - protein, 335 aa, Oryza sativa
MLKLEPEFPGLPQRCDSCRSAPCAFYCLADSAALCATCDADVHSVNPLARRHRRVPMGVVAAPGAGGAFVVRPAGGVNSSWPIREGRRCDYDDDDADAAGEEDEEATSWLLFDPLKDSSDQGLPPFGDALVADFLNLGGGAGEKEDASSSKDCSSSHGKSSEGSHEFAVPGEPVPERQGFGAVSMDITDYDASNFRRGYSFGASLGHSVSMSSLENMSTVPDCGVPDITTSYLRSSKSTIDLFTAAAGSPVAAHSIMSPPQFMGAIDREARVHRYREKRKTRRFEKTIRYASRKAYAETRPRIKGRFAKRSDTDLEVDQYFSTTADSSCGVVPTF

SEQ ID NO: 3402 - protein, 446 aa, Oryza sativa; identical to SEQ ID NO: 3317

SEQ ID NO: 3403 - protein, 250 aa, Oryza sativa
AAAAAASPSTSRGSAGGRGGGDHQRLVVPSSASSMPARRCSEGESESDSEASDVSGSDGEDHSWISWYCSLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKPSQRYVPRVFGFKLHKP

SEQ ID NO: 3404 - protein, 277 aa, Oryza sativa
  unsure (1)..(277): unsure at all Xaa locations
MYKQGGGGGGGGGGGGGAGLDRKRISDALDKHLEKAVAAAAAAASPSTSRGSAGGRGGGDHQRLVVPSXXESESDSEASDVSGSDGEDHSWISWYCSLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKPSQRYVPRVFGFKLHKP

SEQ ID NO: 3405 - protein, 401 aa, Oryza sativa
  unsure (1)..(401): unsure at all Xaa locations
LSSLSLLPLHRAPLPPTSNYPPXRRLPLAPSSSPSSATRRSRAAXARLPGACRSSRRHGRGDRGGGDAAXTLLEYMGQAGAADDLVVLVAHVQSACKRIAALVASPGNAELSRGKAGGGVAVAAGRDAPKPLDELSNEIILSSLRRSGKVAVMASEENHLPIWVSNDSPYVVVTDPLDGSRNIEVSIPTGTIFGIYNRLAELDHLPEEERAQLNSLQSGTHLVASGYVLYSSATIFCISFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYEV

SEQ ID NO: 3406 - protein, 342 aa, Oryza sativa
MSSATDGAASRLGVAGALGMSVTSSVAIVICNKYLISTLGFFFATTLTSWHLMVTFCTLYVAQRLRFFEAKPIDAQTMTKLAIIPFTMLLETIFLSKKFSRSIKISLMVLLLGVGIASVTDLQLNLLGSIIAVLTIAATCVSQILTNQIQRRLKVSSTQLLYQSSPYQSAVLLVTGPFVDKLLTNRDVFAFTYTFQVVAFIVLSCSIAVCVNFSTFLVIGTTSPVTYQVLGHLKTCLILSFGYVLLRDPFTFRNVAGILVAIFGMGLYSFFSVSESRDKKLADGPSPPLPISSSQMAEMKDSEPLLGGGGGAAAKSSPWNEVKGLQSFDEVPRTAKSAFSRP

SEQ ID NO: 3407 - protein, 117 aa, Oryza sativa; identical to SEQ ID NO: 3369

SEQ ID NO: 3408 - protein, 323 aa, Oryza sativa
  unsure (1)..(323): unsure at all Xaa locations
MAMATTSSKNERWSLAGATALVTGGSKGIGRAIVEELASLGATVHTCARTEAPLNRCREELTAKGLAVTVSVCDVSLRADREALAGTVRELFGGKLSILVNCAGMSFLKPAVELTPDDCSQVMGMNFESCFHLSQLAYPLLKASQRGCIINISSIASVVAFCSLPNAVYSAAKGAMNQVTRNLAAEWANDGIRVNCVAPGFIRTPLLSEFVEGNELGRAEFSRVPMGRLGEPEDIASLVAFLSMPASSYITGQVICADGGRCLSXSGWSXFLKDILITCYVERYGRINGICLPRANQARINLSGKSTDCWVCQNDRSYPIYFK

SEQ ID NO: 3409 - protein, 153 aa, Oryza sativa
  unsure (1)..(153): unsure at all Xaa locations
SDGRSERGEERIXFRNLHLNLSRLPSIPSFLPAMLPSHLNGHSPLARRCPRLSAASPPATGDSDAAAAAADAPLAEHDRIYFQSYSHIGIHEAMIKDRVRTDAYRSAIMHHQKFIEGKVVMDVGCGTGILSVFCARAGAKCVSYKIPVLRXLX

SEQ ID NO: 3410 - protein, 248 aa, Oryza sativa
MGRGRVELKRIENKINRQVTFAKRRNGLLKKAYELSVLCDAEVALIIFSNRGKLYEFCSGQSMTRTLERYQKFSYGGPDTAIQNKENELVQSSRNEYLKLKARVENLQRTQRNLLGEDLGTLGIKELEQLEKQLDSSLRHIRSTRTQHMLDQLTDLQRREQMLCEANKCLRRKLEESNQLHGQVWEHGATLLGYERQSPHAVQQVPPHGGNGFFHSLEAAAEPTLQIGFTPEQMNNSCVTAFMPTWLP

SEQ ID NO: 3411 - protein, 198 aa, Oryza sativa
GIRHGRHSREQINMTYKIMCRIEAEELSLDASEIVIASTRQEIEEQWNLYDGFEVILARKLRARVKRGANCYGRYMPRMVIIPPGVEFGHIIHDFEMDGEEENPCPASEDPPIWSQIMRFFTNPRKPMILAVARPYPEKNITSLVKAFGECRPLRELANLTLIMGNREAISKMNNMSAAVLTSVLTLIDEYDLYGQVA

SEQ ID NO: 3412 - protein, 159 aa, Oryza sativa
  unsure (1)..(159): unsure at all Xaa locations
MKGAKSKGAAKPDAKLAVKSKGAEKPAAKGRKGKAGKDPNKPKRAPSAFFVFMEEFRKEFKEKNPKNKSVAAVGKAAGDRWKSLTXEADKASYVAKANKLKAEYNKAIAAYNKGXESTAKKAPAKEEEEDDEEESDKSKSEVNDEDDDEGSEEDEDDDE

SEQ ID NO: 3413 - protein, 246 aa, Oryza sativa
  unsure (1)..(246): unsure at all Xaa locations
XFLQRAYDQIVEDVDMQKIPVRFAITSAGLVGSEGPTNSGPFDITFMSCLPNMIVMSPSNEDELIDMVATAAMVEDRPICFRYPKGAIVGTSGTLAYGNPLEIGKGEILAEGKEIAFLGYGDVAQRCLIARSLLFNFGIQATVANARFCKPLDIDLIRMLCQQHDFLITVEEGTVGGFGSHVSQFISLDGLLDGKIKWRPIVLPDRYIEHASLTEQLDMAGLTAHHIAATALTLLGRHRDALLLMK

SEQ ID NO: 3414 - protein, 162 aa, Oryza sativa
MAAPDVKYRCFVGGLAWATDDRSLEAAFSTYGEILDSKIINDRETGRSLGFGFITFSSEQSMRDAIEGMNGKELDGRNITVNEAQSRRSGGGGGGYGGGGGGYGGGRGGGGYGGGGGGGYGRREGGYGGGGGYGGGRGGGGGGYGGSRGGGYGGDSGGNWRN

SEQ ID NO: 3415 - protein, 368 aa, Oryza sativa
  unsure (1)..(368): unsure at all Xaa locations
XSKDKFQAKGQPKFIPDNYSSVDEVTAALRDAGLESSNLILGIDFTKSNEWSGRYSFGRKSLHAISATPNPYEQAISIIGRTLSPFDDDNLIPCFGFGDASTHDQSVFSFYQDSRSCCGFEEVLERYRQIVPHLNLSGPTSFAPLIYAAISVVENSNLQYHVLVIIADGQVVTTSNTKDGKLSPQEQATIQAIVDASYYPLSIVMVGVGDGPWDAMQHFDDCIPDRAFDNFQFVNFTEIMSTSKDMPKKEAAFALAALMEIPSQYKATLFINRKHAGHVASHLRILPPPNKVLENDNAAASRPPTASSQSTGFGKNTXGIIKVCPICLTNPKDMAFQCGHLTCKECGPTLSTCPLCRVPITMRVRLYS

SEQ ID NO: 3416 - protein, 149 aa, Oryza sativa
  unsure (1)..(149): unsure at all Xaa locations
MPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGTDQKPSSXTAEVP

SEQ ID NO: 3417 - protein, 963 aa, Oryza sativa
  unsure (1)..(963): unsure at all Xaa locations
MAGNDNWINSYLDAILDAGKAAIGGDRPSLLLRERGHFSPARYFVEEVITGYDETDLYKTWLRANAMRSPREEHAXLENMTWRIWNLARKKKEFEKEEACRLLKRQPEAEKLRTDTNADMSEDLFEGEKGEDAGDPSVAYGDSTTGSSPKTSSIDKLYIVLISLHGLVRGENMELGRDSDTGGQVKYVVELAKALSSSPGVYRVDLLTRQILAPNFDRSYGEPTEMLVSTSFKNSKQEKGENSGAYIIRIPFGPKDKYLAKEHLWPFIQEFVDGALGHIVRMSKTIGEEIGCGHPVWPAVIHGHYASAGIAAALLSGSLNIPMAFTGHFLGKDKLEGLLKQGRHSREQINMTYKIMCRIEAEELSLDASEIVIASTRQEIEEQWNLYDGFEVILARKLRARVKRGANCYGRYMPRMVIIPPGVEFGHIIHDFEMDGEEENPCPASEDPPIWSQIMRFFTNPRKPMILAVARPYPEKNITSLVKAFGECRPLRELANLTLIMGNREAISKMNNMSAAVLTSVLTLIDEYDLYGQVAYPKHHKHSEVPDIYRLAARTKGAFVNVAYFEQFGVTLIEAAMNGLPIIATKNGAPVEINQVLNNGLLVDPHDQNAIADALYKLLSDKQLWSRCRENGLKNIHQFSWPEHCKNYLSRILTLGPRSPAIGGKQEQKAPISGRKHIIVISVDSVNKEDLVRIIRNTIEVTRTEKMSGSTGFVLSTSLTISEIRSLLVSAGMLPTVFDAFICNSGSNIYYPLYSGDTPSSSQVTPAIDQNHQAHIEYRWGGEGLRKYLVKWATSVVERKGRIERQIIFEDPEHSSTYCLAFRVVNPNHLPPLKELRKLMRIQSLRCNALYNHSATRLSVVPIHASRSQALRYLCIRWGIELPNVAVLVGESGDSDYEELLGGLHRTVILKGEFNIPANRIHTVRRYPLQDVVALDSSNIIGIEGYSTDDMKSALQQIGVLTQ

SEQ ID NO: 3418 - protein, 963 aa, Oryza sativa; identical to SEQ ID NO: 3417
  unsure (1)..(963): unsure at all Xaa locations

SEQ ID NO: 3419 - protein, 150 aa, Oryza sativa
  unsure (1)..(150): unsure at all Xaa locations
XGRVGAGGRRGGGGPKKKPVSRSVKAGLQFPVGRIGRYLKQGRYSQRIGTGAPVYLAAVLEYLAAEGLELAGNAARDNKKNRIIPRHVLVAIRNDEELGKMLAGVTIAHGGVLPNINPVLLPKKTGSAAAKEAKKAKSPKKATTKSPKKX

SEQ ID NO: 3420 - protein, 301 aa, Oryza sativa
  unsure (1)..(301): unsure at all Xaa locations
XPCVRPRVRSARAVTFHDFMGQNFTSEHLPVSAPGATPPGPYIAYFQPLQSSASSSSSHGGERTMDGTTYHDHWNPLPGPSDGRPLATVHPIDFHHNHWTHLPNSYSQPNSNNGVAEQMAIPVVPMRVGGLDSDSQQRGSLPSVYGNGSGSRSRIPSVPPMAPQFMRPHGNINEQYQQNSSSLYAAPQRRSAVQXXVQDSLDFTLFPQAPTGPNSMETEDAGGNQFYAWERDRFAPYPLMPVDSEANWWGSTPQSHGVTDHSAAPGRRLFGQWIGAGRSPPPPPPPPADNSSYRQMHIPRM

SEQ ID NO: 3421 - protein, 142 aa, Oryza sativa
  unsure (1)..(142): unsure at all Xaa locations
XPKTPGLTFYLKMKGDYHRYLAEFKTGAERKDAADATLAAYQAAQDIAMKELSPTHPIRLGLALNFSVFYYEILNSPDRACTLAKQAFDEAISELDTLGEESYKDSTLIMQLLRDNLTLWTSDMQDDGGDEMRDATKPEDEH

SEQ ID NO: 3422 - protein, 288 aa, Oryza sativa
  unsure (1)..(288): unsure at all Xaa locations
YSKKGDDDDDDGGGRXGGVAPFVAKTYRMVDDPATDGVIAWGRDSNSFVVADPFAFSQTLLPAHFKHSNFSSFVRQLNTYGFRKVDPDRWEFAHVSFLRGQTHLLRRIVRRSSGGGGAKRKEEAGVVAMEVARLRREQREIEGRGAAVWRRVHDAERPPVPMLAFLVKVVGDPQVLRRLXRQGQHQRRRLQRRRLRRVIRSRGRASSSTHPPPPPPTATATSSPPPQTGSTPAAAARRPPAAAFVPDDAVDFTGLYTGXATGSATPSSTPASTTRRRTRSRWWTAATX

SEQ ID NO: 3423 - protein, 92 aa, Oryza sativa
  unsure (1)..(92): unsure at all Xaa locations
RRHKPNEGLRRVGGVAGDEAAGGSGGREGRCGDXLKPRTGRHAQTALKKGECVDYIPTREYYHRHTRGLYWEGKLVLPFXDQFWFRFLLGWL

SEQ ID NO: 3424 - protein, 203 aa, Oryza sativa
MGDWVPRGRPGSRTRIRRPKKRKKKEKQSSTPSSAAGTSLARLAMDAAGAGAGGKLKKGAAGRKAGGPRKKAVSRSVKAGLQFPVGRIGRYLKKGRYAQRIGTGAPVYLAAVLEYLAAEVLELAGNAARDNKKNRIIPRHVLLAIRNDEELGKLLAGVTIAHGGVLPNINPVLLPKKTAEKAPPAGKEAKSPKKAPGKSPKKA

SEQ ID NO: 3425 - protein, 211 aa, Oryza sativa
  unsure (1)..(211): unsure at all Xaa locations
FHRSKHISPRPISIRQVSTAARAPVKLYRGVRQRHWGKWVAEIRLPRNRTRLWLGTFDTXEEAALAYDSAAFRLRGESARLNFPELRRGGAHLGPPLHAGVDAKLHAICHGMDXXPQPQPQTQSNATTTTMSTTATNTPSPFFSSESPVVKSEPVCSASESSSSADGDVSSTGSSDVVPEMQPPWDESVLHKYPSLEIDWDAILSXMQWLN

SEQ ID NO: 3426 - protein, 572 aa, Oryza sativa
LLRSSILAVAALLLFSVNLAKGDIREYQFDVKTTNVTRLCSSKSIVTVNGQFPGPTVFAREGDLVVIRVINHSPYNMSIHWHGIRQLRSGWADGPAYITQCPIQPGGSYVYKYTITGQRGTLWWHAHISWLRATVYGPIIILPKAGVPYPFPAPDKEVPVVFGEWWKADTEAVISQATQTGGGPNVSDAFTINGLPGPLYNCSAKDTFKLKVEAGKTYMLRLINAALNDELFFSIAGHTLTVVDVDAVYVKPFTVDTLLITPGQTTNVLLTTKPSYPGATFYMLAAPYSTAMSGTFDNTTVAGILEYEDPSSHSTAAFNKNLPVLRPTLPQINDTSFVSNYTAKLRSFATAEYPANVPQQVDTRFFFTVGLGTHPCAVNGTCQGPNGSRFAAAVNNVSFVLPSTALLQSHYTGRSNGVYASNFPAMPLSPFNYTGTPPNNTNVSNGTRLVVLPYGASVELVMQGTSVLGAESHPFHLHGFNFFVVGQGFGNFDPVNDPAKYNLVDPVERNTVGVPAAGWVAIRFLVDNPGVWFMHCHLEVHVSWGLKMAWVVQDGSLPNQKILPPPSDLPKC

SEQ ID NO: 3427 - protein, 184 aa, Oryza sativa
  unsure (1)..(184): unsure at all Xaa locations
PGLQESARGNDKSGSDENYDGGLLFSWAMHQISNHLTTLQVMLPNITEGGSLSFFLXSICMYCAMGLGLVGLDFRGLLPPIFEKAVLNLFSKNMGTAVENFQVVLDSHRWVPMPSVGFVANGVVDETSDDVTPPSVLMEHPPLAVFVNGVSAAMNELRPCAPLSLKNVLAEEVVKGLQAVSDSX

SEQ ID NO: 3428 - protein, 168 aa, Oryza sativa
  unsure (1)..(168): unsure at all Xaa locations
MAPANKAERKAVLDAGAWMFNVVTSVGIIMVNKALMATHGFSFATTLTGLHFATTTLMTLVMKWLGHIQPSYLPLPELVKFVFFXANLSIVGMNVSFMWNSVGFYQIAKVCIIPVLCILEILFDKVRYSRNTKLSIGPAXVAAPACTVTDVSVNSKGLLAAVIAVWSX

SEQ ID NO: 3429 - protein, 325 aa, Oryza sativa
  unsure (1)..(325): unsure at all Xaa locations
MEINSSGEEAVVKVRKPYTITKQRERWTEAEHNRFLEALKLYGRAWQRIEEHVGTKTAVQIRSHAQKFFTKLEKEAINNGTSPGQAHDIDIPPPRPKRKPNSPYPRKSCLSSETSTREVQNDKATISNMTNNSTAQMAGDAALEKLQRKEISEKGSCSEVLNLFREVPSASFSSVNKSSSNHGASRGLEPTKTEVKDVVILERDSISNGAGKDAKDINDQEMERHGIHISSKPDHSHENCLDTSSQQFKPKSNSRSFAPMSSTFSSMLVSTLLSNPAIHAAARLAASYWPTVDGNTPDPNQENLXLRVLKEATLALXPTWHLLSX

SEQ ID NO: 3430 - protein, 350 aa, Oryza sativa
MGSSCSRSHSLSEAETTKNAKSADIDRRILQETKAEQHIHKLLLLGAAESGKSTIFKQILYEGAKELSQVESDSSKYVISPDNQEIGEKLSDIDGRLDYPLLNKELVLDVKRLWQDPVIQETYLRGSILQLPDCAQYFMENLVRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDICEKKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 3431 - protein, 364 aa, Oryza sativa
MGSSCSRSHSLSEAETTKNAKSADIDRRILQETKAEQHIHKLLLLGAGESGKSTIFKQIKLLFQTGFDEAELRSYTSVIHANVYQTIKILYEGAKELSQVESDSSKYVISPDNQEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 3432 - protein, 405 aa, Oryza sativa
  unsure (1)..(405): unsure at all Xaa locations
MSVLTCVLDNMGSSCSRSHSLSEAETTKNAKSADIDRRILQETKAEQHIHKLLLLGAGESGKSTIFKQIKLLFQTGFDEAELRSYTSVIHANVYQTIKVCNTGKXILYEGAKELSQVESDSSKYVISPDNQEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDIFEKKIQKVPLSVCEWFKDYQPIAPGKQEVEHAYEFVKKKFEELYFQSSKPDRVDRVFKIYRTTALDQKLVKKTFKLIDESMRRSREGTXFRAKTRL

SEQ ID NO: 3433 - protein, 338 aa, Oryza sativa
  unsure (1)..(338): unsure at all Xaa locations
XGLQEFGTRXLLKVKAELKQCDLLNSSNLVCSVGFDRDKEFFATAGVNKKIKVFEYNMIVNARRDIHYPVVEMSNRSKLSCICWNSYMKSHIASSDFEGIVQVWDVTRSQVFVEMREHERRVWSVDFSLADPTKLVSGSDDGSVKLWNMNQAGSVGTIRTRANVCSVQFQPDSARSIAIGSADHKVSRFHLXRAGRAPWRSLVGRTCTLCAVSSGVASSLGSASTGSPLLLRGSSMRPASLFDSPLRTFXSHTNTKNFVGLSISDGYIATGSETNXVFVYHKAFXMPVLGIXFRVTDPYQAXEIDDPSQFISCVCWRGQSSTLLSANSSGNIKILEMD

SEQ ID NO: 3434 - protein, 158 aa, Oryza sativa
  unsure (1)..(158): unsure at all Xaa locations
XRGILTGRRDKMPTMRQTNGCGGFTKRSESEYDSFGTGHSSTTISAALGMAVGRDLKGGKNNVVAVIGDGAMTAGQAYEAMNNAGYLDSDMIVILNDNKQVSLPTATLDGPAPPVGALSSALSKLQSSRPLRELREVAKGEDKKTKNSVAGXAYNYYE

SEQ ID NO: 3435 - protein, 212 aa, Oryza sativa
  unsure (1)..(212): unsure at all Xaa locations
SSVFRLKETQVAKMTAGFQLGVIGSLTLSVASSVSIVICNKALISTLGFPFATTLTSWHLMVTFCTLHVAQRMRFFEPKAIDGQTVILFGLLNGTSIGLLNLSLGFNSIGFYQMTKLAIIPFTVMLETIFLKKRFSESIKFSLLILLPGVRVPSVPNSQLKFVPNVIFVLTKSFGNCAKKKQSNIIKRKIXLVSXLLFWSSILNSPCRLAVX

SEQ ID NO: 3436 - protein, 531 aa, Oryza sativa
  unsure (1)..(531): unsure at all Xaa locations
MDGCDCIEPLWPTDELLIKYQYISDFFIALAYFSIPLELIYFVKKSSFFPYRWVLIQFGAFIVLCGATHLINLWTFTTHTKTVAMVMTVAKVSTAVVSCATALMLVHIIPDLLSVKTRELFLKNKAEQLDREMGLIRTQEETGRHVRMLTHEIRSTLDRHTILKTTLVELGGTLGLEECALWMPSRSGSSLQLSHTLRHQITVGSTVSINLPVVNQVFSSNRAIIIPHTSPLARIRPLAGRYVPPEVAAVRVPLLHLSNFQINDWPELSAKSYAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMSFIKPIAAIKRLSVSVMLAPDLPLCAIGDEKRLMQTILNISGNAVKFTKEGHITLVASVVKADSLREFRTPDFHPTASDDNFYLKVQXKDSNCLNGFPWLRSMX

SEQ ID NO: 3437 - protein, 749 aa, Oryza sativa
MAILSDVATEVLIPIAAIIGIGFSIAQWVLGSRINRYADYLIEEEEGLNGHDVLLIYDEIQTAISEGATSFLFTEYQYVGVFMSIFAVVIFLFLGSVEGFSTKSQPCTYSKDKYCKPALFNALFSTASFLLGAITSLVSGYLGMKIATFANARTTLEARKGVGKAFIIAFRSGAVMGFLLASSGLVVLYIAINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLITTLFATDFFEIKAVKEIEPALKKQLIISTALMTVGIALISWLALPAKFTIFNFGAQKEVTNWGLFFCVAIGLWAGLIIGFVTEYYTSNAYSPVQDVADACRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTGKPDYANCVKISTDASIKQMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATHGGLLFKWF

SEQ ID NO: 3438 - protein, 767 aa, Oryza sativa
MAILSALGTEVFIPVAAAVGVAFAVAQWLLVARVKVNPAHAAAAAASGGSKNGGYGDYLIEEEEGLNDHNVVVKCHEIQTAISEGATSFLFTEYQYVGIFMSIFAVVIFLFLGSVEGFSTKSQPCTYSKDKYCKPALFNALFSTASFLLGAITSLVSGYLGMKIATFANARTTLEARKGVGKAFIIAFRSGAVMGFLLASSGLVVLYIAINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSMGIIVCLITTLFATDFFEIKAVKEIEPSLKKQLIISTALMTVGIALVSWLALPYKFTIFNFGEQKEVTNWGLFLCVSIGLWAGLIIGYVTEYYTSNAYSPVQDVADACRTGAATNVIFGLALGYKSVIIPIFAIALGIYVSFTIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNSIPGLMEGTGKPDYANCVKISTDASIKQMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATHGGLLFKWF

SEQ ID NO: 3439 - protein, 263 aa, Oryza sativa
  unsure (1)..(263): unsure at all Xaa locations
MSQPAELSREENVYMAKLAEQAERYEEMVEFMEKVAKTVDSEELTVEERNLLSVAYKNVIGARRASWRIISSIEQKEESRGNEDRXCTLIKEYRGKIETELSKICDGILKLLDSHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDAAEEIKEAPKGESGDGQ

SEQ ID NO: 3440 - protein, 251 aa, Oryza sativa
MSQQGEYHAEMMAEFLRGSGGAAVIDGGLATELEANGADLKDALWSARCLFTCPDLIRKVHLDYLEAGASVLITGSYQATIQGFLSKGFSQEESESFLRRSVELACEARAIYLEKCSNGSDEAKDVTKYRKRPILIAASVGSYGAYLADGSEYSGDYGNEGTLEFLKNFHLRRLQVLAEAGPDVIVFETIPNKIETQGFLEMLPFRLRPSAAVVPLLSGEEPPSPPSPERATVATATTTTITILVSRQVFD

SEQ ID NO: 3441 - protein, 253 aa, Oryza sativa
  unsure (1)..(253): unsure at all Xaa locations
LSSDLSPPRSPSRPRRRRTPPNRPPGSNRQLRQRQWFATAPGSPVASAAAELDFDDTGLRPRLPGPRAPAXRPPAPSSCPPPSPTSTSPSSTTSPPASKRASPSAHDPRARVVGRPPERAFRKHAXRGVGGXXSSRKAKFVKVALDGAPYLRKVDLEAYRGYDQLLAALQDKFFSHFTIRKLGNEEMKLVDAVSGNEYVPTYEDKDGDWMLVGDVPWKMFVETCQRLRLMKSSEAVNLAPRSAXXVANLCSCL

SEQ ID NO: 3442 - protein, 195 aa, Oryza sativa
  unsure (1)..(195): unsure at all Xaa locations
XPPPPPQPQPQAAKKSRRGPRSRSSQYRGVTFYRRTGRWESHIWDCGKQVYLGGFDTAHAAARAYDRAAIKFRGVEADINFNLSDYEEDMRQMKSLSKEEFVHVLRRQSTGFSRGSSKYRGVTLHKCGRWEARMGQFLGKKYIYLGLFDSEVEAARAYDKAAIKCNGREAVTNFEPSTYDGELNSTGINSDFTXX

SEQ ID NO: 3443 - protein, 161 aa, Oryza sativa
MAAPDVEYRCFVGGLVFATDDRSLEAAFSTYGEILESKIINDRETGRSRGFGFVTFSSEQAMRDAIEGMNGKELDGRNITVNEAQSRRSGGGGGGGYGQRGGGGGYGGGGYGGGGGGGGYGQRREGGYGGGGGYGGGRGGGGYRGGYRSRGGGNSDGNWRN

SEQ ID NO: 3444 - protein, 250 aa, Oryza sativa
  unsure (1)..(250): unsure at all Xaa locations
KKINFVRQESDEAMGNLLLFWTNHVRCAHYRRRCRIRAPCCNEIFDCRHCHNETKNSIKIDAVKRHELPRHEVQQVICSLCGTEQEVRQVCISCGVCMGKYFCEVCKLFDDDVSKQQYHCNGCGICRIGGKENFFHCSKCGCCYSIVLKNSHACVEGAMHHDCPICFEYLFESTNDVSVLPCGHTIHVKCLREMEEHCQFACPLCSKSVCDMSKAWERLDEELATISDTCDNKMVMLSXLCSSVVSRNXX

SEQ ID NO: 3445 - protein, 361 aa, Oryza sativa
MASGTDEKAKMEGLTSAAAFVEGGIQDACDDACSICLEAFCESDPSTLTGCKHEFHLQCILEWCQRSSQCPMCWQPISLKDPTSQELLEAVERERNVRTNQTRNTTIFHHPALGDFEVQHHLAAARAMGRAHHLGRREGHRGRSGSHGRPQFLVFSSHPNMPSAGSVSSSSVQGEVDNESSPVHTTGELSLHANTHEEAGNQSPGMLTYDADQDAVVSSGNSTPTGQSTPVNNDRAGPSDLQSFSDSLKSRLNAVSMKYKESITKSTRGWKERLFSRHSSVADLGSEVRREVNAGIASVSRMMERLETRGSNGRTSDGPAISTSEVIPSTESSNERVTAAATSSGNTSASSAPCVTTTGSN

SEQ ID NO: 3446 - protein, 579 aa, Oryza sativa
MTMAISSALPSPLLLAASLLLLIVQAQGITRHYEFNVQMANATRLCNTKSMVTVNGQCPGPELVAREGDRVVIRVTNNVAHNISLHWHGVRQVRTGWADGPAYITQCPIQTGQSYVYNFTVAGQRGTLWWHAHISWLRATVYGALVILPKLGVPYPFPAPHKEVPVIFGEWWNADTEEVVNQAVQTGGGPNVSDAFTINGLPGPLYNCSAQDTFKLKVKPGKTYMLRLINAALNEELFFAVANHTLTVVEVDAVYVKPFTVDTLVISPGQTTNVLLTAKPYYPGANFYMSAAPYSTARPGTFGNTTVAGILEYENPAMSPSAASFVKGLPLFKPTLPQLNDTDFVTNFTDKLRSLATPEYPAAVPQSVDKRFFFTVGLGTLPCPANMTCQGPNNTQMAASMNNVSFVLPARALLQSHFTGLSSGVYAPDFPVAPLSPFNYTGTPPNNTNVKTGTKLLVLRYNTSVELVMQDTSILGIESHPLHLHGFNFFVIGQGFGNYDAVNDPAKFNLVDPVERNTVGVPAGGWVAIRFLADNPGVWFMHCHLEAHTTWGLRMAWLVLDGSHPNQKLLPPPSDLPKC

SEQ ID NO: 3447 - protein, 297 aa, Oryza sativa
  unsure (1)..(297): unsure at all Xaa locations
MKFGAIYEEYLREQQDKSKCSHVEYKRLKKVLKKCRVGRSLXKKTAPMVTSRRGTTNHICSNSCTLCDQMFFTELTKEASEIAGCFSSRVQRLLNLHVPSGFLRYIWRVRQCFIDDQQIMVQEGRMLLNYVTMNAXIAIRKILKKYDKIHGSVSGRDFKSKMQTDHIELLQSPWLIELGAFHLNCNSSDIDETVGFLKXXEFFKNFSCDLTEARPLMTMAISETMKYEYSLTCPICLDTLFNPYALSCGHLFCKGCACGAASVYIFQGVKSAPPEAKCPVCRSDGVFAHAVHMTELX

SEQ ID NO: 3448 - protein, 204 aa, Oryza sativa
  unsure (1)..(204): unsure at all Xaa locations
MSVLTYVLDNIGSSCSRSHSLSEAETAENAKXAGESGKSTIFKQIKLLFQTGFDEAELRSYTSVIHANVYQTIKVCNTGKXILYEGAKELSQVESDSSKYVISPDNQEIGEKLSDIDGRLDYPLLNKELVLDVKRVWQDPAIQETYLRGSILQLPDCAQYFMENLDRLAEADYVPTKSDELWSAIRGDDCVEYGYVHPECRRQX

SEQ ID NO: 3449 - protein, 627 aa, Oryza sativa
LAVLVSDQVPDVLIGDPWRFRQIITNLVGNSMKFTEQGHIFIRVHLIEEVKRKMEALDDTSPENIEVTANSKNTMPYNTLSGLEVANNRKTLESFRMFKDSSDAIDSVNLLVTVEDTGIGITKDAQTRIFTPFMQADGSTSRTYGGTGIGLSITKRLVELMGGEIGFVSKPGVSSTFSFTAIFKENRKDPGDIKRYCPEPTPPDFQGMRALVVDGRCARAEVTMYHLRRLGIQCDLAATSESALSALLESCNSSVKSSLNMVLVDKEAWGEDSGLAFFRCLIDLRLKGTLKSWQTMPKFFLLAGSITPADSDCLRLAGYSNSIRKPLRLSTVAACLSKALGVGLTGRRSRDNSLVLRSVLTGKNILVVDDNAVNRIVAAGALKKYGAIVTCVDSGKEAISRLQPPHKFDACFMDVQMPEMDGFEATRLVRSVESKINDTIQAGEVSSEIYGNKAHWHVPILAMTADVIQATFEGSSAKNPFGDNNIAKQKSYAVNREQKFDWTAIYVSFEPTHPDSNTFNTGRAGPDRGRAVQPHWAPQIVGAPPHPPRSLYAAVAQVTGANMLCNDTEQKLQTQRRSQFLPMRRDCRRTALHDSSRVVVVVGGGGGTSVRGAVTPWSSAIDCNRIC

SEQ ID NO: 3450 - protein, 236 aa, Oryza sativa
MTGGPGGGPAPRVIAGRGVAGAKRRRSRESARLSPGEDSAMKGAKSKGAAKPDAKLAVKSKGAEKPAAKGRKGKAGKDPNKPKRAPSAFFVFMEEFRKEFKEKNPKNKSVAADKAPYVAKANKLKAEYNKAIAAYNKGESTAKKAPAKEEEEDDEEESDKSKSEVNDEDDDEGSEEDEDDDECDILKTETDEIKNGFGDCRMKTMTSEPSSGQDGSSKTLRAAGVLRSLSIIIIVY

SEQ ID NO: 3451 - protein, 157 aa, Oryza sativa
MKGAKSKGAAKPDAKLAVKSKGAEKPAAKGRKGKAGKDPNKPKRAPSAFFVFMEEFRKEFKEKNPKNKSVAAVGKAAGDRWKSLTEADKAPYVAKANKLKAEYNKAIAAYNKGESTAKKAPAKEEEEDDEEESDKSKSEVNDEDDDEGSEEDEDDDE

SEQ ID NO: 3452 - protein, 158 aa, Oryza sativa
  unsure (1)..(158): unsure at all Xaa locations
MKGAKSKGAAKPDAKLAVKSKGAEKPAAKGRKGKAGKDPNKPKRAPSAFFVFMEEFRKEFKEKNPKNKSVAAVGKAAGDRWKSLTEADKAPYVAKANKLKAEYNKAIAAYNKGESTAKKAPAKEEEEDDEGESDQSKSRXVNDEDDDEGSEEDEDDDE

SEQ ID NO: 3453 - protein, 164 aa, Oryza sativa
  unsure (1)..(164): unsure at all Xaa locations
MGTSGRPGSSLLWWCGCVPVSPPSSSPFPSSLPPSHKRERAPDSPQDSAMKGAKSKGAAKPDAKLAVKSKGAEKPAAKGRKGKAGKDPNKPKRAPSAFFVFMEEFRKEFKEKNPKNKSVAAVGKAPGDRWKSLTEADKAPYVAKANKLKAEYNKAIAAYNKGEX

SEQ ID NO: 3454 - protein, 731 aa, Oryza sativa
  unsure (1)..(731): unsure at all Xaa locations
MVEPFLLVNGGIGKENRSSLLRVYIPRPLRQKPLFRSSSSSPKNLIKIPSPKNPSHPNFLMDSVPAAGVGVGGGGAGAGYPESTESSPRSRGGDSWDEPFPSSAAAAAAAAGGGRLRLMCSFGGRIVPRPTDKSLCYLGGETRIVAVERNASLADVHARLSRSLLGGQPFTLKYQLPNEDLDSLISVSTDEDLDNLVDEYDRIAATSSGGGSSRTSRIRLFLFPAKPESSSSLGSLLDDSSKSESWFVDALNSAISGSLDGIPRGISTDSASVNCLLGLEDDSSTHSRGGPPNSSPAEEQRANQQKLAAAAAVAAARHPHDVQSVPDSPMIDKNSVSGSTSHAPSLSKLPPLRVRXEDRSPDSRLAAQNPVEVHFPQLGIPVQPGQPVMGGYMQPPPRXPFPSLPAPGSPPPGPSSRVLADDDDPGHGRGGGGKAQTPEPEXPPVADPTNRAMYYNDRSPPAELKRDMPVGTDAASYRVPVPAQDAAAAAAAAAAAAQQPPAGYVYAQMHAPPPQQQPPPPQQQQPVPQQYVTAQNQHFIHNPATGTFIPIQSYYHHPVPQQAPQPPMPQPVPQPQQSHAFDPNTGMYYIPMRTNAPQAYSMPPGAAAVPPPTLVDTTPKPTVPIPQMAVKQPELQQPGLYRTTAAPTPVPASNAPAYAGMGYHHVIQTHHHPAPQPAATVAGNFGYDYGDPTRAQVFYSQAAAPPTLPPQYQPMGSPDAGQADLKQARAS

SEQ ID NO: 3455 - protein, 1084 aa, Oryza sativa
  unsure (1)..(1084): unsure at all Xaa locations
MAGNEWINGYLEAILDSGGAAGGGGGGGGGGGGGGGGGGGGGGGGVDPRSPAAGAASPRGPHMNFNPTHYFVEEVVKGVDESDLHRTWIKVVATRNARERSTRLENMCWRIWHLARKKKQLELEGILRISARRKEQEQVRRETSEDLAEDLFEGEKADTVGELAQQDTPMKKKFQRNFSELTVSWSDENKEKKLYIVLISLHGLVRGDNMELGRDSDTGGQVKYVVELARALAMMPGVYRVDLFTRQVSSPEVDWSYGEPTEMLTSGSTDGEGSGESAGAYIVRIPCGPRDKYLRKEALWPYLQEFVDGALAHILNMSKALGEQVSNGKLVLPYVIHGHYADAGDVAALLSGALNVPMVLTGHSLGRNKLEQIMKQGRMSKEEIDSTYKIMRRIEGEELALDAAELVITSTRQEIDEQWGLYDGFDVKLEKVLRARARRGVSCHGRFMPRMVVIPPGMDFSSVVVPEDTSDGDDGKDFEIASPRSLPPIWAEVMRFLTNPHKPMILALSRPDPKKNITTLVKAFGECRPLRELANLILIMGNRDDIDEMSAGNASVLTTVLKLIDKYDLYGSVAFPKHHKQSDVPEIYRLTGKMKGVFINPALVEPFGLTLIEAAAHGLPIVATKNGGPVDIKNALNNGLLVDPHDQHAIADALLKLVADKNLWQECRKNGLRNIQLYSWPEHCRTYLTRIAGCRIRNPRWLMDTPADAAAEEEEALEDSLMDVQDLSLRLSIDGERGSSMNDAPSSDPQDSVQRIMNKIKRSSPADTDGAKIPAEAAATATSGAMNKYPLLRRRRRLFVIAVDCYGDDGSASKRMLQVIQEVFRAVRSDSQMSRISGFALSTXMPLPETLKLLQLGKIPPTDFDALICGSGSEVYYPSTAQCVDAGGRLRPDQDYLLHINHRWSHDGAKQTIAKLAHDGSGTNVEPDVESCNPHCVSFFIKDPNKVRTMDEMRERVRMRGLRCHLMYCRNATRLQVVPLLASRSQALRYLFVRWGLSVGNMYLIVGEHGDTDHEEMLSGLHKTVIIRGVTEKGSEQLVRSSGSYQREDVVPSESPLIAFTKGDLKADEIMRALKEVTKAASGM

SEQ ID NO: 3456 - protein, 386 aa, Oryza sativa
  unsure (1)..(386): unsure at all Xaa locations
MAEQANQPTVLQKFGGQFHLGSSFSEGVRARNICPSVSSYDRRFTTRSYMTQGLVNGGINVPMMSSSPIFANAPAEKGGKNFMIDFLMGGVSAAVSKTAAAPIERVKLLIQNQDEMIKAGRLSEPYKGIGDCFGRTIKDEGFXASLWRGNTANVIRYFPTQALNFAFKDYFKRLFNFKKDKDGYWKWXFGGNLASGGAAGASSLFFGYSLDYARXRLANDAKAAKGGGERQFNGLVDVYRKTLKSDGIAGLYRGFNISCVGIIVYRGLYFGMYDSLKPVVLTGSLQDNFFASFALGWLITNGAGLASYPIDTVRRRMMMTSGEAVKYKSSMDAFFQILKNEGASHXXKGAGANILPAXAGAWVLSGMTSANLFFGKKRFGVPKWKN

SEQ ID NO: 3457 - protein, 102 aa, Oryza sativa
  unsure (1)..(102): unsure at all Xaa locations
PKDQVGGGGKHEKKMPRRPSGGGGGAGPAAAAVRKVPLRKLLRAASVACGVQFGWALQLSLLTPYVQELGIPHAFASLVWLCGPLSGLLVQPLVGHLSDRIX

SEQ ID NO: 3458 - protein, 295 aa, Oryza sativa
  unsure (1)..(295): unsure at all Xaa locations
PRVRGNVKQIASNRGNKEFLGLLPLLVGNVGLIFTKGDLKEVREEVAKYKVGAPARVGLVAPVDVVVPPGNTGLDPSQTSFFQVLNIPTKINKGAVEIITPVELIKKGDKVGSSESALLAKLGIRPFSYGLVITNVYDSGSVFSPEVLDLTEDDLMEKFASGVSMVASVSLAISYPTIAAAPHMFLNGYKNVLAVAVGTEYSYPHADKIKEYLKDPSKFAVAXPIARDSGAAAPSAAKEEENKEEPQEESNGDLGMSPFTKPVALCCKLKVCSSSNSEVVVILALLALAECSTTA

SEQ ID NO: 3459 - protein, 87 aa, Oryza sativa
  unsure (1)..(87): unsure at all Xaa locations
XYPTIAAAPHMFLNGYKNVLAVAVETEYSYPHADKIKEYLKDPSKFAVAAPVSPDSGAAAPSAAKEEEKKEEPEEESDGDLGMSLFD

SEQ ID NO: 3460 - protein, 196 aa, Oryza sativa
  unsure (1)..(196): unsure at all Xaa locations
MLKIKNKLRCSELETKLSTLQRYGKRLSRRGSCPGHHRTPPTGTTTGSSESALLAKLGIRPFSYXGLVITNVYDRGSVFSPEVLDLTEDDLMEKFASGVSMVASVSLAISYPTIAAAPHMFLNGYKNVLAVAVGTEYSYPHADKIKEYLKDPSKFAVAALVAADSGAAAPSAAKEEEKKEEPQEESDGDLGMSLLD

SEQ ID NO: 3461 - protein, 175 aa, Oryza sativa
  unsure (1)..(175): unsure at all Xaa locations
SPGREHIAPPLLSRASVRRLVSVKNRRLPPSASAAALPNSGDDYSQGCSGSVNSFCGRTEKAFICXMASKLQAFWNHPAGPKTIHFWAPTFKWGISIANVADFAKPPEKISYPQQVAVACTGVIWSRYSMVITPKNWNLFSVNVAMAGTGLYQLSRKIRKDYFSDEKDAAASLEG

SEQ ID NO: 3462 - protein, 312 aa, Oryza sativa; identical to SEQ ID NO: 3113

SEQ ID NO: 3463 - protein, 207 aa, Oryza sativa
  unsure (1)..(207): unsure at all Xaa locations
XVEDRVAATAGYLGGAFDVESLVENLLRQLAGNQELVVNVYDVTNHSNPLVMYGSEVPLGIPSPSHTYTLDFGDPLRKHQIVCRYRNKLHVSWSAITTPSGVFVICMLVGYIIYAAWSRYDNVKEDCRKMEALKKRAEAADIAKSQFLATVSHEIRTPMNGVLGMLDMLLDTELNSTQRDYAQTAQVCGKALISLINEVLDSAKIEA

SEQ ID NO: 3464 - protein, 108 aa, Oryza sativa
  unsure (1)..(108): unsure at all Xaa locations
ARGPPSLLSLAADFAMGGAAAVVAKTGAAPVERVKLLLQNQAEMLRRGSLTRPYRGIADAFGRVLREEGVAALWRGNQANVIRYFPTQAFNFAFKGYFKSIFGYDKEX

SEQ ID NO: 3465 - protein, 329 aa, Oryza sativa
MAEEAAAGGLYYCHMCASTVSAVAAAEGEVEIKCPYCHSGFVEEIESARGVATGGGGAISSVWAPIIDGMVGGGGGDAVRRHRRSRRLADAAGADDGYYRDLALLDFSESRRRTAALLLLMQEFRERQLQRLESATATISAAAAEAGAVVGTSRDAEGVALADYFLGPGLDALMQRVGDGDAGRQGTLPAKKEAVESMPTVEVAAGGDCDSACAVCLEDYAAGERATEMPCRHRFHAKCIVPWLKMHSSCPVCRFQLPTDDDDDSSKSARGGAAHSGGGRRLSQPAPRVDGGGLGRLPAVMQELRSILSQPSPASTSGSSSHAQQHSDE

SEQ ID NO: 3466 - protein, 170 aa, Oryza sativa
  unsure (1)..(170): unsure at all Xaa locations
MGMASFTRQPFYCKSLACHHQQNPASTIVAIDKNLDTSTPDTYRAPPTPLPYDVGLVLKDNPDLEKTGIKRKIHEHKESLMMDDNESLQKCVSEDKPDEEDVCPICLEVFRYSPEYDEENPRSMTKCEHHFHLCCILEWMERSETCPVCDQDLIATSQSDSTXNWEQGPL

SEQ ID NO: 3467 - protein, 50 aa, Oryza sativa
MGKKITVDSATLFNKGLEVIEAHYLFGAEYDDIEIVIHPQSIIHSMIETQ

SEQ ID NO: 3468 - protein, 87 aa, Oryza sativa
  unsure (1)..(87): unsure at all Xaa locations
XKEEKQHKPKPDLGEGGALGGGAFLLDEKHQAKKDPENAHRHKITEEIAATGGVGARGYTFHEHHEKKKDHKSAEESTGEKKHHLFG

SEQ ID NO: 3469 - protein, 127 aa, Oryza sativa
  unsure (1)..(127): unsure at all Xaa locations
XAAAASAPRPYTKHIXYYFLTTCQVVPFIGFAVAMFMFYSLVPILLKISGSTMLNLSLLASDMWAILIRVFAYHEKVDWMYYVAFGVVAIGLVIYSGYSSGQVAEATDVEGKLPDEEEAAVHPKCQG

SEQ ID NO: 3470 - protein, 572 aa, Oryza sativa
  unsure (1)..(572): unsure at all Xaa locations
XGAAARPSSPLHSFXNLLDGAGPASLLRFLGTXAPMVFNVVIMSPHGYFAQANVLGYPDTGGQVVYILDQVRAMENEMLLRIKQQGLNITPRILIVTRLLPDATGTTCGQRLEKVLGTEHTHILRVPFRTENGIVRKWISRFEVWPYLETFTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADMSIYFPYSESRKRLTSLHPEIEELLYSEVDNNEHKFMLKDRNKPIIFSMARLDRVKNLTGLVELYGRNPRLQELVNLVVVCGDHGNPSKDKEEQAEFKKMFDLIEQYNLNGHIRWISAQMNRVRNGELYRYICDTKGAFVQPAFYEAFGLTVVESMTCGLPTFATAYGGPAEIIVNGVSGFHIDPYQGDKASALLVEFFEKCQEDPSHWTKISQGGLQRIEEKYTWKLYSERLMTLTGVYGFWKYVSNLERRETRRYLEMLYALKYRTMASTVPLAVEGEPSNK

SEQ ID NO: 3471 - protein, 368 aa, Oryza sativa
  unsure (1)..(368): unsure at all Xaa locations
PARLRSRITLPGGRSPVPPMDPAASAAESSSLSSRDVAAMPDSPPRRAGHRRAQSEILLGAALPDDIAFVGGGGGDDYEEEEEDDEEEEMEGAGGSXDVRDVPRGRGQARDPGARGAAAAAAXARPRHQHSMSMDGSTSLASSAAGVAGRMGADAKKAISDAKLAELALVDPKRAKRILANRQSAARSKERKMRYIAELERKVQTLQTEATTLSAQLSMLQRDTTGLTSENSDLKIRVQTMEQQVRLQDALNDRLRDEIQQLKVATGQVNANCGKVGNFGLSSFGGANPQGYQRSHIQSLLAAQQLQQLQIHSQHQQQQMHLQQHHHLSTVQQQLLQEGLPLPGDLKMKGIVAASHAQNAGASESHAL

SEQ ID NO: 3472 - protein, 184 aa, Oryza sativa
MDVSAALSSDYSSGTPSPVAADADDGSSAYMTVSSAPPKRRAGRTKFKETRHPVFKGVRRRNPGRWVCEVREPHGKQRIWLGTFETAEMAARAHDVAALALRGRAACLNFADSPRRLRVPPIGASHDDIRRAAAEAAEAFRPPPDESNAATEVAAAASGATNSNAEQFASHPYYEVLDDGLDLG

SEQ ID NO: 3473 - protein, 256 aa, Oryza sativa; identical to SEQ ID NO: 3308

SEQ ID NO: 3474 - protein, 192 aa, Oryza sativa
  unsure (1)..(192): unsure at all Xaa locations
PGCRRWSXHKVMVRWLSRFFHYLDRYFISHASAHASGEVGLSCFRDLVYQEIKGKVKSAVISLIDQEREGEQIDRALLKNVLDIFVEIGLTSMDYYENDFEDFLLKDTADYYSIKAQTWILEDSCPDYMLKAEECLKREKERVAHYLHSSSEQKLLEKVQHELLTQYASQLLEKEHSGCHALLRDDKVDDLX

SEQ ID NO: 3475 - protein, 151 aa, Oryza sativa
RSHPPPQAGAAESKVFYLKMKGDYHIYLAEFKSGDERKQAAESTMNAYKAAQDIALADLAPTHPIRLGLALNFSVFYYEILNSPDRACNLAKQAFDEAISELDSLGEESYKDSTLIMQLLRDNLTLWTSDANDDGGDEIKEAAAPKEPGDQ

SEQ ID NO: 3476 - protein, 136 aa, Oryza sativa
  unsure (1)..(136): unsure at all Xaa locations
MGGRKRALLVGINYPGTKAELKGCHNDVARMRRALVDRFGFDEADIRVLADADRSAPQPTGANIRRELAPXLVGDARPGDFLFFHYSGHGTRLPAETRQDDDTGYDECIGPSXKNLITDPDFTELVQXVPDDCLFT

SEQ ID NO: 3477 - protein, 133 aa, Oryza sativa
  unsure (1)..(133): unsure at all Xaa locations
SALXXVXXSFDQPSSPGRPLDXWVXRLQEFGTRSSEVRRRALSALKGAAKENPAAIMGQASIFGPALADCLKDGSTPVRLAAERCALHSFQLAKGTENVQAAQKYITGLDARRLAKYPEESDGEDSXXDNASG

SEQ ID NO: 3478 - protein, 485 aa, Oryza sativa
MALSVEKTSSGREYKVKDLSQADFGRLEIELAEVEMPGLMACRAEFGPSQPFKGARISGSLHMTIQTAVLIETLTALGAEVRWCSCNIFSTQDHAAAAIARDSAAVFAWKGETLEEYWWCTERCLDWGVGGGPDLIVDDGGDATLLIHEGVKAEEEFEKSGKVPDPESTDNAEFKIVLTIIRDGLKSDPSKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSTGKYEKKVYVLPKHLDEKVAALHLGKLGARLTKLSKSQADYISVPVEGPYKPAHYRY

SEQ ID NO: 3479 - protein, 246 aa, Oryza sativa
MGRGKVQLKRIENKINRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIISRKSHLMLESISELQKKEKSLQEENKVLQKELVEKQKVQKQQVQWDQTQPQTSSSSSSFMMREALPTTNISNYPAAAGERIEDVAAGQPQHVRIGLPPWMLSHING

SEQ ID NO: 3480 - protein, 137 aa, Oryza sativa
  unsure (1)..(137): unsure at all Xaa locations
MPVPLAPYPTPPVPFTPPNGAQSQLVCSGCRNLLMYPAGATSVCFAVCSXTVTAVPAPGTEMAQLVCGGCHTLLMYIRGATSVQCSCCHTVNLAMEANQVAHVNCGNCRMLLMYQYGARSVKCAVCNFVTSVGASPG

SEQ ID NO: 3481 - protein, 299 aa, Oryza sativa
MDVQLESTAVQHGQAKINVEEHALVSLLSDEKYATEKTEDVDPDDYEKLEEGIMQYGCAHYRRRCRIRAPCCNEIFDCRHCHNETKNSIKIDAVKRHELPRHEVQQVICSLCGTEQEVRQVCISCGVCMGKYFCEVCKLFDDDVSKQQYHCNGCGICRIGGKENFFHCSKCGCCYSIVLKNSHACVEGAMHHDCPICFEYLFESTNDVSVLPCGHTIHVKCLREMEEHCQFACPLCSKSVCDMSKAWERLDEELATISDTCDNKMVRILCNDCGATSEVQFHLIAHKCQKCKSYNTRQI

SEQ ID NO: 3482 - protein, 105 aa, Oryza sativa
  unsure (1)..(105): unsure at all Xaa locations
XENTLSPFAGLAFHPLDGILQAIPHVFALYLIPTHFRTHIALLFIEAVWTTNIHDCIHGKVWPVMGAGYHTIHHTTYRHNYGHYTVWMDWMFGTLREPEDILKKD

SEQ ID NO: 3483 - protein, 423 aa, Oryza sativa
MDKLNGSARLMIVSDLDHTMVDHHDEENLSLLRFGALWESVYCQDSLLVFSTGRSPTLYMELRKEKPMLTPDITIMSVGTEITYGEEMVPDDGWVEYLNNKWDRNIVVEETANVSELKLQVESEQRPHKVSFYVDKKSAQEVIKSLSEKLEKRGLDVKIIYSGGQDLDVLPQGAGKGQALAYLLKKLSSCGKPPNNTLVCGDSGNDAELFSIPGVHGVMVSNAQEELLQWYAENAKGNPKIIHATERCAAGIIEAIGHFKLGPSVSPRDVGFPYVKEDHIKPTDAVVKFYVLYEKWRRAEVPKSDSVVQYFKNITHANGVIIQPSGLECSLHASVDALSSCYGEKQGKKYRTWVDRLFVSQSGSDSWLVRFDLWEAEGDARLCCLTSLALNVKPETPAGFLITHVHKTWLKGYSSADEQSSKL

SEQ ID NO: 3484 - protein, 169 aa, Oryza sativa
MRTICDVCESAPAVLFCVADEAALCRSCDEKVHMCNKLARRHVRVGLADPNKVQRCDICENAPAFFYCEIDGTSLCLSCDMTVHVGGKRTHGRYPKEQMANHHNVSDDPASDGNCDDQGNIDSKMIDLNMRPVRTHGQGSNSQGVDVSVNNHDSPGVVPTCNFEREANK

SEQ ID NO: 3485 - protein, 750 aa, Oryza sativa
MATHERKTIDLEQGWEFMQKGITKLKNILEGKPEPQFSSEDYMMLYTTIYNMCTQKPPHDYSQQLYEKYRESFEEYITSMVLPSLREKHDEFMLRELVKRWSNHKVMVRWLSRFFHYLDRYFISRRSLPQLSEVGLSCFRDLVYQEIKGKVKSAVISLTYFLEQIDQEREGEQIDRALLKNVLDIFVEIGLTSMDYYENDFEDFLLKDTADYYSIKAQTWILEDSCPDYMLKAEECLKREKERVAHYLHSSSEQKLLEKVQHELLTQYASQLLEKEHSGCHALLRDDKVDDLSRMYRLFSRITRGLEPVSQIFKQHVTNEGTALVKQAEDAASNKKPEKKEIVGLQEQVFVRKIIELHDKYVAYVTDCFQGHTLFHKALKEAFEVFCNKGVSGSSSAELLATFCDNILKKGGSEKLSDEAIEDTLEKVVRLLAYISDKDLFAEFYRKKLARRLLFDKSANDEHERSILTKLKQQCGGQFTSKMEGMVTDLTVARDHQAKFEEFISTHSELNPGIALAVTVLTTGFWPSYKSFDINLPAEMVKCVEVFKEFYQTRTKHRKLTWIYSLGTCNINAKFEAKTIELIVTTYQAALLLLFNGVDRLSYSEIVTQLNLSDDDVVRLLHSLSCAKYKILSKEPNNRSISPNDVFEFNSKFTDKLRRLKIPLPPVDEKKKVVEDVDKDRRYAIDASIVRIMKSRKVLGHQQLVMECVEQLGRMFKPDFKAIKKRIEDLITRDYLERDKDNPNVYRYLA

SEQ ID NO: 3486 - protein, 342 aa, Oryza sativa
PGLQAVLTVGFSADLGRIFGDSITPGSTRLGAIIVYLVGFWLLDVGNNATQGPCRAFLADLTENDPRRTRIANAYFSLFMALGNILGYATGAYSGWYKIFPFTVTPSCSISCANLKSAFLLDIIILVVTTCITVASVQEPQSLGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSNILMALCFVAMLVITYVAKNMDYPPSGVPPTGIVIASLVVFTILGAPLAITYSIPYAMAASRVENLGLGQGLAMGILNLAIVIPQ

SEQ ID NO: 3487 - protein, 369 aa, Oryza sativa
  unsure (1)..(369): unsure at all Xaa locations
MPDFAQVYNFLGSIFDPETSGHLQRLREMDPIDVETVLLLMKNLSINLTNPNFEAHGNDQMKEHHHNQHPLGGDLLNGTVKFESTSVYISSKKKKKKKKKRLGAMVQGASGGGWSSKVEEGVIVGGLLVVQCILAGYVVFVDHVLSLGANPLSLIVLGAVASSLFFLPFAVVLERKKWPSKISRTLMAQFVFIALGGTTVFQELMLLGIKKTTPAIASAMPNLSPGLIFIIAACFRLEKFDKGCKYTRAKILGTLVCLVGAMAMSFLQSPVSSSPQLTTTSYYDWILGCFYLFLAVVVLSIYTVLQAATLVSFPAPLTMCSVTSMMGAVFTAILQFIVDGKIDMGSPRIDETIISTIVLMLLCLGRYLX

SEQ ID NO: 3488 - protein, 240 aa, Oryza sativa
  unsure (1)..(240): unsure at all Xaa locations
MASLPNGAASASASAAGGGPAVVDKEVDFANYFCTYSYLYHQKEMLCDRVRMDAYHSAVFRNAHHFRGKVVLDVGTGSGILAIWSAQAGARKVYAVEATNMAEHARELARANDVADIVEVIQGSMEDVVLPEKDGVMYPSHARMWLAPIRSDLAENKMEDLEIAMHDWNLFVEDTESYYGVNMNVLTKAYRAEHEKYYLKSAIWNNLHPNQVIGQAAVIKEIDCLTATVDEIREVRAQEX

SEQ ID NO: 3489 - protein, 380 aa, Oryza sativa
MASLPNGAASASASAAGGGPAVVDKEVDFANYFCTYSYLYHQKEMLCDRVRMDAYHSAVFRNAHHFRGKVVLDVGTGSGILAIWSAQAGARKVYAVEATNMAEHARELARANDVADIVEVIQGSMEDVVLPEKVDVIISEWMGYFLLRESMFDSVICARDRWLKPDGVMYPSHARMWLAPIRSDLAENKMEDLEIAMHDWNLFVEDTESYYGVNMNVLTKAYRAEHEKYYLKSAIWNNLHPNQVIGQAAVIKEIDCLTATVDEIREVRAQVTMPIKLDMTRLAALAGWFDVHFRGSKQNPATQEVELSTAPDVNGGTHWGQQVFLLTPPLKVNEGDNVKVSFTMVRSKENHRLMDMEFTYELHESSGKQLPAITTKIYLE

SEQ ID NO: 3490 - protein, 354 aa, Oryza sativa
  unsure (1)..(354): unsure at all Xaa locations
MPISPLLAHLAPSSVAPAAFASGAAALRWXIRIRVSKLCYLFVLCSCKVLPGEHNFVATLIEGRDQKKRPTQFGMNQVLQPFDSVKFNFTKVSPEEVIFTFKESQNDSVKYFDNVPHAVAASPTAILINVSPIGYCHVLLIPRIQDCLPQRVDKESFLLAMYVASEAKDPFFRVGYNSLGGFATINHLHFQAYYLKVQYPVEKALTEKLTTLGNGVSIIQLVQYPVSGFVFEGGACLEDLSDVVSKVCIFLQENNKPFNALISESGKRVFLLPQCYAEKQALGRVSQEFLDMRINPAVWELSGHLVLKRRKDYDEASEATICRFLVEASLSESEFQELKSCILEFLSSAAPEEX

SEQ ID NO: 3491 - protein, 337 aa, Oryza sativa
  unsure (1)..(337): unsure at all Xaa locations
VLPGEHNFVATLIEGRDQKKRPTQFGMNQVLQPFDSVKFNFTKVSPEEVIFTFKESQNDSVKYFDNVPHAVAASPTAILINVSPIGYCHVLLIPRIQDCLPQRVDKESFLLAMYVASEAKDPFFRVGYNSLGGFATINHLHFQAYYLKVQYPVEKALTEKLTTLGNGVSIIQLVQYPVSGFVFEGGACLEDLSDVVSKVCIFLQENNKPFNALISESGKRVFLLPQCYAEKQALGRVSQEFLDMRINPAVWELSGHLVLKRRKDYDEASEATICRFLVEASLSESEFQELKSCILEFLSSAAPEEXRRPNSYSERYRFVTVGAIKSCPSLFFRLMYN

SEQ ID NO: 3492 - protein, 160 aa, Oryza sativa
  unsure (1)..(160): unsure at all Xaa locations
LAAVISCIEFMERGQKKKLATLVGCNYAGTPNELQGCINDVAAMRDALVARFGFAPADVTVLTDDRGSPVLPTGANIKRALADMVARAAPGDVLFFHYSGHGTLVPPVKGRRHGHGECDEAIVPCDFNLITDVDFRRLVDRVPRGASFTMVSDSCHSGGX

SEQ ID NO: 3493 - protein, 262 aa, Oryza sativa
  unsure (1)..(262): unsure at all Xaa locations
MPVVAASGHGLRRTMYSLYSKGSFLLLLGRRCIGGGGAPPGEGMGMRCSGDDEDHLIPRKQNTPRVRESAAAATSNRDVYRSVTTCARASERMSAAEERGDRQERDDGEGGEEERRERGGVGGLVDRAKGFVAEKIAKIPKPDATLDRVSFKGVSRECITLHSHLDVNNPYSHRIPICELTYTFKSGDKXWIAASXTTNLELPVKVPYDFIVSLIKDVSGDWDIDYVLEVGITIDLPXVGXFTIPLATEGEMKLPTFRDLLF

SEQ ID NO: 3494 - protein, 180 aa, Oryza sativa; identical to SEQ ID NO: 1071

SEQ ID NO: 3495 - protein, 636 aa, Oryza sativa
  unsure (1)..(636): unsure at all Xaa locations
GHGWLAFGDRFGRPAGRDDLELYGVGGFCAKERFVSLPFFLVELRLRLPPRTGSPERDFFSEYGDANRYKIQEVIGKGSYGVVCSAIDQHTGDKVAIKKIHNIFEHLSDAARILREIKLLRLLRHPDIVEIKHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYVATRWYRAPELCGSFFTKYSPAIDIWSIGCIFAEILTGKPLFPGKNVVHQLDLMTDLLGTPSMDTVTRIRNEKARRYLSSMRKKQPVPFSERFPKADPAALKLLQRLLAFDPKDRPTAEEALADPYFKGLAKAEREPSCQPITKMEFEFERRKVTKEDVKELIFREILEYHPQLLKDYMNGTEKTNFLYPSALDNFRRQFANLEENGGKNGDAVPSDRKHVSLPRTTTVHSAPIPPKDHQNITSQVPQRIPGRTGRGACPVIPFENLSAMGPYNQRRVVRNPVLPPATTNLSAYAYHRKSDSSERELQQELEKDRMRYQPSEHFMDAKVVSHMSHDLRASSYYVSKAKSDVADRAALQSNMMQGIGPFNGIAAVGGNYNKVSTVQYGVSRMYXGAMATSKMLR

SEQ ID NO: 3496 - protein, 396 aa, Oryza sativa
  unsure (1)..(396): unsure at all Xaa locations
RTGHKLKNPIFPEICYGKLQLNNGLALTPQMGWNSWNFFACNINETVIRDTADALVSTGLADLGYNYVNIDDCWSNVKRGKKDQLLPDPKTFPSGIKDLADYVHGKGLKLGIYSDAGILTCQVRPGSLHHEKDDAAIFAGWGDAARGYDNCYNLGIKPKDRYPPMRDAXNSTGXRQIFYSLCEWGPXDDPALWAGKVGNSWRTTDDIQDTWKSMTDIADKNNKWASYAGPGGWNDPDMLEVGNGGMTFAEYRAHFSIWALMKAPLLIGCDVRNMTKETMEILSNKEVIQVNQDPLGVQGRRILGQGKNGCQEVWAGPLSGNRLAVVLWNRCEESANIIVKLPSVGLDGSSPYSVRDLWKHETLSENVVGTFGAQVDVHDCKMYIFTPAVTVASSXS

SEQ ID NO: 3497 - protein, 304 aa, Oryza sativa
  unsure (1)..(304): unsure at all Xaa locations
MLLNPASREVAALDSIRHHLLEEEEETPATAPAPTRRPVYCRSSSFGSLVADQWSESLPFRPNDAEDMVVYGALRDAFSSGWLPDGSFAAVKPESQDSYDGSSIGSFLASSSSEAGXTPGEVTSTEATVTPGIREGEGEAVAVASRGKHYRGVRQRPWGKFAAEIRDPAKNGARVWLGTFDSAEEAAVAYDRAAYRMRGSRALLNFPLRIGSEIAAAAAAAAAGNKRPYPDPASSGSSSPSSSSSSSSSSSSGSPKRRKRGEAAPASMAMALVPPPPPPAQAPVQLALPAQPWFAAGPIQQLVS

SEQ ID NO: 3498 - protein, 637 aa, Oryza sativa
MRSMMRLMICCLLVSAGAGGIAGEGNLDVALLLQCVKPALRREGGNTQLATWTASTPLCLWRGLRSTIQMALSRSVEVAVPADPAGDGDRDKIRLRQLGYKQELKRGLSVLSNFAFSFSIISVMAGVTTTYSTGLRYGGPVSMTLGWLVVSAFNGCMALSMAEICSAYPTSGGLYYWSAKLAGNDWAPFASWITGWFNITGQVGTFGFLGPGFSLIDGPFYWAMSTERNKFTLGPFICCPVRFSSLNHKTGVDFALAQLVQVIVLLSTGGANGGGYMASNYVVLAIYGAMLVIHGAINSLPIQCLSWFGQLGAFWNAAGVFVLVALIPAVATERASVEFIFTHFNTENGMGIRDKAYILLIGLLMSQYAMAGYDTSAHMTEETKNADWSGPIGIVTSVALSTVFGWIYIVSLTSAVTDIPYLLSPDNDAGGNAVAQAFYTTFHRRYGSGLGGILCLGVVAVAVFLCGLACITSNSRMAYAFSRDGAMPFSKVWHRVNKQEVPINAVWLSVVVAFIMALTSLGSQVAFQAMVSIATIGLCISYALPIFFRVTTARGSFVPGPFHLGKYGIVVGWAAVLWVAAVTVLFSLPVAYPVAEETFNYTPVAVGGVLLLTVGAWALRARFWFQGPITNTNDGPL

SEQ ID NO: 3499 - protein, 295 aa, Oryza sativa
MMKKCPSELQLEAFIREEAGAGDRKPGVLSPGDGARKSGLFSPGDGEMSVLDQSTLDGSGGGHQLWWPESVRTPPRAAAAFSATADERTPASISDDPKPTTSANHAPESDSDSDCDSLLEAERSPRLRGTKSTETKRIRRMVSNRESARRSRRRKQAQLSELESQVEQLKGENSSLFKQLTESSQQFNTAVTDNRILKSDVEALRVKVKMAEDMVARAAMSCGLGQLGLAPLLSSRKMCQALDMLSLPRNDACGFKGLNLGRQVQNSPVQSAASLESLDNRISSEVTSCSADVWP

SEQ ID NO: 3500 - protein, 314 aa, Oryza sativa
  unsure (1)..(314): unsure at all Xaa locations
SLTIDFFPLPRVDEQVAIQEAAAAGLRGMEHLILQLSQTXXQQQQVDCREITDMTVSKFKKVISMLNRTGHARFRRGPVVAQSSGPAASEPAPVRSSPSAVSRPMTLDFTKAASGYGKDAGFSVSGISAASSSFLSSVTGDGSVSNGRGGGSSSLMLPPPPATSCGKPPLSSAAAAMSAGAGHKRKCHDHAHSENVAGATGGRCHCSKRRKHRVKRTIRVPAISSKVADIPADDFSWRKYGQKPIKGSPFPRGYYKCSTLRGCPARKHVERDPTDPSMLIVTYEGEHRHSPSAAGQDHPPSDRKKKPQSLSREV

SEQ ID NO: 3501 - protein, 323 aa, Oryza sativa
  unsure (1)..(323): unsure at all Xaa locations
MITMDLMGGYGRVDEQVAIQEAAAAGLRGMEHLILQLSQTGXEREVAGAXAQEQQQQVDCREITDMTVSKFKKVISMLNRTGHARFRRGPVVAQSSGPAASEPAPVRSSPSAVSRPMTLDFTKAASGYGKDAGFSVSGISAASSSFLSSVTGDGSVSNGRGGGSSSLMLPPPPATSCGKPPLSSAAAAMSAGAGHKRKCHDHAHSENVAGATGGRCHCSKRRKHRVKRTIRVPAISSKVADIPADDFSWRKYGQKPIKGSPFPRGYYKCSTLRGCPARKHVERDPTDPSMLIVTYEGEHRHSPSAAGQDHPPAPPPPLALPLA

SEQ ID NO: 3502 - protein, 506 aa, Oryza sativa; identical to SEQ ID NO: 897

SEQ ID NO: 3503 - protein, 296 aa, Oryza sativa
PRIPRLPPPHSSPPVPGAASKTPTPKSQPRSARSLSRLAMAPSDDLVYMAKLAEQAERYDEMVEAMNSVAKLDEGLTKEERNLLSVGYKNLIGAKRAAMRIIGSIELKEETKGKESHVRQTAEYRRKVEAEMDKICCDVINIIDKYLIPHSSGAESSVFYYKMKGDYYRYLAEFKTGTEKIEVSELSLNAYETASKTAQTDLTPTDPIRLGLALNISVFYCEIMNSPDKACQLAKNAFDEAVAELPSLSEENYKDSTLIMQLLRDNLALWNSDMADDADDIRERTDTTGAKGDPAA

SEQ ID NO: 3504 - protein, 323 aa, Oryza sativa
RGGDVDGAAGALRRFVREAGGCAVVDGGLATELEAHGADLHDELWSASCLVSAPHLIRKVHLDYLDAGANIITSASYQATIQGFQARGLSRERSEALLRRSVHIAQEARAIFAAKGPYANHRSSPRRPVLVAASIGSYGAYLADGSEYTGDYGISVTKETLKSFHRRRLQVLADAGPDLIAFETIPNKLEAQASGDPITECAAVADACARVGAVGVNCTAPRLVHGLILSIRKVTSKPVVVYPNSGETYVAETKEWVVSDRGASETDFVSCVGKWRQAGAALVGGCCRTSPATVRAISWALRESDDAVGGDGDRDDFPAVAVL

SEQ ID NO: 3505 - protein, 403 aa, Oryza sativa
  unsure (1)..(403): unsure at all Xaa locations
MWGDRTHHKHWNQAHVPSGTSKDKFQAKGQPKFIPDNYSSVDEVTAALRDAGLESSNLILGIDFTKSNEWSGRYSFGRKSLHAISATPNPYEQAISIIGRTLSPFDDDNLIPCFGFGDASTHDQSVFSFYQDSRSCCGFEXKVLERYRQIVPHLNLSGPTSFAPLIYAAISVVENSNLQYHVLVIIADGQVTTSNTKDGKLSPQEQATIQAIVDASYYPLSIVMVGVGDGPWDAMQHFDDCIPDRAFDNFQFVNFTEIMSTSKDMPKKEAAFALAALMEIPSQYKATQGLRPLEKHAGHVASHLRILPPPNKVLENDNAAASRPPTASSQSTGFGKNTTDEQNCGITLIIFFYGIIKVCPICLTNPKDMAFQCGHLTCKECGPTLSTCPLCRVPITMRVRLYS

SEQ ID NO: 3506 - protein, 84 aa, Oryza sativa
MKVKILQWHSVASWTWDAQDETCGICRMAFDGCCPDCKFPGDDCPLIWGSCNHAFHLHCILKWVNSQTSTPLCPMCRREWQFKG

SEQ ID NO: 3507 - protein, 212 aa, Oryza sativa
  unsure (1)..(212): unsure at all Xaa locations
GDEVSKQGLLFLNFKEKITIANDDAGFQLGVIGSLALSVASSVAIVICNKALISTLGFPFATTLTSWHLMMTFCTLHVAQRLHFFEPKAIDGQTVILFGLLNGTSIGLLNSCLGFNSIGFYQMTKLAIIPFTVLLETXIFLKKRFSESIKLSLLVLLLGVGIASVTDLKLNLLGSVLSGLAIETTCVAQILTNTIQKRLKVFSTHLLYQSGX

SEQ ID NO: 3508 - protein, 423 aa, Oryza sativa
MDKLSGSARLIIVSDLDHTMVDHHDEENLSLLRFGALWESVYCQDSLLVFSTGRSPTLYKELRKEKPMLTPDITIMSVGTEITYGEAMVPDDGWEEYLNNKWDRNVVVEETAKFSELKLQPETEQRPHKVSFFVDKKSAQEVIKSLSGNMEKCGLDVKIIYSGGQDLDILPQGAGKGQALAYLLKKLSSCGKPPNNTLVCGDSGNDAELFSIPGVHGVMVSNAQEELLQWYAENAKGNPKIIHATERCAAGIIEAIGHFKLGPSVSPRDVGFPYVKEDHIKPTDAVVKFYVLYEKWRRAEVPKSDSVVQYFKNITHANGVIIQPSGLECSLHASVDALSSCYGEKQGKKYRTWVDRLFVSQSGSDSWLVRFDLWEAEGDARLCCLTSLALNVKPETPAGFLITHVHKTWLKGYSSADEQSSKL

SEQ ID NO: 3509 - protein, 355 aa, Oryza sativa
  unsure (1)..(355): unsure at all Xaa locations
XPGLQEFGTRLVRLFNSGAXVDIRRCAIVTLTKLIPTVQVGTHVSVLVHHLKLVLDGNNDDLRKDAAEALCCLAHALGEDFTIFVSSIHKLLVKHHMRYRKWDEIENRLLRREPLISENLSVQKYTQCPPEVISDPLDDFGGVPSEEGQPRSHQVNDVXRLRSAGEASQRSTREDWAEWMRHFSIALLKESPSPALRTCARLAQLQPSVGRELFAAGFASCWAQMNETSQEQLVRSLKTAFSSQNIPPEILATLLNLAEFMEHDEKPLPIDTRLLGALAEKCRAFAKALHYKEMEFEAVCSKKMGANPVTVVESLIHINNQLHQHEAAIGILTYSQQHLEVQLKESWYEKLHRWX

SEQ ID NO: 3510 - protein, 305 aa, Oryza sativa
MATHFTLNTGARIPSVGLGTYKAGTGVVADVVSAAVKAGYRHIDCAPLYKNEQEVIGGALKKLFDDGVVKREDLFITSKIWCSDLAPEDVPLAMDSTLKDLQLDYVDLYLIHWPFQIKKGTELSPENFVKPDIPSTWRAMEQLYDSGKARAIGVSNFSSKKLGDLLCVARVPPAVDQVECHPGWQQAKLRAFCHTSGVHLSAYAPLGRMKGIAVDSVLPSVAEMLGRTPAQVALRWGLQQGQSVLPKSVSEARLKENMDLFGWSIPEELCAKLSEIEQVKQIRGDGFAHPESVYKTYEELFDGEI

SEQ ID NO: 3511 - protein, 475 aa, Oryza sativa
  unsure (1)..(475): unsure at all Xaa locations
MFYPMPLPMDARRRLMLGRRRGXRRRRRWRGMVKLSTVAVVAWVLASAALWAGLHWRFRRPALHKAEEALVCICEERARMLQDQFAVSVNHVHALAILVVTFHYDKHPPALDQDTFAVYVARTSFERPLLSGVAYAQRVVHADRESFERQQGWIIKTMKHEPSPAQDETLLFLLTLDDIXGALGFDEDDILRDFSILVVAAEPLPLASTGLLGVFVTSASAALASPSSLSIASARIAISSLVLVLEPGDREFVTFLDDELRDVAAAAVASVALSTMAFSLAVAAASDALAAPSSLTDSLILCSAAAISASMFSASDMARRFSVSVSVFSFSAASASSSSCRRIAASLEMVSSALSSAAVTASRRDLALSSLAFSYFTCALAAFSCSVRRGISSVTRAVSLRWQCGTRCSHHCQDAVLLACSVRISLHAAAAVAARAGAHRNILRPETRQAWTERWTAGAVAAPAGDWQSAAVAGD

SEQ ID NO: 3512 - protein, 150 aa, Oryza sativa
  unsure (1)..(150): unsure at all Xaa locations
MVKLSTVAVVAWVLASAALWAGLHWRFRRPALHKAEEALVCICEERARMLQDQFAVSVNHVHALAILVVTFHYDKHPPALDQDTFAVYVARTSFERPLLSGVAYAQRVVHADRESFERQQGWIIKTMKHEPSPAQDEYAPLXVFPVSTEY

SEQ ID NO: 3513 - protein, 151 aa, Oryza sativa
  unsure (1)..(151): unsure at all Xaa locations
DLGGGGGGGALEASSSSWAPAEASFPPSGYPFVPGRKRALLVGVSYKGSSYELEGTVNDVDCMRRLLGESFGFPADSILVLTEELGEGDPSRSPTRANLLAAMRWLVEGCDAGDSLVFHFSGHGVHKLDVNGDEVDGYNEALCPVDFERSX

SEQ ID NO: 3514 - protein, 293 aa, Oryza sativa
  unsure (1)..(293): unsure at all Xaa locations
XLGRATTPPSSSSAAPSPSSSTPXAAAAAAADEDVKTEPDGSVPEKILKKPDKILPCPRCNSMETKFCYFNNYNVHQPRHFCRNCQRYWTAGGAMRNVPVGAGRRRNKHVSKYCQAMMTCNNTVAPGDVSDVVHHQVITHGSSLLPATLKENETPTEFISEXVLGLKDGIPCPPSWPPQLMVPAPGICTPVVPIPLSGSSSLVLGKHSREESLQEEEKTRNYLWVPKTLRIDDPAEAAKSSIWATLGIKPDDKGIFKSFQPNVAKNGTAPESPQALQANPAAFSRSQSFQETT

SEQ ID NO: 3515 - protein, 454 aa, Oryza sativa
MPNLGNGVKTNNDLPLVSDKLLIVKGIPFCPNNSKKNDLQGISRPDGRIEIDSMTEDVKTEPDGSVPEKILKKPDKILPCPRCNSMETKFCYFNNYNVHQPRHFCRNCQRYWTAGGAMRNVPVGAGRRRNKHVSKYCQAMMTCNNTVAPGDVSDVVHHQVITHGSSLLPATLKENETPTEFISEVPPCKSSASILDIGEPNDTDLVPLASGDNKEEKSCASSVVVSSCSENLMPDNAIMKEPNNRSGCCNGVALPFPTGPALVLPWSLGWNSVALMPATQCSMQPVLGLKDGIPCPPSWPPQLMVPAPGICTPVVPIPLVPPLWSCFPGWPNGMWNAQCPGGNTTVLPSTAPNKISCSGSSSLVLGKHSREESLQEEEKTRNYLWVPKTLRIDDPAEAAKSSIWATLGIKPDDKGIFKSFQPNVAKNGTAPESPQALQANPAAFSRSQSFQETT

SEQ ID NO: 3516 - protein, 240 aa, Oryza sativa
MRPASCSSSGEVEVARSVGGGGCGGEGEMRGEANGEEEQQPPRRNHLRDDAEEEEEVERRAARPVSGQQQQQQRRRPTDVGGGAAMRSVGYVGKHRLSAAIARLDQELQSLQTGWIDYCAMQDSSRISPGCIRIKAPLVQRTLLGRDGFSACVALAVTNGGRGGEDSEEHFYARPENQGRGPNAAAASVQTKAGKDHRRARSGRPAAVPDAAGTGDRSGLACSPIEALDSQRGRNLLLSS

SEQ ID NO: 3517 - protein, 105 aa, Oryza sativa
MKNECMSFRDSCGQGNVEGCMRSFQKVKREHAVLRQKLESYFQLLRQAGPAGAATRPVMSLSVDETWVTSPAAAVFLRHGETRAPAFALGTAGRRRGEDDMSVIR

SEQ ID NO: 3518 - protein, 198 aa, Oryza sativa
  unsure (1)..(198): unsure at all Xaa locations
XWNSHRCTKTAGWMDQEPPPPTHPPRTETGYRVSSEQCGSILKKLMDHKSGWIFNTPVDPVVYGIPDYFDVIRNPMDLGTVKRKLTSKQYSNPYEFAADVRLTFSNAMKYNPPGNDVHGIADQLNKIFDSEWKLLERKWKDRNLVQEQPSLKVLKAQPAVTPKPVLPKGVTAGTNSADSVSPSTEIDVEEGEISFCQX

SEQ ID NO: 3519 - protein, 189 aa, Oryza sativa
  unsure (1)..(189): unsure at all Xaa locations
MKRLTFGAEPEMVDSASIAQEVMLLLARSGGGGAGYVVGHGGEAPRVFECKTCRRRFPSFQALGGHRASHKRPRGGGGGGAAAAVAAAAGEGEAGVALSLAAGTPAVKASRAHGCAVCGVEFALGQALGGHMRRHRIXXGAEADEAVSARGGXAGARAESTRGEGCGXXLDLNAAPAETQASCWXTACX

SEQ ID NO: 3520 - protein, 1415 aa, Oryza sativa
  unsure (1)..(1415): unsure at all Xaa locations
MKVGFDDAADKADSMAMYKAGLVSPRENKIVDRSSAKREALQSIFDNVTEIECSGSSSSSSRRRRRSGTSGEGAMGLLTKNPRSADEERSRCPYSKQELVKKVESLCDDVCLSAVVDEQGRCAREATEWKKLVDQPKAASGRALIIELETRPRKERTIFRPSWMVSLVNVASGYSRVLLLLMSVILTPSLAASESISAEKATLSDELTHYEHFQRELDAAKGLHEELVKSVEPTLELFFPSRCKGKDLVQLATELVPEGPTAVRRLSEGGGRECGGRREGDSYTIMQPIPRTQCPPSVSRDRPWLPSSLRQPVMAIQPGLNTEEKNQGLLRQRGAGVDRVHQRRAHASAKRGGTVHRGPGPRGGPRRPTVGWPRGHTWDRGGEKREEQEGGGSPSAEAARRRRGKAADDEERQRRPAEKQRERSTDDDRQNQGRRRRSAGSAGEVARCGCSWRWWRREMVNVVAAFRKWIGEEEQWTGKTESEWVLRMKRKGNACERLKKRQREHLDSMAMYKGIGCGRVIASLGSLIDGIMVEFVVDDDKLRRLDGGSGSQRGRRGSSGFPLNDEIAMVVLTLRGHRLSGRYILQILVLRGHRLSGGCILQILDICVSLYTNEEVSVGPSIITVADISPSSPNPSLRLGKALTGQREAMNTEFQRKMLGAKNVRTDKFGLGLFGLGLGPNRNSTTFHICKEIMEIFNTKITKKIHPSVSPRREESWAMMMPKQQGPRKERAFLLFDKLPPSSHSQLLDVSSPPPSSCPVIHLATDGHLGTQHSEDNFREEPQSTTSLIESNRIGIEAGAHLTKKIIRSNRAELVLLFSSRSLAYLNLATAALPATPTTPRSGDPARRGAHWSGASWCCNGGPPLIRSTPPRPMDSARSWLQKLQPRDKDRGKPASPTAARKDGAAAMAEDGEEAISSTTATKVAAAKQFIENHYKDQMRSLEERKERRRMLESKLADPDVSEEEQNNILKDFENREREIMRSRRHKMGVDDFELLTIIGRGAFGEVRLCREKATSNVYAMKKLKKSEMLRRGQVEHVRAERNLLAEVDSAYIVKLYCSFQDEEFLYLVMEYLPGGDMMTLLMRKDTLTDDESRFYVAETILAIESIHKHNYIHRDIKPDNLLLDRTGHLKLSDFGLCKPLDSSSFPNREFDYAVGKNINPSMDGDTAPRRTQQEQLLHWQKNRRMLAYSTVGTPDYIAPEVLLKKGYGMECDLWSLGAIMYEMLVGYPPFYSEDPMSTCRKIVNWRSHLKFPEEAKLSPEAKDLISKLLCNADLRLGTKGAHEIKAHPWFKGLEWEKLYQMEAAFIPEVNDELDTQNFEKFEEIXXPMQTSSKAGPWRKMLSSKDTNFLNFTYKNLELSDDPEHPGIEFADTEEEPQSSSLNSTPSQLDQLPESLEPSPHSSISSEDSQSRHRX

SEQ ID NO: 3521 - protein, 522 aa, Oryza sativa
MDSARSWLQKLQPRDKDRGKPASPTAARKDGAAAMAEDGEEAISSTTATKVAAAKQFIENHYKDQMRSLEERKERRRMLESKLADPDVSEEEQNNILKDFENREREIMRSRRHKMGVDDFELLTIIGRGAFGEVRLCREKATSNVYAMKKLKKSEMLRRGQVEHVRAERNLLAEVDSAYIVKLYCSFQDEEFLYLVMEYLPGGDMMTLLMRKDTLTDDESRFYVAETILAIESIHKHNYIHRDIKPDNLLLDRTGHLKLSDFGLCKPLDSSSFPNREFDYAVGKNINPSMDGDTAPRRTQQEQLLHWQKNRRMLAYSTVGTPDYIAPEVLLKKGYGMECDWWSLGAIMYEMLVGYPPFYSEDPMSTCRKIVNWRSHLKFPEEAKLSPEAKDLISKLLCNADLRLGTKGAHEIKAHPWFKGLEWEKLYQMEAAFIPEVNDELDTQNFEKFEEVRSPMQTSSKAGPWRKMLSSKDTNFLNFTYKNLELSDDPEHPGIGSHRAEQIERPEPAASTRYEAKMSECL

SEQ ID NO: 3522 - protein, 413 aa, Oryza sativa
MSLKSIVRELREMRDGIGSMSRRAADGRAGGGRGGSRHSWPVLWSEQQQQGRWANLPPELLLDVIQRVEASEATWPARRQVVACAAVCRSWREVTKEVVKTLEECGRITFPISLKQPGPREHPVQCFVRRDRGTSTYLLYLGLSPSLHGENDKLLLAARKIRRATRTSFVISLVSNDFSLSSSTYVGKLKPNFLGTKFTIFDSQPPCDAVVLPNNRPSKRHFKQVSPRLPLGNYNVATVSYELTVLRNRGPRRMQCTMHSIPALCIQEGGKAPTPTGIIHSLDEQVPALSTSKGKEPAIEFSSTSLSADLSGPVCTNEVPLVLKNKAPRWHEQLQCWCLNFRGRVTVASVKNFQLVASVDPSLGIPAAEQEKVILQFGKIGKDIFTMDYRYPLSAFQAFAICLTSFDTKPACE

SEQ ID NO: 3523 - protein, 468 aa, Oryza sativa
MRGATGPTCQPHALNKYSPRSTRAAAFATLIRKHQQLNPALASDSPMAAAISGGWTRLRSVGRGASGAVVSLAANDVSGELFVIKSAGEGAARQQLRREWSVMSGLSSPHVLKCLGFVQASGGCGGGEHQLFLEYAPGGSLADVVARNGGRLDEGAVRTYAADVLRGLDYLHGKLVVHGDVKGSNVLVGADGRAKLTDFGCARVAMPGGSKQPVLGGTPAFMAPEVARGEEQGLAADVWALGCTVIEMATGRAPWSDMDNVLPALHKIGYTDAVPDLPRWLSPEAKDFLRGCLQRRAGDRPTGAQLLQHPFISKSCGLNNKETVKATWVSPTSALDATLWESESSSTDGEESECPAKWVRAMACSPSSVPDWDSDQGWIDVLGASPDVVAAEEFDVAAAADQISGQAVGSIVVGVGSSEQSVVVENQEDEFTSLSSCSERVLLVGVHAADNNAASRKAGIKRCSNFSC

SEQ ID NO: 3524 - protein, 113 aa, Oryza sativa
  unsure (1)..(113): unsure at all Xaa locations
MSGVWVFKNGVVRLVEKQQATAGTAVAGGRRKALVHTPSGQVVSSXYAALEARXLTALGWEXRYYEDPSLFQFHKRGSLDLISLPADFSAFSSVHMYDIVVKNRDSFXRVVDA

SEQ ID NO: 3525 - protein, 273 aa, Oryza sativa
  unsure (1)..(273): unsure at all Xaa locations
MQTYAQRTGGYKVGDTVPFPLSFPRGFELDKKVRKWLDDWQRLPYISPYEDGSHLTPRSDITEKRTAAVLHEVLSLTVGKKMEKEVLVKLGEALRLPPGFRKVLARHPGIFYLSHKLRTQTVVLRESFRRHMLVDKHPMMGIRYQYLHLMHTGKRKGKAEDSSRRADDRGGVWCXEGENDDEEDEEYDDDEEEDMEAGVASGDEDSDDDDDDEEGEKKDMEAGVASRDEDSDDEDADDTDHAQRDRGTKHRVEVGACIRIGHQDDFGGSLSTP

SEQ ID NO: 3526 - protein, 593 aa, Oryza sativa
  unsure (1)..(593): unsure at all Xaa locations
SAIGAALRSXXAATVSEADVEKLRLIEELTSDVDAVQERVLSEILGRNAGAEYLTRCGHDAGDTGRATFRAKVPVVSYDDLKPYIQRVADGDCSPVLSTHPITEFLTSSGTSAGECKLILVAMDDSGRRQALHGLIGPVLKLYVPGLEKGKGLYFMFVKSETKTRGGLTAWFALTSVYKSEQFKSMAIAYTSPTAAILCEDAFQSMYAQMVCGLCQRHDVVRFGAVFAAALVRAIRFLQLNWGQLAADIEAGELGPHVADPSVREAVSGILRSDAELAEFVRIECSKGDWAGIITRIWPNTKYVDAIVTGAMAQYIRTLQYYSGGLPIVSTSYASSECFFGINLRPVCDPSEVSYTIMPNTAYFEFLPVGEXXVDATNLVDLARVEVGREYEVVITTYAGLSRYRVGDVLRVTGFHNAAPQFRFVRRQSVLLSVELDKTDEAELHRAVERASSALLRPRGVSVAEYTSRACTERIPGHYVVYWELLTESPVGAGDGEETLGRCCLEMEEALSAVYRQGRVADGSIGPLEIRIVRPGTFEEVMDLAVSRGTSIGQYKVPQCVTVPSVVELLDSRVVSSQFSPALPHWIPTPRSD

SEQ ID NO: 3527 - protein, 554 aa, Oryza sativa
  unsure (1)..(554): unsure at all Xaa locations
MDSARSWFTKLQTREKSIGKKKELPPNGKEGTDEAPSSATKQRVAAAKQYIEKHYKEQMKNLQDRKERRCSLEKKLADANVSEEEQHNIVKQFEKKETEYMRMQRHKMSVDDFDLLTMIGKGAFGEVRVCREKNTGNVYAMKKLRKSEMLRRGQVEHVKAERNLLAEVDHHCIVKLYCSFQDSEYLYLIMEYLPGGDMMTLLMRKDTLTEDEARFYVGETVLAIEAIHRHNYIHRDIKPDNLLLDRHGHLRLSDFGLCKPLDYSNFPDLNEKDVTSTKPQSTNGDGRQQSMPKRTQQEQLEHWQKNRRTLAYSTVGTPDYIAPEVLLKKGYGMECDWWSLGAIMYEMLVGYPPFYSDEPMTTCRKIVNWRTHLKFPEEARLMTDAKDLISKLLCNVDQRLGTKGAEEIKEHSWFSGVEWDKLYEIEAAYQPQVTDELDTQNFEKFEESSDNIQCSAKAGPWRKMLSSKDLNFVGYTYKNFELVNDPEVLGMAELKKKEKAKRPSAKSLFDXFPRRRGATSPSPSPSXKRRRKSPEYRACHAKKPERPVDIEALL

SEQ ID NO: 3528 - protein, 203 aa, Oryza sativa
MAAQEQEQEKQQVKTSTTSSLPSSSERSSSSAPNNLKEGGGVESDEEIRRVPEMGGGGGSASSGAGADERQGKEDGKQQGGGGGGAAAAGGGQEQAPPARKRGRSAGDKEQNRLKRLLRNRVSAQQARERKKAYMTELEAKAKDLELRNAELEQRVSTLQNENNTLRQILKNTTAHAGKRGGGGGGKGGDGGGGGKKHHFTKS

SEQ ID NO: 3529 - protein, 276 aa, Oryza sativa
  unsure (1)..(276): unsure at all Xaa locations
SPGCRNSARXSFDAVALRRLINNKSDGGVTPLHLAALHGHAECVQLLLDLGASVSEVTINDGSTIDLIGSGSTPLHYAACGGSAVCCQLLVAAGANMRAQNTNGLTPLMVARSWHKSSVEGILTKRPEVPVXXILPSSYLSLPLMSIVKIARECGWRKTSVSSVCHDPCAICLDTECTVSAEGCGHEFCTKCALYLCATASSSTSIRGVPGSIPCPLCRHTIVSFVRLTSTXPNKGASVXTNKSLALCAAGASTGSKYAGPAAITSSNIKKNLSET

SEQ ID NO: 3530 - protein, 552 aa, Oryza sativa
  unsure (1)..(552): unsure at all Xaa locations
SSRRSMGALAAVCVCMFVFVSSARAEDPYRFFDWEVTTGNINPLGVQQQGILINGQFPGPEIDCQTNDNLIVNVHNRLSEPFLLSWNGLQHRKNSWQDGVSGTNCPIPPGQNFTYQMQAKDQIGSFFYFPSLAFHKAAGGFGAIRIRSRPLIPVPFDPPAGEYTMLIGDWYKTSHKALQAMLDSGKQLPSPDGILINGKANGASFTVEQGKTYRLRVSNVGLQSTLNLRIQDHNMXRVVEVEGTHTVQNTYSSLYVHAGQSLSVLFTANRPPGVYQITVSTRFAKRALNSSAVLRYAGSSATISAPPPAGLADDIDFSLDQARSIRTNLTASGPRPNPQGSYHYGSINVTRTIRLANSAGRVAGKQRYAVNGVSFVEADTPLKLADYYRISDVFRLGGIPDAPPAGAAAAPRSEAAVMDSDYRSFLEIVFENSEDSVQIWHLDGYSLFVVGMDRGVWSEQSRKSYNLVDAVSRCTVQVYPRAWTAVLVALDNVGMWNLRSEDWARRYQGQQFYLRVYTPSHSFRDELPIPSNALRCGRATNASGRSRTLSRY

SEQ ID NO: 3531 - protein, 65 aa, Oryza sativa
  unsure (1)..(65): unsure at all Xaa locations
IQTXXXTIVXQHMFLNGYKNVLAVAVETEYSYPHADKIKEYLKDPSKXTFLYPLRXMCGAAAIXX

SEQ ID NO: 3532 - protein, 101 aa, Oryza sativa
  unsure (1)..(101): unsure at all Xaa locations
LASDFDQLHDRAPERAFVCKTCNRVFPSFQALGGHRASHKKPRLDGDGDLSLSKPKLHGCSICGLEFAIGQALGGHMRRHRAMTGGIKLSIELVVXSVATX

SEQ ID NO: 3533 - protein, 142 aa, Oryza sativa
  unsure (1)..(142): unsure at all Xaa locations
MASIEPSRPSSGPSLDSHSQYDPFGAAAAERHYRGVRRRPWGKWAAEIRDPNKAARVWLGTFDTAEAAAAAYDDAALRFKGAKAKLNFPERVRGRTGQGGFLVSPAGVSPAMAPRPPSTLPTTTTAASSPSAWPHGGGHGSX

SEQ ID NO: 3534 - protein, 238 aa, Oryza sativa
MAGGGGEYLRQFVEETAWYNEIFLSHVVPGDWWRALPHPLQSWLRNGLGGYLIYFACGFLWCFVIYYWKRHAYIPKDSIPTIEAMKKQIIVASKAMPLYCALPTLSEYMVENGWTQCYVNISEVGWPMYLVYLALYLIFGEFGIYWMHRELHDIKPLYKYLHTYHHIYNKENTLSPFAEAVWTTNIHDCIHGKVWPVMGAGYHTIHHTTYRHNYGHYTVWMDWMFGTLREPEDILKKD

SEQ ID NO: 3535 - protein, 259 aa, Oryza sativa
  unsure (1)..(259): unsure at all Xaa locations
VGVLGLSASAAAAAEEEEESAMRRRFQDSVKALEADIEHANELASEFLRDYDGAVIQMRMAYSAVAXXFLVQWIDCKLAGALGLLKIMIYKVYADGTTALPEWEREASIRQFYGVIFPSLLQLPSGITELDDRKQRRLCLQKFRKVEEXXVSEVDLERELECGICLEVNAKIVLPDCAHSLCMRCFEDWNTKSKSCPFCRACLKKVNPSSLWLYTDDRDVVDMDTLTRENIRRLFMFISKLPLVVLHVVDLDIYEYRIK

SEQ ID NO: 3536 - protein, 436 aa, Oryza sativa
MARGSGAGGGGGGGGGGLELSVGVGGGGGARGGGGGEAAAAVETAAPISLGRLILSGMVAGGVQYGWALQLSLLTPYVQTLGLSHALTSFMWLCGPIAGMVVVVIGFSADIGYAMGDTKEDCSVYHGSRWHAAIVYVLGFWLLDFSNNTVQIFLSLCLVITLIFAKEVPFKGNAALPTKSNEPAEPEGTGPLAVLKGFRNLPTGMPSVLIVTGLTWLSWFPFILYDTDWMGREIYHGDPKGTDPQIEAFNQGVRAATNHGLLIVQIVLGFSSFLIEPMCRKVGPRVVWVTSNFLVCIAMAATALISFWSLKDFHGTVQKAITADKSIKAVCLVLFAFLGVPLAVLYSVPFAVTAQLAATRGGGQGLCTGVLNISIVIPQVVIALGAGPWDELFGKGNIPAFGLASGFALIGGVAGIFLLPKISKRQFRSVSMGGGH

SEQ ID NO: 3537 - protein, 539 aa, Oryza sativa
  unsure (1)..(539): unsure at all Xaa locations
MARGSGAGGGGGGGGGGLELSVGVGGGGGARGGGGGEAAAAVETAAPISLGRLILSGMVAGGVQYGWALQLSLLTPYVQTLGLSHALTSFMWLCGPIAGMVVQPCVGLYSDRCTSKWGRRRPYILTGCVLICLAVVVIGFSADIGYAMGDTKEDCSVYHGSRWHAAIVYVLGFWLLDFSNNTVQGPARALMADLSGRHGPGTANSIFCSWMAMGNILGYSSGSTNNWHKWFPFLKTRACCEACANLKGAFLVAVIFLSLCLVITLIFAKEVPFKGNAAPPNXKSNEPAEPEGTGPLAVLKGFRNLPTGMPSVLIVTGLTWLSWFPFILYDTDWIGREIYHGDPKGTDPQIEAFNQGVRAGAFGLLLNSIVLGFSSFLIEPMCRKVGPRVVWVTSNFLVCIAMAATALISFWSLKDFHGTVQKAITADKSIKAVCLVLFAFLGVPLAVLYSVPFAVTAQLAATRGGGQGLCTGVLNISIVIPQVVIALGAGPWDELFGKGNIPAFGLASGFALIGGVAGIFLLPKISKRQFRSVSMGGGH

SEQ ID NO: 3538 - protein, 499 aa, Oryza sativa
  unsure (1)..(499): unsure at all Xaa locations
MAPVSLPPGFRFHPTDEELIIYYLKRKINGRQIELEIIPEVDLYKCEPWDLPEKSFLPSKDLEWYFFSPRDRKYPNGSRTNRATKAGYWKATGKDRKVNSQRRAVGMKKTLVYYRGRAPHGSRTDWVMHEYRLDERECETDTGLQDAYALCRVFKKTAPGPKIIEQHHHVEQPQWMTSSIDRSPTLDVSCDGRGDDFESSSFSFPTETPMDSMHGGFGMQMSAPHEDGKWMQFLSEDASNPFLTNPVSANFSCLPSKVDVALECARLQHRLXXLPPLEVEDFPHDTKIGILRSNPNDDILQEFLSVATASQELINGSTSSYPEMWLGASTSSASYVNELSSLVEMGGVGVEIADMEVFKDEKKRVENLRGVKLVNNDLGEIVVEGDESXXPTEDIIAQYPIKVTADNSGEAGHRMTDPTDVGGIDTAPIFSQSQPDDFAAGFDDVNPNASFDLYEKVDVNHRLFVSRVAAAKTFFHRIEPSKKVSFHSNPATPAECDHX

SEQ ID NO: 3539 - protein, 947 aa, Oryza sativa
MPSVSRAVCVQRASGNNGRRCRDGAAAAGRRSVVAQRARHGKPEVAIRSGSGGSARGGHCSPLRAVAAPIPTTKKRVFHFGKGKSEGNKAMKDLLGGKGANLAEMASIGLSVPPGFTVSTEACQQYQAAGKTLPAGLWEEIVEGLQWVEEYMAARLGDPARPLLLSVRSGAAVSMPGMMDTVLNLGLNDEVAAGLAAKSGDRFAYDSYRRFLDMFGNVVMDIPHALFEEKLEAMKAVKGLHNDTDLTATDLKELVAQYKDVYVEAKGEPFPSDPKKQLQLAVLAVFNSWDSPRAIKYRSINKITGLKGTAVNVQTMVFGNMGNTSGTGVLFTRNPSTGEKKLYGEFLVNAQGEDVVAGIRTPEDLDAMRDHMPEPYEELVENCKILESHYKEMMDIEFTVQENRLWMLQCRTGKRTGKGAVKIALDMVNEGLVERRTALKMVEPGHLDQLLHPQFENPSGYKDKVIATGLPASPGAAVGQIVFTAEDAEAWHAQGKDVILVRTETSPEDVGGMHAAVGILTARGGMTSHAAVVARGWGKCCVSGCSSVRVNDASKIVVIEDKALHEGEWLSLNGSTGEVIIGKQPLCPPALSGDLETFMSWVDEVRKLKVMANADTPEDATTARQNGAEGIGLCRTEHMFFASDERIKAVRQMIMASSLELRQKALDRLLPYQRSDFEGIFRAMDGLPVTIRLLDPPLHEFLPEGHVEDMVRELCSETGAAQDDVLARVEKLSEVNPMLGFRGCRLGISYPELTEMQARAIFEAAITMTNQGIQVFPEIMVPLVGTPQELGHQVDVIRQIANKVFTDMGKTIGYKVGTMIEIPRAALVADEIAEQAEFFSFGTNDLTQMTFGYSRDDVGKFLPIYLSQGILQHDPFEVLDQRGVGELVKLATERGRKARPNLKVGICGEHGGEPLSVAFFAKAGLDYVSCSPFRVPIARLAAAQVLL

SEQ ID NO: 3540 - protein, 546 aa, Oryza sativa
MLPRNFESAGAVPLVEGNIAREEAMWEPEAREDAVRRRGGENARRRPPRAFRRRARGRPPRALAFSPVRPRRPGLTLLARTAAGPLLLIGWMPSCHDKSRLVYVIYVACFHFVVNEIWNAASGKLVKGFASTCKGSNWRYREMGGALNKFTSTLETAALSLLWEPLLVKQLACCMNQPCNDEQYAFRNMHKKEHAKKLKQCNHSCNYENIGCLLRPFDGYVLFPIFAVSFFSDNLSGYGYLDEQFNQLEELQDESSPNFVEEVAALFFKDSSRLLTNIEQAIIGALRMKNECSVFKVNCNDRNLEGCRRSLQKMKREHATLKQKLESYFQHCYMAKQLGYLLFLLLMQLLRQVGPRDYAAQETKPNPWAWASLSLRFIYSDARTAYPIPSIPQALTPLSLPWRSSPSTPWPRPRPPSPPPTTTPPSPPTARSPPPPHSPAPALASPPPPPPPSRPRSLQFLKIETKTSQFEPITIPTQITPFGVTSLLRERGQEDQEGKKVQPLVRKCEAAQQEEGNWPCTAVRAACASEEGPVRRRRGHPDRHRR

SEQ ID NO: 3541 - protein, 324 aa, Oryza sativa
  unsure (1)..(324): unsure at all Xaa locations
MAMATTSSKNERWSLAGATALVTGGSKGIGRAIVEELASLGATVHTCARTEAPLNRCREELTAKGLAVTVSVCDVSLRADREALAGTVRELFGGKLSILVNCAGMSFLKPAVELTPDDCSQVMGMNFESCFHLSQLAYPLLKASQRGCIINISSIASVVAFCSLPNAVYSAAKGAMNQVTRNLAAEWANDGIRVNCVAPGFIRTPLLSEFVEGNELGRAEFSRVPMGRLGEPEDIASLVXAFLSMPASSYITGQVICADGGRCLSXSGWSXFLKDILITCYVERYGRINGICLPRANQARINLSGKRTDCWVCQNDRSYHIYFK

SEQ ID NO: 3542 - protein, 626 aa, Oryza sativa
MFDLNIVLNDFLYEHGVSTRKKLTGTEQEAGSSPEEEAKRRGRRLRQKKTESLAGGGDDARRRVGIRRTGKWTIKSSDDVDVDIYNPTPTPLLLVVGEYIGRGDGESGKWAVLSPPLPAGFRLQIRAARRRRARSSGSYSCRLRFDAACTGERRSAWRALPDARLASSPFITSVTTPRRRGGWVCFSRRADSIRRRRRRRGRGRGRLCPVSTLPRLCVRRDLQQVPNSTQFRHELTPPPSPAALEFLSSVGLEFKYKMAMMVDPPNGMGNQGKHYYTMWQTLFEIDTKYVPIKPIGRGAYGIVCSSINRATNEKVAIKKINNVFDNRVDALRTLRELKLLRHLRHENVIALKDIMMPVHRRSFKDVYLVYELMDTDLHQIIKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSEADIEFIDNPKARKYIKTLPYTPGIPLTSMYPQAHPLAIDLLQKMLVFDPSKRISVTEALEHPYMSPLYDPSANPPAQVPIDLDIDENLGVDMIREMMWQEMLHYHPEVVAGVNM

SEQ ID NO: 3543 - protein, 839 aa, Oryza sativa
MPRYDDHYGSTRLYVGRLSSRTRSRDLEYLFGRYGRSCVFDLNDLVEGFSVFYTTREWKLQVGDAFEYLSHDGLLFGNHWCRIREVELKRDYAFIEFSDPRDADEARYNLDGRDVDGSRILVEFAKGVPRGAAGGSREYMGRGPPPGTGRCFNCGIDGHWARDCKAGDWKNKCYRCGERGEREVIRAPHRHAVDVVMVVVVAIAGAGAGVTADLGPDPYLDLPGDAEIVMIGDQGVLATAEVPGDPSPQQQMERSATPARMVGGVQGVHRIGENSRSPSDGYRSPVAANGRSPSPRNNGSPSPMDNNSRSPRDNGSPSPRDGNGDGGSQPAVDTRAHTRPVNQTTPTRASAPKQSRGKRTAYHRGVKTVGMKRCSVDRKFPRTFLPITHQLNTGGSAGPQPNPTDRTASGFVRLRRFTVGAWRGCRMCRLTVENALPRRPIATGSPHPRRPLYPPTKRTRENGEEEEGLGMDGAPVAEFRPTMTHGGRYLLYDIFGNKFEVTNKYQPPIMPIGRGAYGIVCSVMNFETREMVAIKKIANAFNNDMDAKRTLREIKLLRHLDHENIIGIRDVIPPPIPQAFNDVYIATELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQYPRRTFASMFPRVQPAALDLIERMLTFNPLQRITVEEALDHPYLERLHDIADEPICLEPFSFDFEQKALNEDQMKQLIFNEAIEMNPNIRY

SEQ ID NO: 3544 - protein, 497 aa, Oryza sativa
  unsure (1)..(497): unsure at all Xaa locations
TTTRHRLRDAAVASVVAVLPHEISPLISAASTFFFILSAYFAVLPLRDEGAISLGLSSLPGLFAGSLLLTLVAAPVASLAFSLPSIPKPRALVFIHRFFSLSLLVFFVLWFASTPGHSPSISQVIYIAINLDASNKPPGWGNHSWFYILVRISLFLWVSLLNLIAISSTWARVIDIMDIQSGSRLFGFIGAGATLGQLFGSLFAATMALLGPFLLLFSSLLMELAALSSKGICTDDLHGSTELSSTMYVSFXHQNTEADDEMSSLVTSQGLPSQVSESQKTKPEIFVMFEGFWLIARSPYLMYISLFLWLSAVVSSFFYFQKVTIVATTISSPTARRRTFALINSFIAVFILAGQLTLTGRILTIAGVTVAICASPFIATLNMVALALWPTWVAVAVTETIRKVTTYVLTRPGRELLFTVVSQDEKYKAKVLIDVVVQRLGDATAAGIYSLLFSSLEKKASMVTLYALPLCFVWLLTAFHLGRLQTNLVKVQVASFA

SEQ ID NO: 3545 - protein, 276 aa, Oryza sativa
  unsure (1)..(276): unsure at all Xaa locations
MTTTTTTRHRLRDAAVASVVAVLPPVLLLFSSLLMELAALSSKGICTDDLHGSTELSSTXXAEQSQNTEADDEMSSLVTSQGLPSQVSESQKTKPEIFVMFEGFWLIARSPYLMYISLFLWLSAVVSSFFYFQGRILTIAGVTVAICASPFIATLNMVALALWPTWVAVAVTETIRKVTTYVLTRPGRELLFTVVSQDEKYKAKILIDVVVQRLGDATAAGIYSLLFSSLEKKASMVTLYALPLCFVWLLTAFHLGRLQTNLVKVQVASFASSIPR

SEQ ID NO: 3546 - protein, 82 aa, Oryza sativa
  unsure (1)..(82): unsure at all Xaa locations
XFAPHIFLNGYKNLFFFFLETKFLYPHFYKFKEFFKDPSKFVVAAPVSPDSGVVAPSAAKEEKKKEKPQEESDGYLGISLFD

SEQ ID NO: 3547 - protein, 430 aa, Oryza sativa
  unsure (1)..(430): unsure at all Xaa locations
MRRTEDGWPSAWVPPPPLSHPLPIPPRPTPPSTRRRTPAHPAPPPPPPSSQAARPAPPSIVAFPVLPIPPLELRVKRGSKRLLRQAPPLALLPSRRACRRRRHPAASCFSCRSVEVTNSSFVCFPVKFPKLDPPLEEEEKWTAEEESALKAGIAKHGAGKWRTILKDPDFSNVLRYRSNVDLKDKWRNMNVTVNASGARDRVKAPVVKKPRSAPKHEGHSTSTAIAAVTSDGDDDVAEPVPLATSTSSKRSLSRLDNIIVEAVRSLNEPTGSGSPACAHYIEEQYWPPADFDHVLSSKLNDLTASGKLIKVNRKYRIAPSSSLSEGRSSKVVLLGYKKRTNXKLDREDVAVLTKSQIDAELARMRTMTAEEAAAAAARAVAEAEAIMTEAEAAVREAEAAEADAVAAQAFAEAAMATFKNRSSAKLIIRA

SEQ ID NO: 3548 - protein, 336 aa, Oryza sativa
  unsure (1)..(336): unsure at all Xaa locations
XWRSRSSLSPVAAVSFLDSNRGGAFNQLKDKFRVVALAAGSNVTLLADQVKTFKPKLVAVRNESLVDELKEALADCDWKPEIIPGEQGVIEVARHPDAVTVVTGIVGCAGLKPTVAAIEAGKDIALANKETLIAGGAFRDWPVDKLKEVKVADALKHPNWNMGKKITVDSATLFNKGLEVIEAHYLFGAEYDDIEIVIHPQSIIHSMIETQDSSVLAQLGWPDMRIPILYTMLGSLTFKAPDNVKYPSMDLAYAAGRAGGTMTGVLSAANEKAVELFIDEKIGYLDIFKVVELTCDAHRNELVTRPSLEEIIHYDLWAREYAASLQPSTGLSPVPV

SEQ ID NO: 3549 - protein, 553 aa, Oryza sativa
GRRREKSISLKEHRLLALQSIGVSDSHLVVLSLHSAPHNLLLPPLLCLYTTPSLPHSPASASRPDVESSINSVRVAMALKVVSFPGDLAAVSFLDSNRGGAFNQLKGWIFLDLPFQTRDRRAVSLRRTCCSMQQAPPPAWPGRAVVEPGRRSWDGPKPISIVGSTGSIGTQTLDIVAENPDKFRVVALAAGSNVTLLADQVKTFKPKLVAVRNESLVDELKEALADCDWKPEIIPGEQGVIEVARHPDAVTVVTGIVGCAGLKPTVAAIEAGKDIALANKETLIAGGPFVLPLAQKHKVKILPADSEHSAIFQCIQGLPEGALRRIILTASGGAFRDWPVDKLKEVKVADALKHPNWNMGKKITVDSATLFNKGLEVIEAHYLFGAEYDDIEIVIHPQSIIHSMIETQDSSVLAQLGWPDMRIPILYTMSWPDRIYCSEVTWPRLDLCKLGSLTFKAPDNVKYPSMDLAYAAGRAGGTMTGVLSAANEKAVELFIDEKIGYLDIFKVVELTCDAHRNELVTRPSLEEIIHYDLWAREYAASLQPSTGLSPVPV

SEQ ID NO: 3550 - protein, 438 aa, Oryza sativa
MDSAARASQSAAPPPPGAGVRVRAPLVESVSCYCRLDTGLKTVVDARKFVPGAKMCMQPDVKPNKCKSRGSRKERSRTQAPLLPGLPDDLAIACLIRVPRVEHPNLRIVCKRWNRLLSGNYYYSLRKRNGMAEEWVYVFKRDREGKISWHAFDPLHQLWKSLPPVPAEYSEALGFGCAVLSGCYLYLFGGKDPLRGSMRRVVFYNARTNKWHRAPDMLRKRHFFGSCVINNCLYVAGGECEGIQRTLPSAEVYDPNRNRWACVAEMNNGMVPFIGVVYDGKWFLKGLDSHRQVTSEVYLPSSNLWSTIDDEMVTGWRNPSITFNGKLYSSDCRDGCKLRVYDPNTGTWAKFMDSKHHLGSSRAFEAAALVTLNGKLCIVRNNMSITLVDISDPTMNSARMWETVARKGQHRSFVANLWSTIAGRNLKSHIIHCQVLQV

SEQ ID NO: 3551 - protein, 259 aa, Oryza sativa
  unsure (1)..(259): unsure at all Xaa locations
GRLARPISIAAIFTPSPLRFLLFTSKPLFHSPRRRRLRRRGGWEGRTSPVRARWWPGRATPSSPCDVGKMEHGCEHYRRRCKIVAPCCGEVFACRHCHNDATASXXDRHTICRQDVEKVVCLLCDTEQPVSQVCINCGVNMGEYFCDVCKFYDDDTEKGQFHCYDCGICRVGGKENYFHCAKCGSCYAVALRDNHQCVENSMRQNCPICYEYLFDSLKXTRVLDCGHTMHMECFSEMVGHNKYTCPICSKTALDMTHHX

SEQ ID NO: 3552 - protein, 398 aa, Oryza sativa
MHASRMEQTTGVSGHEHIIDIPRDSGPSTSTSHSVARENHGEPNPVDRSATRALVPALQAPSAVASAGHTSGARRSDNYVRRHRSPLNSGLWISIEVLVNVSQIVAAIVVLSLSRKEHPQAPLFEWVIGYTVGCFATLPHLYWRYIHRNIVNGENEPAHTLQGSSQNNSTEPSASASERRRNAARNAVLANPRINALFDHFKMALDCFFAVWFVVGNVWIFGGRSSAADAPNLYRLCIVFLTFSCIGYAMPFILCAMICCCLPCIISVMGFREDTNNTRGATSESINSLPTYKFKTKKRRHSSGNEAEGQDGGIVAAGTDKERSLSAEDAVCCICLAKYAHNDELRELPCTHCFHKECVDKWLKINALCPLCKSEIASSSGTSDTRWILLSKVVRAFD

SEQ ID NO: 3553 - protein, 139 aa, Oryza sativa
  unsure (1)..(139): unsure at all Xaa locations
MAALLGRRFGMAAAALIALAALGSAASGTASKSSFVKSTVKAHDVVIFSKSYCPYCRRAKAVFKELEQEPYVVELDQREDGWEIQDALSDMVGRRTVPQVFVHGKHLGGSDDTVEAYESGKLAKLLNIDVKEDLXVVIV

SEQ ID NO: 3554 - protein, 334 aa, Oryza sativa
MAGAQESLVLAGVMHGHNDVVTAIATPIDNSPFIVSSSRDKSLLVWDLTNPVQNVGEGAGASEYGVPFRRLTGHSHFVQDVVLSSDGQFALSGSWDGELRLWDLSTGVTTRRFVGHDKDVLSVAFSVDNRQIVSASRDRTIKLWNTLGECKYTIGGDLGGGEGHNGWVSCVRFSPNTFQPTIVSGSWDRTVKVWNLTNCKLRCNLEGHGGYVNAVAVSPDGSLCASGGKDGVTLLWDLAEGKRLYSLDAGSIIHSLCFSPNRYWLCAATQDSIKIWDLESKHIVQDLKPEIPVSKNQMLYCTSLNWSADGSTLYAGYTDGTIRIYKISGFSYAG

SEQ ID NO: 3555 - protein, 381 aa, Oryza sativa
MASSTQGQVITCKAAVAWEANKPMTIEDVQVAPPQAGEVRVKILFTALCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 3556 - protein, 398 aa, Oryza sativa
MDAGAQPPDTEMAEAGGGQQPPAAAAAAGAGAGAGMMENIQATLSHGGRFIQYNIFGNVFEVTAKYKPPILPIGKGAYGIVCSALNSETGEQVAIKKIANAFDNKIDAKRTLREIKLLRHMDHENIVAIRDIIPPPQRNSFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEADLDFVNENARRYIRQLPRHARQSFPEKFPHVHPLAIDLVEKMLTFDPRQRITVEGALAHPYLASLHDISDEPVCSSPFSFDFEQHALSEEQMKDLIYQEGLAFNPDYQ

SEQ ID NO: 3557 - protein, 349 aa, Oryza sativa
  unsure (1)..(349): unsure at all Xaa locations
RAAGIRHEASSPLLSFQEEQGKLRTFSSSQVVLLYNTKKRSSKGLVDGFPLAIHDCIEALLGREEQQHIPMDYLQRLLLQPDGLDLVAVRSDAIDWIWKVHELYKFGPLTAVLSVNYLDRFLSVFDLPVKACMTQLLAVASLSLAAKMEETVVPHPLDLQVCDAKYVFETRTIKRMELAVLNALKWRMQAVTACSFIDYYLHKFNDDDTPSTSALSRSVDLILSTCKGVNFVVFRPSEIAASVALGASEEHETSMFERVATCYXXNLKKERVLRCYEMIQDKIIMRNSQSAGSVFSIPKSPIGVLDAAACISQQSEDTFVGSPATNYESSASSKRRRICRXLFSLYICS

SEQ ID NO: 3558 - protein, 707 aa, Oryza sativa
MADLQEPLVRPKRKKVLVDYLVKFRWILVIFVVLPISALIYFNIYLGDVWSAMKSEKRRQKEHDDNVQKVVKRLKQRNPKKDGLVCTARKPWIAVGMRNVDYKRARHFEVDLSAFRNILEIDRERMVAKVEPLVNMGQITRATCPMNLALAVVAELDDLTVGGLINGYGIEGSSHLYGLFSDTVVAVEVVLADGRVVRATKDNEYSDLFYGIPWSQGTLGFLVSAEIKLIPIKEYMRLTYTPVKGSLKEIAQGYCDSFAPRDGDPAKVPDFVEGMVYTENEGVMMTGVYASKEEAKKKGNKINCVGWWFKPWFYQHAQTALKKGEFVEYIPTREYYHRHTRCLYWEGKLILPFGDQFWFRFLLGWLMPPKVSLLKATQGESIRNYYHDNHVIQDMLVPLYKVGDALEFVHKEMEVYPLWLCPHRLYKLPVKTMVYPEPGFEHHHRQGDTSYAQMFTDVGVYYAPGAVLRGEEFNGALAVHRLEQWLIENHSYQPQYAVSELNEKDFWRMFDASHYEHCRQKYGAVGTFMSVYYKSKKGRKTEKEVQEAEAAILEPAYADEADRGGALPPPAASTHPVLAGGAKPPVTIPDPIAALLSSTPIPSSSDASARPPPYPYQPESAADPTRQAFTAEQINETTYVDIHGNKSVFDSLRNNPKVHYDGRRFSYKSKHDLKGKDQLLVLVRKYPEGLAVVEVKDAYPTVMEDLQ

SEQ ID NO: 3559 - protein, 849 aa, Oryza sativa
MADLQEPLVRPKRKKVLVDYLVKFRWILVIFVVLPISALIYFNIYLGDVWSAMKSEKRRQKEHDDNVQKVVKRLKQRNPKKDGLVCTARKPWIAVGMRNVDYKRARHFEVDLSAFRNILEIDRERMVAKVEPLVNMGQITRATCPMNLALAVVAELDDLTVGGLINGYGIEGSSHLYGLFSDTVVAVEVVLADGRVVRATKDNEYSDLFYGIPWSQGTLGFLVSAEIKLIPIKEYMRLTYTPVKGSLKEIAQGYCDSFAPRDGDPAKVPDFVEGMVYTENEGVMMTGVYASKEEAKKKGNKINCVGWWFKPWFYQHAQTALKKGEFVEYIPTREYYHRHTRCLYWEGKLILPFGDQFWFRFLLGWLMPPKVSLLKATQGESIRNYYHDNHVIQDMLVPLYKVGDALEFVHKEMEVYPLWLCPHRLYKLPVKTMVYPEPGFEHHHRQGDTSYAQMFTDVGVYYAPGAVLRGEEFNGALAVHRLEQWLIENHSYQPQYAVSELNEKDFWRMFDASHYEHCRQKYGAVGTFMSVYYKSKKGRKTEKESSEVGVPAKQDLETKIIKIRCNTPSRKSHPLLRKRTARIQPRQTKPRLYETRERTTHLSPPPPPPSFSARERPSSDRGGALPPPAASTHPVLAGGAKPPVTIPDPIAALLSSTPIPSSSDASARPPPYPYQPESAADPMDLKDSLSKFKQQQERCQSSLASIAASTSKPKHRAQPVNAPSAPARPLQPIKFSNDTERLQHINSVRKSPIGAQIKLVIELLYKTRQAFTAEQINETTYVDIHGNKSVFDSLRNNPKVHYDGRRFSYKSKHDLKGKDQLLVLVRKYPEGLAVVEVKDAYPTVMEDLQ

SEQ ID NO: 3560 - protein, 291 aa, Oryza sativa
  unsure (1)..(291): unsure at all Xaa locations
EAXLARKPFHFSAMRLSSLLFLVCFFTVAMSQLXAAAAKARHFRWEVSNMFWSPDCEEKVVIGINGQFPGPTIRAKAGDTIVVHLKNGLHTEGVVIHWHGIKQIRTPWADGTASISQCAINPEETFTYRFVVDKPGTYFYHGHYGMQRAAGLYGSLIVDVADGDEEPFKYDGEINLLLSDWYHESIYTQMVGLSSNPFRWIGEPQSLLINGRGQFNCSLAAAHTPGAKQCAAAGNRHCAPVILPVLPNKTYRLRVASTTSLASLNLAVGNHKLTVVEADGNYVEPFAVDDX

SEQ ID NO: 3561 - protein, 725 aa, Oryza sativa
MSAARRGLPGPVAHHWEIGCFPLRGREVLCIDQNGCCFLFDGDTRNAVTMPGLCQPKRFPLSLFVPSTGVDNDSGSLFIMESVVKPKSTSSGPRSDQFEAFVYRTPSPRRHLSSTCQSLPPPPFVRDPKFSNIRTKITSYAVVSGGSEMCISVEGAGTYCMDTVKHTWRHVGEWILPFNGKVKYVPELKLWFGLSAKTNHLAATDLSAMDDDCFQQPELLKTWMELSPPKNWWDLSNSHLVSLGSGRFCIARFFYTRHLMGYYYDQIVDNRFVVLTGVDVVPCVHDTSSGIANGGTGDLRMIKYESKLHVPNGSVKRDISGETDAVACVHGAIHRQFGHDASAIRRRFGQEARPGGYSEPGIKQNPRHQPCRPAASTHPRSQRQGRAAWRLFGRGGGAGGRRSGASFLPDTMLPSHLNGHSPLARRCPRLSAASPPATGDSDAAAAAADAPLAEHDRIYFQSYSHIGIHEAMIKDRVRTDAYRSAIMHHQKFIEGKVVMDVGCGTGILSVFCARAGAKCVYAVEASEMATQAREIVKANNLDDKVVVVHGRVELFMAPITNSERYEGSVDFWSDVYGINMSALVPLAKKFTSEEPSIEIIGGENVLSWPFVVKHIDCYTFKAEELKSFTTKYKVSSMMLDKSPSDLNPLDVIRKKRRRGSEDPVVLSTAPEDEPTHWHQTILYFPDPIEVKQDQIIEGSVKVSQSEENPRFLNIQLDCTFHWRCR

SEQ ID NO: 3562 - protein, 428 aa, Oryza sativa
  unsure (1)..(428): unsure at all Xaa locations
PRATGGRSEQRRTHXXFRNLHLNLSRLPSIPSFLPAMLPSHLNGHSPLARRCPRLSAASPPATGDSDAAAAAADAPLAEHDRIYFQSYSHIGIHEAMIKDRVRTDAYRSAIMHHQKFIEGKVVMDVGCGTGILSVFCARAGAKCVYAVEASEMATQAREIVKANNLDDKVVVVHGRVECXDVEVEDKVDVIISEWMGYMLLYESMLPSVLFARDKWLKPGGLILPSHATLFMAPITNSERYEGSVDFWSDVYGINMSALVPLAKKFTWEEPSIEIIGGENVLSWPFVVKHIDCYTFKAEELKSFTTKYKVSSMMLAPIHGFGLWFEVEFNGPSNPTDKSPSXXLNPLDVIRKKRRRGSEDPVVLSTAPEDEPTHWHQTILYFPDPIEVNQIIEGSVKVSQSEENPRFLNIQLDCTTGGQTLVKDYAMR

SEQ ID NO: 3563 - protein, 265 aa, Oryza sativa
MSPAEPTREESVYKAKLAEQAERYEEMVEYMERVARAAGGASGGEELTVEERNLLSVAYKNVIGARRASWRIISSIEQKEEGRGNDAHAATIRSYRGKIEAELARICDGILALLDSHLVPSAGAAESKVFYLKMKGDYHRYLAEFKSGDERKQAAESTMNAYKAAQDIALADLAPTHPIRLGLALNFSVFYYEILNSPDRACNLAKQAFDEAISELDSLGEESYKDSTLIMQLLRDNLTLWTSDANDDGGDEIKEAAAPKEPGDQ

SEQ ID NO: 3564 - protein, 175 aa, Oryza sativa
SPSSAMAFFSHHHLQQPHPQAPPPPPPQQQQQPVPPSFRNALPVPVDGQIPAPLPFFNPPPAFQDQPAQPPLVDAMGLTAAAGLGWRQPREQELLGENSQMSSIDFLQTGSAVSTGLALSLEDRRHGGGSGAGAGNSSGDSPLLLLPMLDDDISREVQRLDADMDRFIKAQVRHS

SEQ ID NO: 3565 - protein, 334 aa, Oryza sativa
  unsure (1)..(334): unsure at all Xaa locations
MAFFSHHHLQQPHPQAPPPPPPQQQQQPVPPSFRNALPVPVDGQIPAPLPFFXTRRRPSRTSPRSHHWWTRWGLRPRRGXGXRQPREQELLGENSQMSSIDFLQTGSAVSTGLALSLEDRRHGASGDSPLLLLPMLDDDISREVQRLDADMDRFIKAQSERLRQSILEKVQAKQFEALASVEDKILRKIRDKEAEVENINKRNSELEDQIKQLAVEVGAWQQRAKYNESMINALKYNLEQVCAHQSKDFKEGCGDSEVDDTASCCNGGAANLQLMPKENRHSKDLTACRVCKSSEACMLLLPCRHLCLCKECESKLSFCPLCQSSKILGMEIYM

SEQ ID NO: 3566 - protein, 830 aa, Oryza sativa
  unsure (1)..(830): unsure at all Xaa locations
PPPPTKAAARGTSSPAAGRTVRRPRAVARTLECERRVVGEGFAVRRGIGRKELDSLDPFISLDEFEFSPPAGFHDHPHRGFENVTYMLEGGFSYHDFSGHKGTINTGDVQWMTAGRGVVHAEMPGGHGVQRGINLWINLSSKDKMVEPRYQELASHDIPAAERDGVSVKVIAGEALGARSPLQTRTPALCLDVAMRPGARLRAPVPPGWSACSYVIDGEAVFGDEAAAAGAHTCVVFGGGGDGVAARATERSAARFLLVAARPHGEAVVKDGPFVMNTREEVEQAREDYRNRRNGFEMAAGWSSDHVATAAAAHDGHRRRRGRCTMXXHQXSSRSQVNAAFAREDRNFGNFVAKLMPKIFGFVILEKFWRWAPTFQETGGTSRYTGGLITAWRNAKFKAALTCSFHSTIDQTSFLITNIYAPHANSERQEVFDLLTALRTTRLEPWMRIGDFNIYRFPHEKNNDSINTRGMEEFNSWINGEGLFDIDIPSRKFTWSNKRRCPTSVKLDRVLIDTAWNQTFANASAKALIATTSDHIPILAEFSDNCSKSDIFRLENYWLQMPDFIAMTETNWSRGTRPLTAISKLNHKLRRLRASTKAWNRNKRSIPTLLQLFSETSPSDPTFTLPLLYPQQECLQSLCTPFTKEEIVKVIHIFQDLFDNNIDLSGVNQSYITLIPKSGFIRGRSITENFILASELVQSALKGKKPMIVLKLDFHKAFDTVSWDALFRIMEARGFPDKRIGWIKALLCTGKAQITNNGQKGEQIQYKRGEHRPICKYADDTLILLKGEADQATAIKEILDSFANFSGLTPRRIWSANAGAKIRTARFARH

SEQ ID NO: 3567 - protein, 338 aa, Oryza sativa
  unsure (1)..(338): unsure at all Xaa locations
MGKKKKRVEKVFCYYCDREFDDEKILVQHQKAKHFKCHVCHKKLSTAGGMAIHVLQVHKESVTKVPNAKPERESTEIEIFGMQGIPPDVLAAHYGEEEDPSSKVAKVEVPSLXXPPVMPNPAGMVYPPRPAYGVAPPMYNPALNPLMARPPIWPAPPPQPWFTQPVVSVPQMASGLAPQQPLFPIQNMXXAPMTSAPANLLQTSFPMAHVGVPSPGTPQVSQPLFPVSTSAGNGAVKSPYVASVAPGSIPTSSPSVAPAGVGYAATNQGTGGPAAVPPPASNNKAPATQPGANEVYLVWDDEAMSMEERRLSLPKYQVHDETSQVSSVNTAIFIILYL

SEQ ID NO: 3568 - protein, 720 aa, Oryza sativa
MALTTFSISRGGFVGALPQEGHFAPAAAELSLHKLQSRPHKARRRSSSSISASLSTEREAAEYHSQRPPTPLLDTVNYPIHMKNLSLKELQQLADELRSDVIFHVSKTGGHLGSSLGVVELTVALHYVFNTPQDKILWDVGHQSYPHKILTGRRDKMPTMRQTNGLSGFTKRSESEYDSFGTGHSSTTISAALGMAVGRDLKGGKNNVVAVIGDGAMTAGQAYEAMNNAGYLDSDMIVILNDNKQVSLPTATLDGPAPPVGALSSALSKLQSSRPLRELREVAKGVTKQIGGSVHELAAKVDEYARGMISGSGSTLFEELGLYYIGPVDGHNIDDLITILREVKSTKTTGPVLIHVVTEKGRGYPYAERAADKYHGVAKFDPATGKQFKSPAKTLSYTNYFAEALIAEAEQDNRVVAIHAAMGGGTGLNYFLRRFPNRCFDVGIAEQHAVTFAAGLACEGLKPFCAIYSSFLQRGYDQVVHDVDLQKLPVRFAMDRAGLVGADGPTHCGAFDVTYMACLPNMVVMAPSDEAELCHMVATAAAIDDRPSCFRYPRGNGIGVPLPPNYKGVPLEVGKGRVLLEGERVALLGYGSAVQYCLAAASLVERHGLKVTVADARFCKPLDQTLIRRLASSHEVLLTVEEGSIGGFGSHVAQFMALDGLLDGKLKWRPLVLPDRYIDHGSPADQLAEAGLTPSHIAATVFNVLGQAREALAIMTVPNA

SEQ ID NO: 3569 - protein, 94 aa, Oryza sativa
  unsure (1)..(94): unsure at all Xaa locations
MXTAEAXREENVSMAQLDEHGERCKEMDEFIANVALTTDVRELTLVDRNLLFVSYKNDIGAQDALHKSISSIDQKEDSTWNEAYVASINDLQLR

SEQ ID NO: 3570 - protein, 944 aa, Oryza sativa
  unsure (1)..(944): unsure at all Xaa locations
MMESGVPPCAACGDDAHAACRACSYALCKACLDEDAAEGRTTCARCGGEYDNVVWDFVXXTGXRSSXARTMSTHARTISSVSGVGSELNDESGKPIWKNRVESWKEKKKEKKASAKKAAAKAQAPPVEEQIMDEKEPDAYEPLSRIIPISKNKLTPYRAVIIMRLVVLGLFFHYRITNPVYSAFGLWMTSVICEIWFGFSWILDQFPKWCPINRETYVDRLIARCVRYGEDSGLAPVDFFVSTVDPLKEPPLITANTVLSILAVDYPVEKISCYVSDDGSAMLTFESLAETAEFARRWVPFCKKYSIEPRAPEFYFSQKIDYLKDKIHPSFVKXERRAMKRDYEEYKVRINALVAKAQKTPEEGWIMQDGTPWPGNNPRDHPGMIQVFLGETGARDFDGNELPRLVYVSREKRPGYQHHKKAGAMNALVRVSAVLTNAPYILNLDCDHYVNNSKAVREAMCFMMDPSVGRDVCYVQFPQRFDGIDRSDRYANRNVVFFDVNMKGLDGLQGPVYVGTGCCFYRQALYGYGPPSLPALPKSSVCSWCCCCCPKKKAEKSEKEMHRDSRREDLESAIFNLREIDNYDEYERSMLISQMSFEKSFGLSSVFIESTLMENGGVPESANPSTLIKEAIHVISCGYEEKTEWGKEIGWIYGSVTEDILTGFKMHCRGWRSIYCMPIRPAFKGSAPINLSDRLHQVLRWALGSVEIFLSRHCPLWYGYGGGRLKWLQRLSYINTIVYPFTSLPLIAYCCLPAICLLTGKFIIPTVRCLSLYMFLGIGIEDWWRNEQFWVIGGVSAHLFAVFQGILKMIAGLDTNFTVTAKATDDTEFGELYVFKWTTVLIPPTSILVLNLVGVVAGFSDALNSGYESWGPLFGKVFFAMWVIMHLYPFLKGLMGRQNRTPTIVVLWSVLLASVFSLLWVKIDPFIGSSXXTTTTNSCANFDC

SEQ ID NO: 3571 - protein, 860 aa, Oryza sativa
  unsure (1)..(860): unsure at all Xaa locations
MESGVPPCAACGDDAHAACRACSYALCKACLDEDAAEGRTTCARCGGEYGAPDPAHGQGAVVEEEVEESHEPAAGGVRERVTMASQLSDHQDEGVHARTMSTHARTISSVSGVGSELNDESGKPIWKNRVESWKEKKKEKKASAKKAAAKAQAPPVEEQIMDEKDLTDAYEPLSRIIPISKNKLTPYRAVIIMRLVVLGLFFHYRITNPVYSAFGLWMTSVICEIWFGFSWILDQFPKWCPINRETYVDRLIARYGDGEDSGLAPVDFFVSTVDPLKEPPLITANTVLSILAVDYPVEKISCYVSDDGSAMLTFESLAETAEFARRWVPFCKKYSIEPRAPEFYFSQKIDYLKDKIHPSFVKXERRAMXDGTPWPGNNPRDHPGMIQVFLGETGARDFDGNELPRLVYVSREKRPGYQHHKKAGAMNALVRVSAVLTNAPYILNLDCDHYVNNSKAVREAMCFMMDPSVGRDVCYVQFPQRFDGIDRSDRYANRNVVFFDKKAEKSEKEMHRDSRREDLESAIFNLREIDNYDEYERSMLISQMSFEKSFGLSSVFIESTLMENGGVPESANPSTLIKEAIHVISCGYEEKTEWGKEVLRWALGSVEIFLSRHCPLWYGYGGGRLKWLQRLSYINTIVYPFTSLPLIAYCCLPAICLLTGKFIIPTLSNAATIWFLGLFISIIVTSVLELRWSGIGIEDWWRNEQFWVIGGVSAHLFAVFQGILKMIAGLDTNFTVTAKATDDTEFGELYVFKWTTVLIPPTSILVLNLVGVVAGFSDALNSGYESWGPLFGKVFFAMWVIMHLYPFLKGLMGRQNRTPTIVVLWSVLLASVFSLLWVKIDPFIGSSETTTTNSCANFDC

SEQ ID NO: 3572 - protein, 918 aa, Oryza sativa
  unsure (1)..(918): unsure at all Xaa locations
MMESGVPPCAACGDDAHAACRACSYALCKACLDEDAAEGRTTCARCGGEYEQLERSXXLLTMLCGILWEQDEGVHARTMSTHARTISSVSGVGSELNDESGKPIWKNRVESWKEKKKEKKASAKKAAAKAQAPPVEEQIMDEKXXTDAYEPLSRIIPISKNKLTPYRAVIIMRFVVLGLFFHYGGPTPVYSAVGLWMTSVICEIWFGFSWILDQFPKWCPINRETYVDRLIARYGDGEDSGLAPVDFFVSTVDPLKEPPLITANTVLSILAVDYPVEKISCYVSDDGSAMLTFESLAETAEFARRWVPFCKKYSIEPRAPEFYFSQKIDYLKDKIHPSFVKERRAMKRDYEEYKVRINALVAKAQKTPEEGWIMQDGTPWPGNNPRDHPGMIQVFLGETGARDFDGNELPRLVYVSREKRPGYQHHKKAGAMNALVRVSAVLTNAPYILNLDCDHYVNNSKAVREAMCFMMDPSVGRDVCYVQFPQRFDGIDRSDRYANRNVVFFDVNMKGLDGLQGPVYVGTGCCFYRQALYGYGPPSLPALPKSSVCSWCCCCCPKKKAEKSEKEMHRDSRREDLESAIFNLREIDNYDEYERSMLISQMSFEKSFGLSSVFIESTLMENGGVPESANPSTLIKEAIHVISCGYEEKTEWGKEVLRWALGSVEIFLSRHCPLWYGYGGGRLKWLQRLSYINTIVYPFTSLPLIAYCCLPAICLLTGKFIIPTLSNAATIWFLGLFISIIVTSVLELRWSGIGIEDWWRNEQFWVIGGVSAHLFAVFQGILKMIAGLDTNFTVTAKATDDTEFGELYVFKWTTVLIPPTSILVLNLVGVVAGFSDALNSGYESWGPLFGKVFFAMWVIMHLYPFLKGLMGRQNRTPTIVVLWSVLLASVFSLLWVKIDPFIGSSETTTTNSCANFDC

SEQ ID NO: 3573 - protein, 240 aa, Oryza sativa
MICVIFPFVISSNFIAIHLKNLNFIVQIRGHSMGRGKIAIKRIDNTMNRQVTFSKRRGGLMKKARELAILCDADVGLIVFSCTGRLYDFSSSSSMKSIIERYQEAGEEHCRLLNPMSEAKFWQREVTTLRQQVQNLHHNNRQLLGEEISNFTVRDLQLLQNQVEMSLHSIRNKKDQLLAEEILKLNEKGSLVQKENSELRKKFNIAHQRNIELHKKVKFLFDLLETYKNVDKNGGGLLVI

SEQ ID NO: 3574 - protein, 169 aa, Oryza sativa
  unsure (1)..(169): unsure at all Xaa locations
MGRGKIAIKRIDNTMNRQVTFSKRRGGLMKKARELAILCDADVGLIVFSCTGRLYDFSSSSMKSIIERYQEAGEEHCRLLNPMSEAKSHSYMTYTDRQLLGEEISNFTVRDLQLLQNQVEMSLHSIRNKKGSLVQKENSELRKKFNIAHQRNIELHKKHHAYYKRKKSX

SEQ ID NO: 3575 - protein, 607 aa, Oryza sativa
MENGAGAGDDEYTRDGSVDLRGNPVLRSKRGGWKACSFIVVYELFERMAYYGIASNLVIYLTEKLHQGTVEAANNVTNWSGTVFITPLIGAVVADAWLGRYWTFVAGSAVYLMGMLLLTLAVSVPALKPPPCDGGGGAACPRASALQLGVYFGGLYTIALGHGGTKPNISTIGADQFDDFHPPEKLHKLSFFNWWMFTIFLGILFSTTVLVYLQDNVSWTVGYGIPTLGLMVSVAVFLSGTPLYRHKVPQGSPLATMGRVVAAAVWKWRVPLPADSKELHELELEHYTTRRGFRMDATVSMAFLNKAAVKPGEGGGGSVARLPGWTLCTVTQVEETKQIVKLVPLLATMVVPCTLVAQAGTLFVKQGVTLDRRIGKFHVPPASLGAFVTATMLICIVLYDRFLVPAVRRRTKNPRGITLLQRISLGMLLQIVTMVVTSVVESQRLGYARRHGLVATGGQLPVTIFILLPQFVLLGVADAFLVVGQIEFFYDQAPESMKSLGTAMSLTAYGAGNLLSSAILAAVERVTGGGKGRTPWVTNNLNASRLDYYYAFLATLAAANLLAFVVLSCKYSYRVESTETIDVDVAMDDVAQGGGVVTVKSEAAPMA

SEQ ID NO: 3576 - protein, 548 aa, Oryza sativa
  unsure (1)..(548): unsure at all Xaa locations
MGTAKIPALLWFLLAGLVLALAVNPAHGAKTRHYDFFITETNYTRLCHEKSILTVNGQFPGPTIYARKGDFIIVNVHNNGNKNITIHWHGVDQPRNPWSDGPEFITQCPIRPGGNFTYQVILFEEEGTLWWHAHSDFDRATVHGAIVIHPKRGTTFLFRKLDKEIPVILGNQFCLTXXDDTFKVAVQQGNTYLLRVINAGLTNDMFFAIAGHRLTVVGIDARYTKPITVDYIMIAPGQTMDVLLKANRTLGSNSRYYMAARTFITLPVDTIRFNNSTATAIVEYTDSAVARPVGPPEFPVLLPAIKDEDAAMAFVKQLRSLGNQDHPVHVPKQVDEHMLIDIDINFLPCDANNATNKLCEGPQGNRFAASLNNVSFQNPAIDVLDAYYYGSGRGVYEENFPNKLTVIVNPTGDINGGGPLLTKRGTKVKVLEYGTVVEVVFQDLSIENHPMHLHGFTFYVVGRGSGTFDERRDPATYNLIDPPFQNTVSVPKSSWAAIRFRADNPGVWFMHCHFDRHVVWGMDTMFIVKDGKTPQAQMLPRPPNMPEC

SEQ ID NO: 3577 - protein, 599 aa, Oryza sativa
MGTAKIPALLWFLLAGLVLALAVNPAHGAKTRHYDFFITETNYTRLCHEKSILTVNGQFPGPTIYARKGDFIIVNVHNNGNKNITIHWHGVDQPRNPWSDGPEFITQCPIRPGGNFTYQVILFEEEGTLWWHAHSDFDRATVHGAIVIHPKRGTTFLFRKLDKEIPVILGNQFCLTISILQCDAMQCFWWNDDVEHVLDKAKRIGGDVEPSDTNTINGQPGDMFPLCSRDDTFKVAVQQGNTYLLRVINAGLTNDMFFAIAGHRLTVVGIDARYTKPITVDYIMIAPGQTMDVLLKANRTLGSNSRYYMAARTFITLPVDTIRFNNSTATAIVEYTDSAVARPVGPPEFPVLLPAIKDEDAAMAFVKQLRSLGNQDHPVHVPKQVDEHMLIDIDINFLPCDANNATNKLCEGPQGNRFAASLNNVSFQNPAIDVLDAYYYGSGRGVYEENFPNKLTVIVNPTGDINGGGPLLTKRGTKVKVLEYGTVVEVVFQDLSIENHPMHLHGFTFYVVGRGSGTFDERRDPATYNLIDPPFQNTVSVPKSSWAAIRFRADNPGVWFMHCHFDRHVVWGMDTMFIVKDGKTPQAQMLPRPPNMPEC

SEQ ID NO: 3578 - protein, 579 aa, Oryza sativa
MGTAKLPALLWLLAGVVLALAVNPAHGAKTRHYDFFITETNYTRLCHEKSILTVNGQFPGPTIYARKGDLVIVNVHNNGNKNITIHWHGVDQPRNPWSDGPEFITQCPIRPGGNFTYQVILSEEEGTLWWHAHSDFDRATVHGAIVIHPKRGTTFPFKKPDKEIPVILGEWWNDDIEHVLDKAQLLGGDVDPSNANTINAQPGDMFPCSRDDTFKVAVQQGNTYLLRIINAGLTNDMFFAIAGHRLTVVGIDARYTKPLTVDYIMIAPGQTMDVLLEAKRTLGSNSRYYMAARTFITLPLDTIPFNNSTATAIVEYTDSVTARPVGPPEFPVQLPAIKDENAAMAFVTQLRSLGNQEHPVHVPTHVDEHMLIDIDINVLPCDPTNMAEKCKEGPQGNRFAASLNNVSFQSPAIDVLDAYYYSSGHGVYEEDFPNKLNAFVNPTGDNGGRPLLTKRGTKVKVVEYGTVVEVVFQDLSSENHPMHLHGFAFYVVGRGSGTFDERRDPATYNLVDPPFQNTVSVPKSSWAAIRFRADNPGVWFMHCHFDRHVVWGMDTVFIVKDGKTPQAQMLPRPPNMPEC

SEQ ID NO: 3579 - protein, 687 aa, Oryza sativa
  unsure (1)..(687): unsure at all Xaa locations
MDEEAKPNPNADAAPAAAEAAASSPPPLSSSESAEGKDKEEEKEEEEEEEAGDLVEKLVELVEEIAAISDFRNAYRRQFCNLSRRIRLLAPMLEEAKEGPRPLPDVSYSALRRLREALADSRELLRLGVSGSKISLVLEREKIMKSFQDITARLEQALGLISFDELDISDEVREQVELVHAQFKRAKERSDPSDDDLFNDLVSVYNSSTSANVDPDILQRLSDKLQLATISDLNQESLILHEMXXSGGDPGAVVEKMSMLLKRIKDFVQSRDPEMGTPVNTTELSGKDNMASLIVPDDFRCPISLDLMKDPVIVATGQAGHDTCPKTQQKLPNKSLTPNYVLRSLIAQWCEANGMEPPKXXAAQHHNAPASCTAAEHSNVVELLQKLLSQNLEDQREAAGMLRQLAKRSPENRACIGDAGAIPILVSLLSITDVSTQEHVVTALLNLSIYEENKARIITSGAVPGVVHVLKRGSMEARENSAATLFSLSLVDENKITIGASGAIPALVLLLSNGSQRGKRDAATALFNLCIYQGNKGKAVRAGLIPVLLGLVTETESGMMDEALAILAILSSHPEGKTAISSANAIPMLVGVIRNGSARNKENAAAVLVHLCNGEQQQQHLAEAQEQGIVTLKVNQAQAEAMAQAHAHAQSQAQVQALNEAQSQRLVFLAEASSWKXSPAMPSVEVX

SEQ ID NO: 3580 - protein, 684 aa, Oryza sativa
  unsure (1)..(684): unsure at all Xaa locations
EEEEAGDLVEKLVELVEEIAAISDFRNAYRRQFCNLSRRIRLLAPMLEEAKEGPRPLPDVSYSALRRLREALADSRELLRLGVSGSKISLVLEREKIMKSFQDITARLEQALGLISFDELDISDEVREQVELVHAQFKRAKERSDPSDDDLFNDLVSVYNSSTSANVDPDILQRLSDKLQLATISDLNQESLILHEMXXSGGDPGAVVEKMSMLLKRIKDFVQSRDPEMGTPVNTTELSGKDNMASLIVPDDFRCPISLDLMKDPVIVATGQTYERGCIERWLEAGHDTCPKTQQKLPNKSLTPNYVLRSLIAQWCEANGMEPPKXXAAQHHNAPASCTAAEHSNVVELLQKLLSQNLEDQREAAGMLRQLAKRSPENRACIGDAGAIPILVSLLSITDVSTQEHVVTALLNLSIYEENKARIITSGAVPGVVHVLKRGSMEARENSAATLFSLSLVDENKITIGASGAIPALVLLLSNGSQRGKRDAATALFNLCIYQGNKGKAVRAGLIPVLLGLVTETESGMMDEALAILAILSSHPEGKTAISSANAIPMLVGVIRNGSARNKENAAAVLVHLCNVEPAAXQHLCLSAGTRELXPLVEELAKSGTDRGKRKAIQLLERMNRFLMQQSQAQAQAEAMAQAHAHAQSQAQVQALNEAQSQVEMQVEQLLLPTTSHLSDRRDG

SEQ ID NO: 3581 - protein, 179 aa, Oryza sativa
  unsure (1)..(179): unsure at all Xaa locations
XTXASCLQQLLKVVMFERKDNXNRPSFLRSLLIGKNILIVDDNKVNLRVAAAALKKYGAKVHCVESGKDAVSLLQQPHCFDACFMDVQMPEMDGFEATRQIRQMEVKANEERKALDLMEGSTFVESHLPVLAMTADVIQATYEECIKSGMDGYVSKPFDEEQLYQAVSRLVVGTKESAV

SEQ ID NO: 3582 - protein, 627 aa, Oryza sativa
MENGAGAGDDEYTRDGSVDLRGNPVLRSKRGGWKACSFIVVYELFERMAYYGIASNLVIYLTEKLHQGTVEAANNVTNWSGTVFITPLIGAVVADAWLGRYWTFVAGSAVYLMGMLLLTLAVSVPALKPPPCDGGGGAACPRASALQLGVYFGGLYTIALGHGGTKPNISTIGADQFDDFHPPEKLHKLSFFNWWMFTIFLGILFSTTVLVYLQDNVSWTVGYGIPTLGLMVSVAVFLSGTPLYRHKVPQGSPLATMGRVVAAAVWKWRVPLPADSKELHELELEHYTTRRGFRMDATVSMAFLNKAAVKPGEGGGGSVARLPGWTLCTVTQVEETKQIVKLVPLLATMVVPCTLVAQAGTLFVKQGVTLDRRIGKFHVPPASLGAFVTATMLICIVLYDRFLVPAVRRRTKNPRGITLLQRISLGMLLQIVTMVVTSVVESQRLGYARRHGLVATGGQLPVTIFILLPQFVLLGVADAFLVVGQIEFFYDQAPESMKSLGTAMSLTAYGAGNLLSSAILAAVERVTGGGKGRTPWVTNNLNASRLDYYYAFLATLAAANLLAFVVLSCKYSYRVESTETIDVDVAMDNVAQGGGVVTGDVEERDGGLSPEVLVAWAPSQPRKETRI

SEQ ID NO: 3583 - protein, 323 aa, Oryza sativa
  unsure (1)..(323): unsure at all Xaa locations
MARIHADPVLEADQFDRLPDSLVLVILNNVEDVRSLGRCSAVSKRFYGLVPLVHDVYVKIDRVVTVDGEAEDALNLSSPKPRNILSHFLKRCCSRSSSRSTACAARTVLGGRCSRXXLAQHSPAQVLRNFTHIRNLRVELPSGDVDRKPVGAEHELYSEDNGSMPESFYTNGGLKLRVVWTISSLIAASTRHYLLRSIIKDHPTLTSLVLTDADGQGTLSMGAEQLKEFRENQLSASACSNRTQVPACNMKLKYAPYLELPGGIALQGATLVAIKPSPEGSNGGHTSRKETDAFVSGAFDGPFKFAVKALMKRRTYLLEMNGF

SEQ ID NO: 3584 - protein, 380 aa, Oryza sativa
  unsure (1)..(380): unsure at all Xaa locations
CSISLQPRAGGRGGGGAFDPFLHFGRFPMARIHADPVLEADQFDRLPDSLVLVILNNVEDVRSLGRCSAVSKRFYGLVPLVHDVYVKIDRVVTVDGEAEDALNLSSPKPRNILSHFLKRCCSRSSSRSTACAARTVRGGRCSRXXLAQHSPAQVLRNFTHIRNLRVELPSGDVGTEEGVLLKWRAEYGSTLQNCVILGGTQVDRKPVCAEHELYSEDNGSMPESFYTNGGLKLRVVWTISSLIAASTRHYLLRSIIKDHPTLTSLVLTDADGQGTLSMGAEQLKEFRENQLSASACSNRTQVPACNMKLKYAPYLELPGGIALQGATLVAIKPSPEGSNGGHTSRKETDAFVSGAFDGPFKFAVKALMKRRTYLLEMNGF

SEQ ID NO: 3585 - protein, 102 aa, Oryza sativa
  unsure (1)..(102): unsure at all Xaa locations
RSRGRIVSDEEEXVTSXDRNLYIVLISIHGLVRGENMELGRDSDTGGQVKYVVELARALAATPGVHRVDLLTRQISCPDVDWTYGEPVEMLTVPAADADDEX

SEQ ID NO: 3586 - protein, 334 aa, Oryza sativa
  unsure (1)..(334): unsure at all Xaa locations
MGRSPCCEKEGLKKGPWTPEEDQKLLAYIEQHGHGCWRSLPSKAGLQRCGKSCRLRWTNYLRPDIKRGKFSLQEEQTIIQLHALLGNRWSAIATHLPKRTDNEIKNYWNTHLKKRLAKMGIDPVTHKPRSDVAGAGGGHAKAAAHLSHTAQWESARLEAEARLAREAKLRALAASATPGAPHLPAPPASAAAXGGGSRXLDSPTSTLSFSESAVLATVLEAHGAAAAAAARAAMQPMQAYDEACKDQHWGDVDAADVGFPGAGAGFTGLLLEGSLNQIPRPAGRDAEADGEFQETEEEKNYWNSILNLVNSSSAPMSTAVVVPASHAYSPAPDF

SEQ ID NO: 3587 - protein, 143 aa, Oryza sativa
  unsure (1)..(143): unsure at all Xaa locations
ATAXVYKVASYAKDHNVPVIADGGISNSGHIVKALSLGASTVMMGSFLAGSHEAHGTYEYKLKVAQGVVGAVADKGSVLRFIPYTMQAVKQGFQDLGASSLQSAHELLRSETIKLEIKGRFTSSRDQTXSLPSIIGRLFIPPN

SEQ ID NO: 3588 - protein, 268 aa, Oryza sativa
  unsure (1)..(268): unsure at all Xaa locations
GVSYTYDDVIFLPGYIGFPADAVDLSTRLSRRIPLSIPCVASPMDTVSEAAMAAAMASLGAAAVVHCNTEPHLQAXIVRAAKSRRLXXETSSRQAPLPVSEYMRPAPRSVSASFDFEQAAAFLADEGLDYAPLVSDDSEVIDLITVNDVERIRSYPKLGKPSLGADGKFVVAASIGTREDDKRRLEQLVKAGANAIVVDSSQGNSIYQIDMIKYAKKMYPEVDLIGGNVVTIAQAQNLVASGVDGLRVGMGSGSICTTQEVCAVGRGQ

SEQ ID NO: 3589 - protein, 501 aa, Oryza sativa; identical to SEQ ID NO: 1150

SEQ ID NO: 3590 - protein, 161 aa, Oryza sativa
KAADTEASETTTERSPQSTRRNRSKSRGPEMAAARAAVPIAVFLLLVLAEADPAAATRSPSAFVQNAIYSNRITIFSKTYCPYSMRAKRIFRDLKENPYIVELDLREDGREIQSVLLDLVGRHTVPQVFVNGQHVGGSDDTANAHSNGQLQKLLGNSQSQR

SEQ ID NO: 3591 - protein, 397 aa, Oryza sativa
MGRKRAVLVGINYAGTEGELKGCLNDVARMRRCLVDRFGFDEADIRVLADADPSTPQPTGANIRLELERLVGDARPGDTLFFHYSGHGLQLPIETGGDDDDTGYDECIVPCDMNLIKDQDFTELVQKVPDGCLFTMVSDSCHSGGLIDKTKEQIGSSTKQSQAPSPGTCSCASLLQIALRHLPRRGGQRIIGSRSRDGVGEDQPPRSQAELLAADATRAGIKNRSLPLSTFVEMLTERTGKDDVGVGSIRTTLFHHFGDDASPKIRRLVNAMLGRRHGSATASEEHPDKAKPERVDGEGEAAAAKQGAPETRPLPRNGVLISGCQTDETSADATTPEGVSYGALSDAIQSVLAEERRGKVTNMELVRRARELLAKQGYTQQPGLYCRDKHANVAFIC

SEQ ID NO: 3592 - protein, 397 aa, Oryza sativa
MGRKRAVLVGINYAGTEGELKGCLNDVARMRRCLVDRFGFDEADIRVLADADPSTPQPTGANIRLELERLVGDARPGDTLFFHYSGHGLQLPIETGGDDDDTGYDECIVPCDMNLITDQDFTELVQKVPDGCLFTMVSDSCHSGGLIDKTKEQIGSSTKQSQAPSPGTCSCASLLQIALRHLPRRGGQRIIGSRSRDGVGEDQPPRSQAELLAADATRAGIKNRSLPLSTFVEMLTERTGKDDVGVGSIRTTLFHHFGDDASPKIRRLVNAMLGRRHGSATASEEHPDKAKPERVDGEGEAAAAKQGAPETRPLPRNGVLISGCQTDETSADATTPEGVSYGALSDAIQSVLAEERRGKVTNMELVRRARELLAKQGYTQQPGLYCRDKHANVAFIC

SEQ ID NO: 3593 - protein, 380 aa, Oryza sativa
MADDLGPPTVLQKIHGQSMMFSKISPYSLMKNPALYNANTSYSVPLKSYNGMDGNNGFSSVTSVSPVFASAPKEKGLSGFMIDFMMGGVSAAVSKTAAAPIERIKLLIQNQDEMIKSGRLSHPYKGIADCFGRTIKDEGVIALWRGNTANVIRYFPTQALNFAFKDHFKRMFNFKKDKDGYWKWFAGNLASGGAAGACSLFFVYSLDYARTRLANDAKAAKKGGGRQFNGLVDVYRKTLASDGIAGLYRGFNISCVGIIVYRGLYFGMYDSLKPVVLVGNLQDNFLASFLLGWGITIGAGLASYPIDTVRRRMMMTSGEAVKYNSSLDAFKQIVAKEGAKSLFKGAGANILRAVAGAGVLAGYDKLQVVVFGKKYGSGGG

SEQ ID NO: 3594 - protein, 722 aa, Oryza sativa
MGGRYLHSPPAVNLICEESTFVRSTSCCLHSCLCLRCKTSNLKPCRTLVFNMPSRRFNRRLAALPDVDDFFWEKDPTPILDTIDAPIHLKNLSSKELKQLAGEVRSEISFIMSRKCQPCNTGHSVVELAIAIHYVFNAPMDKILWDAGQHTYAHKILTGRRSLFHTIKQRKGLSGFTSRFESEYDPFGAGHGCNSLSAGLGMAVARDLGGRKNRIVTVISNWTTMAGQVYEAMGHAGFLDSNMVVILNDSRHTLLPKADSQSKMSINALSSALSKVQSSKGFRKFREAAKGLSKWFGKGMHEFAAKIDEYARGMIGPHGATLFEELGLYYIGPIDGNNIDDLICVLKEVSTLDSTGPVLVHVITENEKDSGGEFNSEITPDEEGPPDSSQDILKFLENGLSRTYNDCFVESLIAEAENDKRIVVVHGGMGIDRSIQLFQSRFPDRFFDLGIAEQHAVTFSAGLACGGLKPFCIIPSTFLQRAYDQIVEDVDMQKIPVRFAITSAGLVGSEGPTNSGPFDITFMSCLPNMIVMSPSNEDELIDMVATAAMVEDRPICFRYPKGAIVGTSGTLAYGNPLEIGKGEILAEGKEIAFLGYGDVVQRCLIARSLLFNFGIQATVANARFCKPLDIDLIRMLCQQHDFLITVEEGTVGGFGSHVSQFISLDGLLDGKIKWRPIVLPDRYIEHASLTEQLDMAGLTAHHIAATALTLLGRHRDALLLMK

SEQ ID NO: 3595 - protein, 670 aa, Oryza sativa
  unsure (1)..(670): unsure at all Xaa locations
XGLQAPRPNRSSSIGNGVQFLNRHLSSIMFRNKDCLEPLLDFLRGHRHKGHVMMLNDRIQSLGWLPALLAKAEEHLSKLPADTPYSQFAYKFQEWGLEKGWGDTAGYVLEMIHLLLDVLQAPDPSTLETFLGRIPMIFNVVVVSPHGYFGQANVLGLPDTGGQIVYILDQVRALENEMVLRLKKQGLDFTPKILIVTRLIPEAKGTSCNQRLERISGTQHTYILRVPFRNENGILRKWISRFDVWPYLEKFAEDAAGEIAAELQGTPDFIIGNYSDGNLVASLLSYKMGITQCNIAHALEKTKYPDSDIYWTKYDEKYHFSCQFTADIIAMNNADFIITSTYQEIAGSKNTVGQYESHTAFTLPGLYRIVHGIDVFDPKFNIVSPGADMSIYFPYTEKAKRLTSLHGSLENLISDPEQNDEHIGHLDDRSKPILFSMARLDRVKNITGLVEAYAKNARLRELVNLVVVAGYNDVKKSKDREEIAEIEKMHELIKTYNLFGQFRWISAQTNRARNGELYRYIADTHGAFVQPAFYEAFGLTVVEAMTCGLPTFATVHGGPAEIIEHGISGFHIDPYHPDQAANLIADFFEQCKQDPNHWVEVSNRGLQRIYEKYTWKIYSERLMTLAGVYGFWKYVSKLERRETRRYLEMFYILKFRELAKTVPLAVDEAH

SEQ ID NO: 3596 - protein, 493 aa, Oryza sativa
  unsure (1)..(493): unsure at all Xaa locations
MTGPFDVSYLQVDKRAQDDELHALQWLNTSRRDGGSRERPPPTRCRRRRHASASSGTSSADAEEEESAAPRRRGGGGGGDGGAGKRRRRHRKQQQQRREGDGGDVVRDGRVSVTSRYSGPLYLDQLRPSLNRPVIRPTLACFRPVIKPKRGIQAAALTAAAAAAARRSGAMAEEAAAGGLYYCHMCASTVSAVAAAEGEVEIKCPYCHSGFVEEIESARGVATGGGGAISSVWAPIIDGMVGGGGGDSVRRHRRSRRLADAAGADDGYYRDLALLDFSESRRRTAALLLLMQEFRERQLQRLESATATISAAAAEAGAVVGTSRDAEGVALADYFLGPGLDALMQRVGDGDAGRQGTLPAKKEAVESMPTVEVAAGGDCDSACAVCLEDYAAGERATEMPCRHRFHAKCIVPWLKMHSSCPVCRFQLPTDDDDDSSKSARGGAAHSGGGRRLSQPAPRVDGGGLXQELRSILSQPSPASTSGSSSHAQQHSDE

SEQ ID NO: 3597 - protein, 379 aa, Oryza sativa
  unsure (1)..(379): unsure at all Xaa locations
LIWVFFASALPTSSSARRTAAACLAWAALAAAAARWRRSWGAAAVAALISLASVVVLCSPSTPGSHEFVALLVEKEMDHQPQRGYLEKLELGGLECSWRKDAIDWICKVHSYYNFGPLSLYLAVNYLDRFLSSFNLPHDAWMQQLLSVSCLSLATKMEETVVPLPMDLQVFDAEYVFEARHIKRMELIVMKTLKWRLQAVTPFSFIGYFLDKFNEGKPPSYTLASWCSDLTVGTLKDSRFLSFRPSEIAAAVVLAVLAENQFLVFNSALGESEIPVNKEMVMRCYELMVEKALVKKIRNSNASSSVPHSPITVLDAACFSFRSDDTTLGSSQSNSNNKDYNSQDSAPASKRRRLNTTPIXXLYIHNLALLCNCSFSEQL

SEQ ID NO: 3598 - protein, 106 aa, Oryza sativa
  unsure (1)..(106): unsure at all Xaa locations
XGDCAGQQCLSAAIGCRGGELQSLQDELNELETMEPASAACQGVITSTEGKSDPLLPVTIGPENASWERWFQRVRSSRRVGIQRLRFFLAPSCKDETTSFVQIKIT

SEQ ID NO: 3599 - protein, 460 aa, Oryza sativa
  unsure (1)..(460): unsure at all Xaa locations
MAESRIFGGLKPTKSRLLGPTIRGPPPNGAATHAPRRILFSFSPESQWLGQSSTRACLPPLRSPCLPAPSAASPAYPRLASSAASASAPARLRSRITLPGGRSPVPPMDPAASAAESSSLSSRDVAAMPDSPPRRAGHRRAQSEILLGAALPDDIAFVGGGGGDDYEEEEEDDEEEEMEGAGGSXDVRDVPRGRGQARDPGARGAAAAAAXARPRHQHSMSMDGSTSLASSAAGVAGRMGADAKKAISDAKLAELALVDPKRAKRILANRQSAARSKERKMRYIAELERKVQTLQTEATTLSAQLSMLQRDTTGLTSENSDLKIRVQTMEQQVRLQDALNDRLRDEIQQLKVATGQVNANCGKVGNFGLSSFGGANPQGYQRSHIQSLLAAQQLQQLQIHSQHQQQQMHLQQHHHLSTVQQQLLQEGLPLPGDLKMKGIVAASHAQNAGASESHALRSEP

SEQ ID NO: 3600 - protein, 464 aa, Oryza sativa
MSEDLFEGEKGEDAGDPSVAYGDSTTGNTPRISSVDKLYIVLISLHGLVRGENMELGRDSDTGGQERGENSGAYIIRIPFGPKDKYLAKEHLWPFIQEFVDGALSHIVKMSRAIGEEISCGHPAWPAVIHGHYASAGVAAALLSGALNVPMVFTGHFLGKDKLEELLKQGRQTREQINMTYKIMCRIEAEELALDASEIVIASTRQEIEEQWNLYDGFEVILARKLRARVKRGANCYGRYMPRMVIIPPGVEFGHMIHDFDMDGEEDGPSPASEDPSIWSEIMRFFTNPRKPMILAVARPYPEKNITTLVKAFGECRPLRELANLTLIMGNREAISKMHNMSAAVLTSVLTLIDEYDLYGQVAYPKRHKHSEVPDIYRLAVRTKGAFVNVPYFEQFGVTLIEAAMHGLPVIATKNGAPVEIHQVLDNGLLVDPHDQHAIADALYKLLSEKQLWSALKQLDIRAQ

SEQ ID NO: 3601 - protein, 964 aa, Oryza sativa
MYGNDNWINSYLDAILDAGKGAAAGDRPSLLLRERGHFSPARYFVEEVITGYDETDLYKTWLRANAMRSPQEKNTRLENMTWRIWNLARKKKELEKEEANRLLKRRLETERPRVETTSDMSEDLFEGEKGEDAGDPSVAYGDSTTGNTPRISSVDKLYICSHSLHGLVRGENMELGRDSDTGGQVKYVVELAKALSSCPGVYRVDLFTRQILAPNFDRSYGEPVEPLASTSFKNFKQERGENSGAYIIRIPFGPKDKYLAKEHLWPFIQEFVDGALSHIVKMSRAIGEEISCGHPAWPAVIHGHYASAGVAAALLSGALNVPMVFTGHFLGKDKLEELLKQGRQTREQINMTYKIMCRIEAEELALDASEIVIASTRQEIEEQWNLYDGFEVLLAGIPRASLQRGANCYGRYMPRMVIIPPGVEFGHMIHDFDMDGEEDGPSPASEDPSIWSEIMRFFTNPRKPMILAVARPYPEKNITTLVKAFGECRPLRELANLTLIMGNREAISKMHNMSAAVLTSVLTLIDEYDLYGQVAYPKRHKHSEVPDIYRLAVRTKGAFVNVPYFEQFGVTLIEAAMHGLPVIATKNGAPVEIHQVLDNGLLVDPHDQHAIADALYKLLSEKQLWSKCRENGLKNIHQFSWPEHCKNYLSRISTLGPRHPAFASNEDRIKAPIKGRKHVTVIAVDSVSKEDLIRIDRNSIEAARKENLSGSTGFVLATSLTIGEIHSLLMSAGMLPTDFDAFICNSGSDLYYPSCTGDTPSNSRVTFALDRSYQSHIEYHWGGEGLRKYLVKWASSVVERRGRIEKQVIFEDPEHSSTYCLAFKVVNPNHLPPLKELQKLMRIQSLRCHALYNHGATRLSVIPIHASRSKALRYLSVRWGIELQNVVVLVGETGDSDYEELFGGLHKTVILKGEFNTSANRIHSVRRYPLQDVVALDSPNIIGIEGYGTDDMRSALKQLDIRAQ

SEQ ID NO: 3602 - protein, 277 aa, Oryza sativa
MAAASRARRWSLAGKTALVTGGTKGIGRAIVEELAGFGVRVHTCSRHDADLQDCLRRWNAAGEGGGAAALVTGSVCDVSVRGDREALVAAARAALGGRLDMLVNNAGQVVVGPAAETAPEEYARLMATNLESCFHLAQLAHHLLRDAAAGGGAAASVVNISSTAAFYAAPHLAVYSATKGGMNQLTRCLAAEWARDGVRVNAVAPGATRTDICDTSGVALGEKTRRRLADAGAMDRVPIRRIGEPEEVAAAVVFLCMPAASYITGQVICVDGGRTLL

SEQ ID NO: 3603 - protein, 105 aa, Oryza sativa
MAGGGVWVFRNNGVMELEEQATSRKALVHVATSEVIRSTEALERRLGALGWERYYEDRATLQLHRRDGSADLISIPRDFSRFRSTHMYDVVVKNRDHFKVVDLHT

SEQ ID NO: 3604 - protein, 350 aa, Oryza sativa
MDPGRVVFDSGVARRACPGGAQMLLFGGGGSANSGGFFRGVPAAVLGMDESRSSSSAAGAGAKRPFFTTHEELLEEEYYDEQAPEKKRRLTAEQVQMLERSFEEENKLEPERKTELARRLGMAPRQVAVWFQNRRARWKTKQLEHDFDRLKAAYDALAADHHALLSDNDRLRAQVISLTEKLQDKETSPSSATITTAAQEVDQPDEHTEAASTTGFATVDGALAAPPPGHQQPPHKDDLVSSGGTNDDGDGGGAAVVVFDVTEGANDRLSCESAYFADAAEAYERDCAGHYALSSEEEDGGAVSDEGCSFDLPDAAAAAAAMFGAAGVVHHDAADDEEAQLGSWTAWFWS

SEQ ID NO: 3605 - protein, 249 aa, Oryza sativa
MDAFYSTSSAYGAAASGWGYDSLKNFRQISPAVQSHLKLVYLTLCVALAASAVGAYLHVALNIGGMLTMLGCVGSIAWLFSVPVFEERKRFGILLAAALLEGASVGPLIKLAVDFDSSILVTAFVGTAIAFGCFTCAAIVAKRREYLYLGGLLSSGLSILLWLQFAASIFGHSTGSFMFEVYFGLLIFLGYMVYDTQEIIERAHHGDMDYIKHALTLFTDFVAVLVRILVIMLKNASDKSEEKKRKKRS

SEQ ID NO: 3606 - protein, 489 aa, Oryza sativa
MESLRDMVLPPGFGFHPKDTELISHYLKKKIHGQKIEYEIIPEVDIYKHEPWDLPAKCDVPTQDNKWHFFAARDRKYPNGSRSNRATVAGYWKSTGKDRAIKMGKQTIGTKKTLVFHEGRPPTGRRTEWIMHEYYIDERECQACPDMKDAYVLCRITKRNDWIPGNGNELDNSDPHPEPYDAPPSVISTEQLNPAAEPVVGVEAAPVTVAEPDGVTTSAITANIPSPSDDINLDDWLNELFDPFFDPEQSLASADLSPDEQNVESSNVGALAPKVEQDYSSPNENVVDDTEYLLPEDVYNILHPGTDDFNMLQNPLDQYPIQYATDVWSGIQKEELWSPQANAEPSQSNEAADNGIIRRYRSMKTPETSVPQFKGKTQAKMRVGINKMATSSSESINQTIKFENSGRLVEHQKNQAHDVASTKRSDAGKPSTELSSNRGFLRGIRNAFAGCSDARWNMILVAGFAIGVAVVALHIGQRLGLSQRDQQHT

SEQ ID NO: 3607 - protein, 331 aa, Oryza sativa
  unsure (1)..(331): unsure at all Xaa locations
XGRGDRGGGDAAXTLLEYMGQAGAADDLVVLVAHVQSACKRIAALVASPGNAELSRGKAGGGVAVAAGRDAPKPLDELSNEIILSSLRRSGKVAVMASEENHLPIWVSNDSPYVVVTDPLDGSRNIEVSIPTGTIFGIYNRLAELDHLPEEERAQLNSLQSGTHLVASGFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYEV

SEQ ID NO: 3608 - protein, 1141 aa, Oryza sativa
MAAATAAAETPPTLLEYMGQAGAADDLVVLVAHVQSACKRIAALVASPGNAELSRGKAGGGVAVAAGRDAPKPLDELSNEIILSSLRRSGKVAVMASEENHLPIWVSNDSPYVVVTDPLDGSRNIEVSIPTGTIFGIYNRLAELDHLPEEERAQLNSLQSGTHLVASGFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYEIMRSEDNVACEKRTGGPTGELCICKTDVFTCQVFCFCLRDYAVSLCNIAEKLGCISPVCTLLCNVVRLVRFKSSNKSNFYYEPCNFVKPLLTIELGWLTEQSKLEGISGRVIAMRRVAISRPVARRVNFNLMKPAAAAALLLPPPPPSSREGSAPQTRAEPRSTMSADSAAAGRDALLDELRALMAAHSPSLHALVVPSEDAHQSEYVSERDKRRQFVSGFTGSAGLALITMKEALLWTDGRYFLQAEQQLTNRWKLMRMGEDPPVEVWIADNLSDEAVIGINPWCISVDTAQRYEHAFSKKHQTLFQLSSDLVDEIWKDRPPVNALPVFVQPVEYAGCSVTEKLKELREKLQHEKARGIIIAALDEVAWLYNIRGNDVHYSPVVHSYSIVTLHSAFFYVDKRKVSVEVQNYMTENGIDIKDYNMVQSDASLLASGQLKGSAVNGSSHGENDMNENSKVWIDSNSCCLALYSKLDQYQVLMLQSPIALPKAVKNPVELDGLRKAHIRDGAAVVQYLAWLDKQMQENYGASGYFTEAKGSQKKEHMNVKLTEVSVSDKLEGFRASKEHFKGLSFPTISSVGPNAAVIHYKPEASSCAELDADKIYLCDSGAQYLDGTTDITRTVHFGKPSEHEKSCYTAVLKGHIALDTAVFPNGTTGHAIDILARTPLWRSGLDYRHGTGHGIGSYLNVHEGPHLISFRPSARNVPLQASMTVTDEPGYYEDGSFGIRLENVLIVKEANTKFNFGDKGYLAFEHITWTPYQTKLIDTTLLTPAEIEWVNAYHSDCRKILQPYLNEQEKEWLRKATEPIAASC

SEQ ID NO: 3609 - protein, 269 aa, Oryza sativa
  unsure (1)..(269): unsure at all Xaa locations
MNLPSRVNGDDFMNYDWKDXXITQRCTETQPQVGPAAQSSVAVHQSAAPQSVSSQSGEPSAVVPSPSGASNTSNSKTRMRWTPELHERFVDAVNLLGGSEKATPKGVLKLMSADNLTIYHVKSHLQKYRTARYRPELSEGSSEKKAASKEDIPSIDLKGGIDLTEALRLQLELQKRLHEQLEIQRSLQLRIEEQGKCLQMMLEQQCIPGTDKAVDASTSAEGTKPSSDLPESSAVKDVPENSPKQQYDMFTFMFKKKKKKKKXNSRLVL

SEQ ID NO: 3610 - protein, 440 aa, Oryza sativa
  unsure (1)..(440): unsure at all Xaa locations
MGAREEVREEEGEEGEGVGGKEEEKAAAAAAAVSCSICLDAVVAAGGERSTARLQCGHEFHLDCIGSAFNAKGVMQCPNCRKIEKGNWLYANGSRPTQDVNMDEWAHDEDLYDVSYSEMPFRFHWCPFGRLAQLPSFFEEGESSPPVTFHDFMGQHMFTEHVAAVSSAPGAAHPCPYVAYLHPLPSLASSSSSHVPERTMDGPAYHDPWHPLAGPSDGRPLQSVQPADFHHNHWAHVPNSYPQPNNNNGVAEQQGVPFGTTRAARVDGDTQRRGSSISPSYFSNGSGXSRSRAPNVPPMVPQFMRAHGSISEQYQQSSSSSLFAGAHRSGGMRTAPPPPLPENPAFCLFPPGSSGHNSMETDDAGGNRFYAWERDRFAPYPLMPVDCETNWWSSQQSHGTSEPAPAPRRLFGQWIGVGRSSPENRSPEGSSYRQMHTPRM

SEQ ID NO: 3611 - protein, 359 aa, Oryza sativa
  unsure (1)..(359): unsure at all Xaa locations
MERELLETFEAAKKAADAAAGADDSPEADRCLDAMRRLRGLRVTTDVLVSTQVGKRLRYLTKHPHSDIQSMATDLLGYWKKVVIEEGKKNGTTENVGSTNSAARAEKAQPMKVDKSSASGSVKPEKREVNVRXXQKPESIKVEKITNNDSKNQQVKVERAPKDRTPDTKKPSSVPNGPPKLTSLVKCNDPTRDKIRELLADAFSRVHGETSKDDREEVNARDPFRVAVTVESALFERLGRSTGAHKAKYRSIMFNLRADNNTDFRRRVLLGQVRPERLVDISPEEMASDARKLENKQIKEKALFDCERGGAPKATTDQFKCGRCGQRKTTYYQLQTRSADEPMTTFVTCVNCNNHWKFC

SEQ ID NO: 3612 - protein, 273 aa, Oryza sativa
  unsure (1)..(273): unsure at all Xaa locations
MASADLFPNVSFCHVSVPAVAGASTEVTGGATAVFGGDASTVSLVWSGETQAKHTLEIDLSDAQIFKLGPTEWLCVSGESEAKDGVEEKSYSRAIKVVLRTEAESKAFYLAFQQWKHRVISGKAGEPLENGLIIGSKSKFDTKIEASSAKMYFHYYGQLLHQQNMLQDFVRTGTYYAAVMENRSDFEGRVVVDVGAGSGILSLFAAQAGARHVYAVEASEMAEHAQRLISGNPSLGQRITALSTTICDATRPAAAAVTIFAATGKAQRQRRLX

SEQ ID NO: 3613 - protein, 575 aa, Oryza sativa
  unsure (1)..(575): unsure at all Xaa locations
MLPRGEPLENGLIIGSKSKFDTKIEASSAKMYFHYYGQLLHQQNMLQDFVRTGTYYAAVMENRSDFEGRVVVDVGAGSGILSLFAAQVIKGKVEEVELPEKADILISEPMGTLLVNERMLESYVIARDRFLVPGGKMFPTTGRIHMAPFSDEYLYVEMANKALFWQQHNFFGVDLTPLHGSAFQGYFSQPVVDAFDPRLLVSPPTFHTLDFTTMKEEELYEIDIPLNFVASVGTRVHGLACWFDVLFNGXGQEITGRLHLVAHSAQSYTIYLTMSAKMWGEGAEQGGILQTSTAKLELKEPYYRLSQPQPYVMQQDQQQQQLPSLQPQKREVEVEEVRRPKLRYLEFVQVAAAQATICLAGLYALAKDHAGPLRPGVDAVESAVKGVVGPVYGRFHGVPLDVLAFVDRKVDDTVQELDRHLPPTLKAASAKACAVARGVPDVARELTAEVQQSGVTGAARVAYAKVEPVAKGVYGRIQPAAKDLYVRYEPAAEHLAVSTWRSLNNLPLFPQVAQIAVPTAAYWAEKYNKVIAAAADKGYTGAQYLPAIPTERIAKVFGELSPEAQPSKSESAKTQ

SEQ ID NO: 3614 - protein, 538 aa, Oryza sativa
  unsure (1)..(538): unsure at all Xaa locations
MASPDLFPNVSFSHVSVPAAAGASTEVSATAVFGGDASIGAPRLSRSGETQAKHTLEIDLSDAQIFKLGPTEWLCVSGESEAKDGVEEKSYSRAIKVVLRTEAESKAFYLAFQQWKHRVISGKAGEPLENGLIIGSKSKFDTKIEASSAKMYFHYYGQLLHQQNMLQDFVRTGTYYAAVMENRSDFEGRVVVDVGAGSGILSLFAAQAGARHVYAVEASEMAEHAQRLISGNPSLGQRITVIKGKVEEVELPEKADILISEPMGTLLVNERMLESYVIARDRFLVPGGKMFPTTGRIHMAPFSDEYLYVEMANKALFWQQHNFFGVDLTPLHGSAFQGYFSQPVVDAFDPRLLVSPPTFHTLDFTTMXXEEELYEIDIPLNFVASVGTRVHGLACWFDVLVNGSTVQRWLTTAPGSPTTHWYQLRCILSQPLYVMAGQEITGRLHLVAHSAQSYTIYLTMSAKMWGEGAEQGGILQTSTVASCLKEPYYRLSQPQPYVMQQDQQQQQXYHLXSHRVLSGTITTDKISCLASAIEHWQE

SEQ ID NO: 3615 - protein, 586 aa, Oryza sativa
  unsure (1)..(586): unsure at all Xaa locations
MASADLFPNVSFCHVSVPAVAGASTEVTGGATAVFGGDASTGAPRLSLVWSGETQAKHTLEIDLSDAQVFLRDLDVLQIFKLGPTEWLCVSGESEAKDGVEESYSRAIKVVLRTEAESKAFYLAFQQWKHRVIIMAGEPLENGLIIGSKSKFDTKIEASSAKMYFHYYGQLLHQQNMLQDFVRTGTYYAAVMENRSDFEGRVVVDVGAGSGILSLFAAQAGARHVYAVEASEMAEHAQRLISGNPSLGQRITVIKGKVEEVELPEKADILISEPMGTLLVNERMLESYVIARDRFLVPGGKMFPTTGRIHMAPFSDEYLYVEMANKALFWQQHNFFGVDLTPLHGSAFQGYFSQPVVDAFDPRLLVSPPTFHTLDFTTMKVNISLLVMRLKLQVIFLYCFSLQNEAFFXFLCQEEELYEIDIPLNFVASVGTRVHGLACWFDVLFNGSTVQRWLTTAPGXSPTTHWYQLRCILSQPLYVMAGQEITGRLHLVAHSAQSYTIYLTMSAKMWGEGAEQGGILQTSTAKLELKEPYYRLSQPQPYVMQQDQQQQQLPSLQPQGSEQQMQDGLSPSITIEPDQDSAAFTR

SEQ ID NO: 3616 - protein, 580 aa, Oryza sativa
  unsure (1)..(580): unsure at all Xaa locations
MTMAISSALPSPLLLAASLLLLIVQAQGRVRPRVRNVQMANATRLCNTKSMVTVNGQCPGPELVAREGDRVVIRVTNNVAHNISLHWHGVRQVRTGWADGPAYITQCPIQTGQSYVYNFTVAGQRGTLWWHAHISWLRATVYGALVILPKLGVPYPFPAPHKEVPVIFGEWWNADTEEVVNQAVQTGGGPNVSDAFTINGLPGPLYNCSAQDTFKLKVKPGKTYMLRLINAALNEELFFAVANHTLTVVEVDAVYVKPFTVDTLVISPGQTTNVLLTAKPYYPGANFYMSAAPYSTARPGTFGNTTVAGILEYENPAMSPSAASFVKGLPLFKPTLPQLNDTDFVTNFTDKLRSLATPEYPAAVPQSVDKRFFFTVGLGTLPCPANMTCQGPNNTQMAASMNNVSFVLPARALLQSHFTGLSSGVYAPDFPVAPLSPFNYTGTXPPNNTNVKTGTKLLVLRYNTSVELVMQDTSILGIESHPLHLHGFNFFVIGQGFGNYDAVNDPAKFNLVDPVERNTVGVPAGGWVAIRFLADNPGVWFMHCHLEAHTTWGLRMAWLVLDGSHPNQKLLPPPSDLPKC

SEQ ID NO: 3617 - protein, 321 aa, Oryza sativa
  unsure (1)..(321): unsure at all Xaa locations
MAIKRTKAEKKVAYDKKLCQLLDEYTKVLIAVADNVGSNQLQEIRKGLRGDSIVLMGKNTLIRRCIKVHADNTGNKDFLELMPLLVGNVGLIFTKGDLKEVREEVAKYKVGAPARVGLVAPVDVXVVPPGNTGLDPSQTSFFQVLNIPTKINKGTVEIITPVELIKKGDKVGSSESALLAKLGIRPFSYGLVITNVYDSGSVFSPEVLDLTEEDLMEKFASGVSMVASVSLAISYPTIAAAPHMFLNGYKNVLAVAVETEYSYPHADKIKEYLKDPSKFAVAAAVAAADSGAAAPAASKEEEKKEEPEEESDGDLGMSLFD

SEQ ID NO: 3618 - protein, 322 aa, Oryza sativa
  unsure (1)..(322): unsure at all Xaa locations
MAIKRTKAEKKVAYDKKLCQLLDEYTKVLIAVADNVGSNQLQEIRKGLRGDSIVLMGKNTLIRRCIKVHADNTGNKDFLELMPLLVGNVGLIFTKGDLKEVREEVAKYKVGAPARVGLVAPVGCXVVPPGNTGLDPSQTSFFQVLNIPTKINKGXTVEIITPVELIKKGDKVGSSESALLAKLGIRPFSYGLVITNVYDSGSVFSPEVLDLTEEDLMEKFASGVSMVASVSLAISYPTIAAAPHMFLNGYKNVLAVAVETEYSYPHADKIKEYLKDPSKFAVAAPVAAADSGAAAVASSKEEEKKEEPEEESDGDLGMSLFD

SEQ ID NO: 3619 - protein, 265 aa, Oryza sativa
  unsure (1)..(265): unsure at all Xaa locations
MAIKRTKAEKKVAYDKKLCQLLDEYTKVLIAVADNVGSNQLQEIRKGLRGDSIVLMGKNTLIRRCIKVHADNTGNKEFLELMPLLVGNVGLIFTKGDLKEVREEVAKYKVGAPARVGLVAPVDVVVPPGNTGLDPSQTSFFQVLNIPTKINKGTVEIITPVELIKKGDKVGSSESALLAKLGIRPFSYGLVITNVYDSGSVFSPEVLDLTEDDLMEKFASGVSMVASVSLAISYPTIAAAPHMFLNGYXECACCCCGDRILVPTC

SEQ ID NO: 3620 - protein, 176 aa, Oryza sativa
  unsure (1)..(176): unsure at all Xaa locations
MARPQQRYRGVRQRHWGSWVSEIRHPLLKTRIWLGTFETAEDAARAYDEAARIMCGPRVRTNFPHDPHSAAAASSSFLSAALVAKLHRFNLASVQAAQRGNSNDDDSTTSSSAAASSRAVIPSLPAAAGALGNAXXATAEWSGGFLEEQYVDQMIEELLDYFSMEISSDVPCSSTC

SEQ ID NO: 3621 - protein, 216 aa, Oryza sativa
  unsure (1)..(216): unsure at all Xaa locations
MARLTTLITSTSLPPQPRAHSSLSRRERALSLAATTRNPSPSSRTSAMARPQQRYRGVRQRHWGSWVSEIRHPLLKTRIWLGTFETAEDAARAYDEAARIMCGPRVRTNFPHDPHSAAAASSSFLSAALVAKLHRFNLASVQAAQRGNSNDDDSTTSSSAAASSRAVIPSLPAAAGALGNAXXATAEWSGGFLEEQYVDQMIEELLDYFSMEISCX

SEQ ID NO: 3622 - protein, 322 aa, Oryza sativa
  unsure (1)..(322): unsure at all Xaa locations
MTAKGGAAPSPGGAGGLPNGRFFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFXQAVGATTPFFTAVFAYIMTVKRESWVTYLTLVPVVTGVMIASGGEPSFHLFGFIMCIGATAARALKTVLQGILLSSEGEKLNSMNLLLYMAPIAVILLLPATIFMEDNVVGITIELAKKDTTIVWLLLFNSCLAYFVNLTNFLVTKHTSALTLQVLGNAKGAVAVVVSILIFRNPVSVTGMLGYTLTVIGVILYSESKKRNKP

SEQ ID NO: 3623 - protein, 420 aa, Oryza sativa
MSTGGGVNGGAPGARDAPIDNTNGGNFALQSSGGTFTGPRRTATSVPIIAVFPEDIVYEAPLPKPNSTPVVQFWSEFSTHPLYKSGCVTVYSLATVRTTHTTFLRTGDCTASTYNPIQSEAKNRLVSHAVASGQSFLVVQYPGDFSIFRGPRRAPVHHSLARKTKSISARLALHRQRIRRRYRYSPGEYIGMRIQCNACEAAAATVVCCADEAALCARCDVEIHAANKLASKHQRLPLDAALPAALPRCDVCQEKAAFIFCVEDRALFCRDCDEPIHVPGTLSGNHQRYLTTGIRVGFSSVCSANADHLPPPAPKGNSKPPASGIAAAAAPKPAVSAAAQEKGSPIGFKDLEWLDDIDLFHVQSPAKGGSTAAEVPELFASPQPASNMGLYKASGARQSKKPRVEIPDDDEDFFIVPDLG

SEQ ID NO: 3624 - protein, 257 aa, Oryza sativa
MRIQCDACEAAAATVVCCADEAALCARCDVEIHAANKLASKHQRLPLDAALPAALPRCDVCQEKAAFIFCVEDRALFCRDCDEPIHVPGTLSGNHQRYLTTGIRVGFSSVCSANADHLPPPAPKGNSKPPASGIAAAAAPKPAVSAAAQEVPSSPFLPPSGWAVEDLLQLSDYESSDKKGSPIGFKDLEWLDDIDLFHVQSPAKGGSTAAEVPELFASPQPASNMGLYKASGARQSKKPRVEIPDDDEDFFIVPDLG

SEQ ID NO: 3625 - protein, 175 aa, Oryza sativa
ATSSAYPPPPPYYRLYKDYEKDPSSAPEPPPPVDGPYQLFGATYTTDVVLPSLEDQGVRQLYPKSPDIDFKKELRTLNRELQLHILELADILVERPSQYARRVEDISLIFKNLHHLLNSLRPHQARATLIHMLENQIQRRKQAIEDIKQRREEAQKLLGESLLILDGNQPSLPAM

SEQ ID NO: 3626 - protein, 578 aa, Oryza sativa
  unsure (1)..(578): unsure at all Xaa locations
MSCSWMIPVFAILAFVASAAQADVVEHTFNVATLSLPRICRNTSVTAVNGRVPGPQVEAREGDTVVIHVINDSPYNVTVHWYMYLNRGTPWADGPAMVTQCPIRPGHRYTYRFAVAGQEGTLWWHAHSSYMRATVYGALVIRPRRAGGYPFPTPYEEKTVLLGEWWNGDPVALESQSFSTGIPAPNADAYTINGMPGDSYLCPETTNRIAKFEVRRDKTYLLRIINAALNTAFFFKVAGHTFTVVAADASYTEPYATDVIVIAPGQTVDALMAADASPGXXYHMAISSYQSAIPFPPRPAGFNGNTSTAIVEYVDATATTDAGSPVLPVMPKPNDTYTANQFYTSLTALIRPGRRTVPLTVDTRMLVTVGLGFSSCQPEQTQCNRSAPVVLANMNNVSFALPNTVSMLEALYHTADGVYTRDFPDQPPVAFDYTSRGLLGNSPLASTGSPSTKVKTLRYNATVEMVLQNTALVGLESHPMHLHGFNFFVVAQGFGNNDGEAAGAGEFNLVNPQERNTVAVPTGGWAVIRFVADNPGMWAMHCHIDSHFAIGLAMVFEVESGPTPGTTLPPPPPDLPQC

SEQ ID NO: 3627 - protein, 622 aa, Oryza sativa
  unsure (1)..(622): unsure at all Xaa locations
MENATLSNCGSSTDILSNCGSSTAQPVERGLFDSPACRTGAVRQVLSNGSLPISSPVALWPFDXXRPIELHPFDRDLFSRFSPPGNTSVTAVNGRVPGPQVEAREGDTVVIHVINDSPYNVTVHWHGVFQRGTPWADGPAMVTQCPIRPGHRYTYRFAVAGQEGTLWWHAHSSYMRATVYGALVIRPRRAGGYPFPTPYEEKTVLLGEWWNGDPVALESQSFSTGIPAPNADAYTINGMPGDSYLCPETTNRIAKFEVRRDKTYLLRIINAALNTAFFFKVAGHTFTVVAADASYTEPYATDVIVIAPGQTVDALMAADASPGXXYHMAISSYQSAIPFPPRPAGFNGNTSTAIVEYVDATATTDAGSPVLPVMPKPNDTYTANQFYTSLTALIRPGRRTVPLTVDTRMLVTVGLGFSSCQPEQTQCNRSAPVVLANMNNVSFALPNTVSMLEALYHTADGVYTRDFPDQPPVAFDYTSRGLLGNSPLASTGSPSTKVKTLRYNATVEMVLQNTALVGLESHPMHLHGFNFFVVAQGFGNNDGEAAGAGEFNLVNPQERNTVAVPTGGWAVIRFVADNPGMWAMHCHIDSHFAIGLAMVFEVESGPTPGTTLPPPPPDLPQC

SEQ ID NO: 3628 - protein, 456 aa, Oryza sativa
MQKQLRRLRTLGRGASGAVVWLASDDASGELLAVKSAAGEGGAEQLRREGRVMSGLCSPHIVPCLGSRAAAGGEYQLFLEFAPGGSLADEAARSGGRLAERAISAYAADVARALAYLHGNSLVHGDVKARNIMVGADGRAKLADFGCARRTDSERPIGGTPAFMAPEVARGEEQGPAADVWALGCTIIEMATGRVPWSDMDDVFSAVHRIGYTDAVPEIPEWLSPEAKNFLSRCFTRNPSDRPTAAQLLEHPFLASASSDIDETAPKHGWVSPKSTLNAECWESDEDDEVEEGMSQSATKRISALAITCSALPDWDSEDGWIDLQSDPSEVSETPAPMVVTTADFGLWWEEALDAEIDLHFVDVDGDGYVTRTVRARGFIEYDRQLSVRVRGDMPLCPVDCHRSDTVKFGCHCNGNRVINFESAQKNTKKKKKKTHKKKKRGGGHERETSSSLSLL

SEQ ID NO: 3629 - protein, 170 aa, Oryza sativa
  unsure (1)..(170): unsure at all Xaa locations
MQEQATSSRPSSSERSSSSGGHLEIKEGMESDEEIGRVPELGLEPGGASTSGRAAGGGGGGAERAQSSYGAGQRAXRRGRSPADKEHKRLKRLLRNRVSAQQARERKKAYLNDLEVKVKDLEKKNSEXLEERFSTLQNENQMLRQILKNTTVSRRGPGSTASGEGQXRRR

SEQ ID NO: 3630 - protein, 339 aa, Oryza sativa
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 3631 - protein, 267 aa, Oryza sativa
MGRGKVQLKRIENSMNRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIRSRKSHLMLESISELQKKERSLQEENKALQKELVERQKNVRGQQQVGQWDQTQVQAQAQAQPQAQTSFFFFFMLRDQQALLSPQNICYPPVMMGQRNDAAARRRWRPKARCNFRIGGFPPWMLSTFKA

SEQ ID NO: 3632 - protein, 270 aa, Oryza sativa
  unsure (1)..(270): unsure at all Xaa locations
MGRGKVQLKRIENKINRQVTFSKRRNGLLKKAHEISVLCDAEVAAIVFSPKGKLYEYATDSRMDKILERYERYSYAEKALISAESESEITLPHXQHALHPEVLMVFVXQYCLRHLMGEDLESLNLKELQQLEQQLESSLKHIISRKCSFLAXXVQERSLQEENKALQKELVERQKNVRGQQQVGQWDQTQVQAQAQAQPQAQTSSSSSSMLRDQQALLPPQNICYPPVMMGERNDAAAAAAVAAQGQMIIVVVVGQTAAVCTVNHGSNLE

SEQ ID NO: 3633 - protein, 267 aa, Oryza sativa
MGRGKVQLKRIENKINRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIISRKSHLMLESISELQKKERSLQEENKALQKELVERQKNVRGQQQVGQWDQTQVQAQAQAQPQAQTSSSSSSMLRDQQALLPPQNICYPPVMMGERNDAAAAAAVAAQGQVQLRIGGLPPWMLSHLNA

SEQ ID NO: 3634 - protein, 178 aa, Oryza sativa
  unsure (1)..(178): unsure at all Xaa locations
LHEHFGQSRRELGALLPLFRRAHVSLGLGYVDVGRTATEMTNGANTVGHDXKVCLLLDEYTTVGIRRCPSGESYQLVXMHWGTQGXVHLSHGEYTVIRRCMRGLSGNSGNKVILELLPLLGGKVGLIFTKGDHKDVRXEVGQNKGGAPASDDRGAPGEGVVAAGXTGAXPFQTWFFHX

SEQ ID NO: 3635 - protein, 267 aa, Oryza sativa
CTSSLSFNMWSFASNAIAGSIRKKAQPSKCSQSNPDCSDDDVSSCASREEGLECPICWESFNLVENVPYVLWCGHTMCKNCILGLQWAVVKFPTLPIQLPLFISCPWCNLISFRLVYKGKPQVPRKNYFLLWMVESMNGERAKFHSPSHEERHSLSSGGGPSSSQHHRRPAPRTESASGRERSVAGNVFNTYSISASLQKIMLSFVQMTAKFPLVIIFLLIVLYAVPASVAVLVLYVLVTVLFALPSFLILYFAYPSLDWLVREIFN

SEQ ID NO: 3636 - protein, 767 aa, Oryza sativa
  unsure (1)..(767): unsure at all Xaa locations
MATVSDIGLSAAINVSMAVAFLLVFAFLRLQPINDRVYFPKWYLRGMRDSPVSSGAAVQKVVNLNMRSYLKFLSWMPAALKMPEDELINHAGLDSAVYLRIYLTGIKIFVPISILASLVLFPVNWTNDTLDSMKVVHSKIDKLSISNIPYGSNRFVTHLVMAYAVTFWTCYVLFREYEIITTMRLRFLASEKRRPDQFTVLVRNIPPDPDESISELVEHFFLVNHPDHYLRHQVVYNANKLADLVEKKKKLQNWLDYYQLKYERNPSKRPTTKTGFLGCFGSEVDAIEYYKAEIEKIGKEEADERQKIMKDPQSAVPAAFVSFRSRWGAAVCAQTQQTSNPTVWITEWAPEPRDVYWNNLSIPFVSLTVRRLIVAVAFFFLNFFYVIPIAFVQSLASLEGIEKALPFLKPLIKIDVIKSFIQGFLPGIALKVFLILLPTILMFMSKFEGLISQSSLERRSASKYYIFLVFNVFLGSIVTGSALDQLKAYIHQSANEIPRTIGVAIPMRATFFITYVMVDGWTGVAGEILRLRALIIFHLKNFFLVKTEKDREEAMDPGSICFDWCEPRIQLYFLLGLVYAVVTPLLLPFILVFFGLAYVVYRHQIINVYNQQYESGAQFWPSVHGRIIIALIVSQLLLIGLLSTKGFEETTPVLVVLPVLTFWFYKYCKNRFEPAFVRNPLQEAMRKDTLERAREPTFDLKAYLANAYLHPVFKGREEEDNMSISEDVGMEEVIVPTKRQSRRNTPAQSKYEGSDTLSLPETVHERX

SEQ ID NO: 3637 - protein, 262 aa, Oryza sativa
  unsure (1)..(262): unsure at all Xaa locations
XFFVTIWIAAVMFKSNDILRKQTALKGERKMSVLVGITILFVVHVFGVYWCYKNGDLVRPLVALAPKEIPPFWHAIFIILVNDTMVRQTAMIIKCMLLMYYKNSKGRSYRRQGQMLTVVEYFLLLYRALLPAPVWYRFFLNKEYGSLFSSLTTGLYLTFKLTSVVEKVQSFLTALRALSHKDFHYGSYATSEQVSATGDMCAICQEKMHTPILLRCKHIFCEDCVSEWFERERTCPLCRALVKPADLRSFGDGSTSLFFQLF

SEQ ID NO: 3638 - protein, 289 aa, Oryza sativa
  unsure (1)..(289): unsure at all Xaa locations
SGXXSRLDPRVRRYDIQQVARWVEQILPFSLLLLVVFIRQHLQGFFVTIWIAAVMFKSNDILRKQTALKGERKMSVLVGITILFVVHVFGVYWCYKNGDLVRPLVALAPKEIPPFWHAIFIILVNXXIRFLIMWVPSXILCRYNGAPNCYDHQGQMLTVVEYFLLLYRALLPAPVWYRFFLNKEYGSLFSSLTTGLYLTFKLTSVVEKVQSFLTALRALSHKDFHYGSYATSEQXNMCAICQEKMHTPILLRCKHIFCEDCVSEWXSTCILHPLLXXPLKISXFXSCIF

SEQ ID NO: 3639 - protein, 821 aa, Oryza sativa
MNNWALEIIDFVFGIYSRSGFGDDWIYRPAEQPRSDRAPVRPVVQRRSDRPPVRPATVPRSDRPRRNFSKNSKIDFARGYMSIGSSGRFGGKKGERVDREFRLFAAHDRRGGAFRRSDRREHSGQTGGGDKRGEQLRRSDRLIYTGQTDDIRAVRPARQLRSDRSPSISRPKSNWPVCKKNQPGQRKIMNWKGEDIETGQRKKKQTVRRRPVAARRWATVRHEPPRATTQRCSGGGFRGGDQVRRGGNWRVGRGAARDGVQGGFVEREEVRVRVWREFLRRVGRGAACGDGDLAAHDGESGREEGGDAPNFRFWAYTTQKTSLMSEDRPYLLSRALPSSITDVGLNPTISPITHRAQQSPSFQTLGSNTTCYPTGPEITIGNQTQKKHHSRSKHNDDTEARYLIMEFSRGLHLQGTDYGRSSPIQHIQRIRVTTTHSRSPPAAVPSRYAKCRAAVAWEAGKPLSIEEVEVAPPQAMEVRLKILYTALCHTDVYFWEAKGQTPVFPRIFGHEAGGIVESVGEGVTELSPGDHVLPVFTGECGDCRHCLSEESNLCDLLRINTDRGAMIGDGQTRFTARGGQPVYHFLGTSTFSEYTVVHVGCVAKIHPAAPLDKVCVLSCGISTGFGATVNVAKPPKGCTVAIFGLGAVGLAAMEGARISGASRIIGVDLNPAKFELAKKFGCTDFVNPKDYDKPVQQVIIEMTNGGVDRSVECTGNAAAMISAFDCVNDGWGVAVLVGVAGKDAAFKTHPTNFLNERTLRGTFFGNYKPRTDLPGVVEMYMNKELELEKFITHSVPFSEINTAFDLMLSGESLRCIIRMED

SEQ ID NO: 3640 - protein, 380 aa, Oryza sativa
MATAGKVIKCKAAVAWEAGKPLSIEEVEVAPPQAMEVRLKILYTALCHTDVYFWEAKGQTPVFPRIFGHEAGGIVESVGEGVTELSPGDTWLPVFTGECGDCRHCLSEESNLCDLLRINTDRGAMIGDGQTRFTARGGQPVYHFLGTSTFSEYTVVHVGCVAKIHPAAPLDKVCVLSCGISTGFGATVNVAKPPKGCTVAIFGLGAVGLAAMEGARISGASRIIGVDLNPAKFEQAKKFGCTDFVNPKDYDKPVQQVIIEMTNGGVDRSVECTGNAAAMISAFECVHDGWGVAVLVGVAGKDAAFKTHPTNFLNERTLRGTFFGNYKPRTDLPGVVEMYMNKELELEKFITHSVPFSEINTAFDLMLSGESLRCIIRMED

SEQ ID NO: 3641 - protein, 119 aa, Oryza sativa
  unsure (1)..(119): unsure at all Xaa locations
MVLKSGVAEDGGAXAAAVMRRCLSASWRRRVTDCVLARELHDNVADLNDPLWSAKXALLSSPHLERKVHVDYLEAGADIIITASYQATIQGFESKGFSKEQSEDLLAESDETAREAPDX

SEQ ID NO: 3642 - protein, 400 aa, Oryza sativa
  unsure (1)..(400): unsure at all Xaa locations
MTTAIAIEDVRREVRILSSLTGHSNLVQFYDAFEDEDNVYIVMELCKGGELLDRILARGGKYSEEDAKVVMVQILSVVSFCHLQGVVHRDLKPENFLFTSKDENSALKVIDFGLSDFVKPDERLNDIVGSAYYVAPEVLHRSYGTEADMWSIGVIAYILLCGSRPFWARTESGIFRAVLKAEPSFDEAPWPTLTAEAKDFVKRLLNKDYRKRMTAAQALSHPWIRNSQQVKIPLDMIIYKLMRAYISSSSLRKSALRALAKTLTANQLFYLREQFELLGPNKNGYISLQNLKTALVKNSTDAMKDSRVIDFVNTVCTLQYRKLDFEEFAASAVSVYQMEALETWEQHARRAYELFDKEGNRPIVIEELAXDWIRHADGKLSFLGFIKLLHGVSSRSIPKA

SEQ ID NO: 3643 - protein, 597 aa, Oryza sativa
MGLCHGKSAAVLEPTVEEEEEGATRVAEAAAAPAKPASPAPSAAAAAAKPGTPKQHKFPFYLPSPLPASSYKGSPANSSVASTPARGGFKRPFPPPSPAKHIRALLARRHGSVKPNEASIPESGEPGVALDKGFGFSRHFAAKYELGREVGRGHFGYTCAATCKKGELKGDDVAVKVIPKAKMTTAIAIEDVRREVRILSSLAGHSNLVQFYDAYEDEENVYIVMELCKGGELLDRILARGGKYSEEDAKVVMRQILSVASFCHLQGVVHRDLKPENFLFSSKDENSAMKVIDFGLSDFVKPDERLNDIVGSAYYVAPEVLHRSYGTEADMWSIGVIVYILLCGSRPFWARTESGIFRAVLKADPSFEEAPWPTLSAEAKDFVRRLLNKDYRKRMTAAQALCHPWIRGTEEVKLPLDMIIYRLMRAYISSSSLRRAALRALAKTLTTDQIYYLREQFELIGPNKSDLITLQNLKTALMKNSTNAMKDSRVVDFVNTISNIQYRKLDFEEFSAAAISVYQMEGLETWEQHARQAYEFFDKEGNRPIVIDELASGLGLGPSVPLHVVLQDWIRHPDGKLSFLGFMKLLHGVSSRTIPKT

SEQ ID NO: 3644 - protein, 581 aa, Oryza sativa
  unsure (1)..(581): unsure at all Xaa locations
MGLCHGKPSQIPEPEAEEAAAAAGVAVAGAASPAKQPKFPFYLPSPLPASSYKSSPANSSVASTPARGGXLKRPFPPPSPAKHIRALLARRHGSVKPNEAPIPEGGETEVGLDKGFGFSKHFFAKYELGDEVGRGHFGYTCSAKAKKGDHKGHDVAVKVIPKAKMTTAIAIEDVRREVRILSSLTGHSNLVQFYDAFEDEDNVYIVMELCKGGELLDRILARGGKYSEEDAKVVMVQILSVVSFCHLQGVVHRDLKPENFLFTSKDENSALKVIDFGLSDFVKPDERLNDIVGSAYYVAPEVLHRSYGTEADMWSIGVIAYILLCGSRPFWARTESGIFRAVLKAEPSFDEAPWPTLTAEAKDFVKRLLNKDYRKRMTAAQALSHPWIRNSQQVKIPLDMIIYKLMRAYISSSSLRKSALRALAKTLTANQLFYLREQFELLGPNKNGLXISLQNLKTALXVKNSTDAMKDSRVIDFVNTVCTLQYRKLDFEEFAASAVSVYQMEALETWEQHARRAYELFDKEGNRPIVIEELASELGLGPSVPLHVVLQDWIRHADGKLSFLGFIKLLHGVSSRSIPKA

SEQ ID NO: 3645 - protein, 206 aa, Oryza sativa
  unsure (1)..(206): unsure at all Xaa locations
RAAGIRHEGSRCCAPHPTSIRERIEESKEPAGTASCSSRSKIISLQRASAMSSLMDKAKGFVAEKIAHIPKPEASLDSLSFKGMSRECITVHSNVNVSNPYDHRLPICELTYTLKCAGNVVASGTMPDPGWIAASDTTKLEIPAKIPYDFLISLVKDVGRDWDIDYQLDVGLTIDLPIVGNFTIPLSTSGEMKLPTLKDMFXLSYL

SEQ ID NO: 3646 - protein, 758 aa, Oryza sativa
MALIGTVAAEVLIPLAAVIGILFAVLQWYMVSRVAVERESDGGDGDGDGVDDEEDGVDYRGVEARCAEIQHAISVGATSFLMTEYKYLGAFMAAFAAVIFVSLGSVGRFSTSTEPCPYDAARRCRPALANAAFTAAAFLLGATTSVVSGYLGMRVATFANARTALEARRGIGRAFAVAFRSGAAMGFLLASSALLVLFAAVNAFGLYYGDDWGGLYEAITGYGLGGSSMALFGRVGGGIYTKAADVGADLVGKVERNIPEDDPRNPAVIADNVGDNVGDIAGMGSDLFGSYAESSCAALFVASISSFGADHDFAAMMYPLLVSAAGIVACAATTLVATDAGELGAADEVAPALKRQILISTVLMTAAVAAVTFLSLPRSFTLFDFGERKLVKNWHLFICVSAGLWAGLVIGYVTEYFTSNAYGPVQTVAQSCRTGAATNVIFGLAVGYKSVIVPIFAIAGAIYASFRLAAMYGIALAALGMLSTIATGLTIDAYGPISDNAGGIAEMAGMPRRVRERTDALDAAGNTTAAIGKGFAIGSAALVSLALFGAYVSRAGIRTVNVVSPRVFVGLLAGAMLPYWFSAMTMRSVGSAALRMVEEVRRQFDEIPGLAEGLAAPDYATCVRISTDASLREMVAPGALVMASPLVAGTLFGVEALAGLLAGALVSGVQVAISASNSGGAWDNAKKYIEAGATEEARSLGPKGSEAHKAAVIGDTIGDPLKDTSGPSLNILVKLMAVEALVFAPFFAAHGGIVFNHL

SEQ ID NO: 3647 - protein, 446 aa, Oryza sativa
  unsure (1)..(446): unsure at all Xaa locations
PTRPKDFKKSNQKSRALLSSSSAXAHRRWRWPVVSGRIVEMGECRGGGGGGDCLIKLFGKTIPVPEPGACAAGDVDKDLQHSGSSTTEPKTQENTVQDSTSPPPQPEVVDTEDSSADKNSSENQQQQGDTANQKEKLKKPDKILPCPRCSSMDTKFCYYNNYNINQPRHFCKNCQRYWTAGGAMRNVPVGAGRRKSKSVSAASHFLQRVRXCSARXSSSLCPSXXTNGTVLSFGSDLSTLDLTEQMKHLKDKFIXXNNRYQEHRRDXXVGLCAEGLSKTEESNQTNLKEKVSADRSPNVAQHPCMNGGAMWPFGVAPPPAYYTSSIAIPFYPAAAAAVAAYWGCMVPGAWNAPWPPQSQSQSVSSSSAASPVSTMTNCFRLGKHPRDGXXEELDSKGNGKVWVPKTVRIDDVDEVARSSIWSLIGIKGDKGNPAALTRSVTFQEGS

SEQ ID NO: 3648 - protein, 553 aa, Oryza sativa
  unsure (1)..(553): unsure at all Xaa locations
YRNRQVRPTAYPPRVTPTRHGPRSANTLSAVYSRRGLPILASSRSWPNEARAYRPLAVEAQQPELVKISTNPDFKKSNQKSRALLSSSSSSSAXAHRRWRWPVVSGRIVEMGECRGGGGGGDCLIKLFGKTIPVPEPGACAAGDVDKDLQHSGSSTTEPKTQENTVQDSTSPPPQPEVVDTEDSSADKNSSENQQQQGDTANQKEKLKKPDKILPCPRCSSMDTKFCYYNNYNINQPRHFCKNCQRYWTAGGAMRNVPVGAGRRKSKSVSAASHFLQRVRXCSARXSSSLCPSXXTNGTVLSFGSDLSTLDLTEQMKHLKDKFIXXNNRYQEHRRDXXVGLCAEGLSKTEESNQTNLKEKVSADRSPNVAQHPCMNGGAMWPFGVAPPPAYYTSSIAIPFYPAAAAAVAAYWGCMVPGAWNAPWPPQSQSQSVSSSSAASPVSTMTNCFRLGKHPRDGXXEELDSKGNGKVWVPKTVRIDDVDEVARSSIWSLIGIKGDKVGADHGRGCKLAXXVFESKDEAKASTHTAISSLPFMQGNPAALTRSVTFQEGS

SEQ ID NO: 3649 - protein, 154 aa, Oryza sativa
  unsure (1)..(154): unsure at all Xaa locations
MAEKIVDPSRRRDIPRAARAAAVADLALAAGHRAAARRRRRTPYWGGEGFGEMPPKRQRSAAGPSGEAPVNSLDDGCLMHIFSFLSPIPAIEYDSMAEKIFSSLKEQGHGVTVVRTRIEGGAKAVRTNGTLALQHVRAIYSRSSVFFWFEVGEX

SEQ ID NO: 3650 - protein, 158 aa, Oryza sativa
  unsure (1)..(158): unsure at all Xaa locations
MAEKIVDPSRRRDIPRAARAAAVADLALAAGHRAAARRRRRTPYWGGEGFGEMPPKRQRSAAGPSGEAPVNSLDDGCLMHIFSFLSPIPDRYNTALVCHRWRFLACHPRLWLRVERPIRNTIEPGVYPNLESAVSAASTGEXRLSMIRSHHSRSKDMV

SEQ ID NO: 3651 - protein, 309 aa, Oryza sativa
  unsure (1)..(309): unsure at all Xaa locations
GRVGGRVGGRVGGRVGARAAAVADLALAAGHRAAARRRRRTPYWGGEGFGEMPPKRQRSAAGPSGEAPVNSLDDGCLMHIFSFLSPIPDRYNTALVCHRWRFLACHPRLWLRVERPIRNTIEPGVYPNLESAVSAARPGDTILIAAGGTHVARNIQIKKPLCIIGGGELPDDTVLTCSRGSDNALEFHSTCKIANLTIRAKLGCCLLYRSGRLTFGGACFQCEQNPLDFLPFLLIRTALEFNWFXXXLRGQGLGVPVVRPRFEGGAKAVRPIGPLGLNLVRAIYFRSFVFFWFEVGGNQCKPVRPWPCF

SEQ ID NO: 3652 - protein, 309 aa, Oryza sativa
  unsure (1)..(309): unsure at all Xaa locations
MAAAAETSAKVGAPRRWSLQGKTALVTGGTRGIGRAVVEELAALGATVHTCSRKEEELSERLKEWEARGFRVTTXSVCDLSVRXDQRERLLXRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGLLANKDFEGAVVSRTPLRRVGEPEEVSSLVAFLCMPGSSYITGQTISVDGGMTINGXSIQVKINGLSRRRYVPAVQKRPYMLFLGFAKQSEYCVN

SEQ ID NO: 3653 - protein, 741 aa, Oryza sativa
  unsure (1)..(741): unsure at all Xaa locations
PACRLLSFPSPVWWRSSDRRLRAVLLFSQGGQYSRRGHRCRRRRLGARAASPQGGRLVGCGRQHGPPXALGGGGALEIEKTPEAAEDMESEPALAAAREAERVPPWREQVTARGMVAALLIGVVYTVIVMKLSLTTGLIPTLNVSAALLAFLALRGWTHALDRLGIASRPFTRQENTVIQTCAVACYTIGYGGGFGSFLLGLNKKTYELSGASTPGNVPGSYKEPGIGWMTGFLLSTSFVGLLTLLPLRKVLVIDYKLTYPSGTATAVLINGFHTPQGDKNAKKQVRGFLRYFGISFLWSFFQWFYTGGDVCGFLQFPTFGLKAWKHTFFFDFSLTYVGAGMICSHLVNLSLLFGAILSWGIMWPLIGKQKGNWYSAKASESSMSGLFGYKSFICIALLVGDGFYNFVKVIVVTLKSVRERSRRRGLNNRVAVADADTMAIDDMQRNEVFNRDNIPTWMAYTGYTLLSVIAVVLIPVMFRQVKWYYVIIAYLLAPALGFCNAYGTGLTDMNMGYNYGKIALFIFAAWAGKDDGVVAGLVGCGLVKQLVLISADLMPDFKTGHLTLTSPRSMLVGQVVGTLMGCVVAPLTFFLFYKAFDVGDPNGYWKAPYALIYRNMAIIGVEGFSALPRHCLQLCAGFFAFAVLANLARDFLPRRYGRYMPLPMAMAVPFLVGASFAIDMCAGSLVVFLWHRFDGKRAALLVPAVASGLICGDGIWTFPSSLLALAKVKPPICMKFIPGN

SEQ ID NO: 3654 - protein, 727 aa, Oryza sativa
  unsure (1)..(727): unsure at all Xaa locations
MQKSSAREEEEEEEEVAAGAGRRGHRCRRRRLGARAASPQGGRLVGCGRQHGPPXALGGGGALEIEKTPEAAEDMESEPALAAAREAERVPPWREQVTARGMVAALLIGVVYTVIVMKLSLTTGLIPTLNVSAALLAFLALRGWTHALDRLGIASRPFTRQENTVIQTCAVACYTIGYGGGFGSFLLGLNKKTYELSGASTPGNVPGSYKEPGIGWMTGFLLSTSFVGLLTLLPLRKVLVIDYKLTYPSGTATAVLINGFHTPQGDKNAREQVRGFLRYFGISFLWSFFQWFYTGGDVCGFLQFPTFGLKAWKHTFFFDFSLTYVGAGMICSHLVNLSLLFGAILSWGIMWPLIGKQKGNWYSAKASESSMSGLFGYKSFICIALLVGDGFYNFVKVIVVTLKSVRERSRRRGLNNRVADADTMAIDDMQRNEVFNRDNIPTWMAYTGYTLLSVIAVVLIPVMFRQVKWYYVIIAYLLAPALGFCNAYGTGLTDMNMGYNYGKIALFIFAAWAGKDDGXVAGLVGCGLVKQLVLISADLMHDFKTGHLTLTSPRSMLVGQVVGTLMGCVVAPLTFFLFYKAFDVGDPNGYWKAPYALIYRNMAIIGVEGFSALPRHCLQLCAGFFAFAVLANLARDFLPRRYGRYMPLPMAMAVPFLVGASFAIDMCAGSXLVVFLWHRFDGKRAALLVPAVASGLICGDGIWTFPSSLLALAKVKPPICMKFIPGN

SEQ ID NO: 3655 - protein, 80 aa, Oryza sativa
  unsure (1)..(80): unsure at all Xaa locations
XPHMFPNGDKNVLSVSVETENLYPQAYKIKGDFKDPPKFAVVAPVAPHRGGAAPTAPKEEKKKEKPQEESHGDLGISLFE

SEQ ID NO: 3656 - protein, 262 aa, Oryza sativa
MENGGGDVPENANDHCPGTQSEAAGKADACTGCPNQQICATAPKGPDPGVMSIGFMLPNPDDAVIWRGPRKNGLIKQFLKDVDWGEIDYLVVDAPPGTSDEHISIVQYLQIAGIDGAIIVTTPQQVSLIDVKKEINFCKKVGVPVLGVVENMSGLRQAFSDMKFVKPSEAGETDATEWALNYIKEKAPELLSVVACSEVFDSSKGGAEKMCQEMEVPFLGKVPMDPQLCKAAEEGRSCFTDQKCSASAPALKSIIKKLVKTK

SEQ ID NO: 3657 - protein, 262 aa, Oryza sativa
MENGGGDVPENANDHCPGTQSEAAGKADACAGCPNQQICATAPKGPDPGVMSIGFMLPNPDDAVIWRGPRKNGLIKQFLKDVDWGEIDYLVVDAPPGTSDEHISIVQYLQIAGIDGAIIVTTPQQVSLIDVKKEINFCKKVGVPVLGVVENMSGLRQAFSDMKFVKPSEAGETDATEWALNYIKEKAPELLSVVACSEVFDSSKGGAEKMCQEMEVPFLGKVPMDPQLCKAAEEGRSCFTDQKCSASAPALKSIIKKLVKTK

SEQ ID NO: 3658 - protein, 348 aa, Oryza sativa
  unsure (1)..(348): unsure at all Xaa locations
MENGGGDVPENANDHCPGTQSEAAGKADACAGCPNQQICATAPKGPDPDLLAIIERMNTVKHKILVLSGKGGVGKSTFSAQLSFALAEMDHQVGLLDIDICGPSIPKMLGLEGQDIHQSNLGWSPVYVESNLGVMSIGFMLPNPDDAGIWRGPRRNGLIKQFLKDVDWGEIDYLVVDAPPGTSDEHISIVQYLQIAGIDGAIIVTTPQQVSLIDVKKEINFCKKVGVPVLGVVENMSGLRQAFSDMKFVKXXSEAGETDATEWALNYIKEKAPELLSVVACSEVFDSSKGGAEKMCQEMEVPFLGKVPMDPQLCKAAEEGRSCFTDQKCSASAPALKSIIKKLVKTKX

SEQ ID NO: 3659 - protein, 337 aa, Oryza sativa
  unsure (1)..(337): unsure at all Xaa locations
NGGGDVPENANDHCPGTQSEAAGKADACAGCPNQQICATAPKGPDPDLLAIIERMNTVKHKILVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQIAGIDGAIIVTTPQQVSLIDVKKEINFCKKVGVPVLGVVENMSGLRQALLSVVACSEVFDSSKGGAEKMCQEMEVPFLGKVPMDPQLCKAAEEGRSCFTDQKCSASAPALKSIIKKLVKTKXEGGVTHDREVTPVVSAVWSAITC

SEQ ID NO: 3660 - protein, 101 aa, Oryza sativa
LVRSGGPSSRTRRQKDKELNLGQSGVCSSSCTNRPTISRYAPADVKRPCNHASGVQQHGHNNLDCTSVPNFLPSGCSSGSGYSRRFDAMRKRTSDGGRFSR

SEQ ID NO: 3661 - protein, 872 aa, Oryza sativa
  unsure (1)..(872): unsure at all Xaa locations
XTRRDTWIKFANXCWKSGRISQAKSTLVKLLQLDPESSPELTLYHGHPQVVLAYLKYQYAVGDELKRRDAFCRLQDLSVQLATTTNSYSGTLASQVATSNAGVPLIARVYLTLASWKRALSPGLDDDSIQEILVSYKNATLNAKDWGKAWHLWALFNTEVMSRYTLRGRPDIAGKYVVAAVTGYFYSIACASTTKGVDDSLQDILRLLTLWFNHGATSEVQMALQKGFSLVNIEMWLVVLPQIIARIHSNNKIVRELIQSLLVRIGKDHPQALMYPLLVACKSISILRQRAAQEVVDKIRQHSGGLVDQAQLVSKELIRVAILWHEMWHEALEEASRMYFGEHNIEGMLAVLEPLHAMLERGXXETIKENTFIQAYGHELLEAHECCLKYRATGEDAELTKAWDLYYHVFRRIDKQLPSLTTLDLHSVSPELLXCRKLELAVPGTYSADAPLVTIEYFVPQLIXITSKQRPTDAWVHGSDGNDYAFLLKGHEDLRQDERVMQLFGLVNTLLENSRKTSEKDLSIQRYAVIPLSPNSGLIGWVPNCDTLHALIREYRDARKIFLNQEHRCMLSFAPDYDHLPLIAKVEVFQHALENSEGNDLAKVLWLKSRTSEVWLERRTNYTRSLAVMSMVGYLLGLGDRHPGNLMLDRYSGKILHIDFGDCFEASMNREKFPEKVPFRLTRMLVKAMEVSGIEGTFRTTCENVMQVLRTNKDSVMAMMEAFVHDPLINWRLFNFNEVPQVTNYGNAHSHTVVNSEEAANRELMQPPRGARERELLQAVNQLGDANEVLNERAVAVMARMSHKLTGRDFSSGSSLSGAGSSTQHGNEHLASGDTREVEPGLSVKVQVQRLILQATSHENLCQNYVGWCPFW

SEQ ID NO: 3662 - protein, 243 aa, Oryza sativa
  unsure (1)..(243): unsure at all Xaa locations
QSLSCQAHTPSASSLLPFLLSPCSLFLLVFQSSSMAVAIEAPFHVLAVDDSLPDRKLIERLLKTSSFQVTTVDSGSKALEFLGLHDHEDSPISTQSDQQVRREVGVNLIITDYCMPGMTGYDLLKKIKESSYLRDIPVVIMSSDNIPSRINRCLEEGADEVFLKPVXRLSDMSKLKPHILKSRCTEHYQREQHLQSHSESYTSSYPTGENSSSSTSTNSHNRKAGEDSLSDRKLIERLLKTSS

SEQ ID NO: 3663 - protein, 217 aa, Oryza sativa
  unsure (1)..(217): unsure at all Xaa locations
XLILWDGGSCHFRLSFCICSESSXMRCILLSGRMRCLAALARWEDLSALCREQWTGSEPSARLEMAPMAANAAWHMGEWAHRAEXVSRLDDGDENKLRILGTXTASGXGTSNGXFFRAVLSVRCKKYEEARVYVERARRCLATELAALVLESYERAYNNMVRVQQLSELEEVIDYCTLPMESTXIADSRRELIRNMWNERIKGTKRNVEVILCFFXL

SEQ ID NO: 3664 - protein, 167 aa, Oryza sativa
  unsure (1)..(167): unsure at all Xaa locations
XLDKKLYITGGLGLTDKSPNSWDIYDPVTNSWCVHKNPMLTPDIVKFVALDXGVGNCSXKAAWNRMYFAVVMDGTLYMLEQSLGTKLMMWQKETKEWIMLGRLSDKLTRPPCELVGIGRKIYIIGRGLSIVTIDLDTVRADGFLVSSSTGPLVEHDFPPERCRVISI

SEQ ID NO: 3665 - protein, 360 aa, Oryza sativa
  unsure (1)..(360): unsure at all Xaa locations
LLKXSTVESYPVAAWXSDGPHTSLIHGLPDEIAILCLARVPRRYHNALRCVSKRWRALLSSEEWHSCXRGTSSADEPWVYVICRSTGIKCYVLAPDPTTRSLKIMQVIEPPCSSREGISIETLDKRLFLLGGCSWLKDANDEVFCYDASSNCWSSVXXPMPTARCYFVSAALDKKLYITGGLGLTDKSPNSWDIYDPVTNSWCVHKNPMLTPDIVKFVALDGELVTVHKAAWNRTGIYDPLCRTWRGTENEIALCWSGSTVVMDGTLYMLEQSLGTKLMMWQKETKEWIMLGRLSDKLTRPPCELVGIGRKIYIIGRKGXVLVTXIDLDTVRADGFLVSSSTGPLVEHDFPPERCRVISI

SEQ ID NO: 3666 - protein, 245 aa, Oryza sativa
  unsure (1)..(245): unsure at all Xaa locations
XISADAQDPSKMPLLGDALVIAGTIFFAFSNVGEEYCVKKKDRVEFVAMFALFGLLVSIIQILIFEKKNLVAIAWSPTMLCLFAGFAVALFMFYSITPFVLKMSGSTLFNLSLLTSDMWAVAIRVLFYHQQINWLYYIAFAVVAIGLIIYSLNDHSSDSXEQEQLQIQKQQPNTSNFQERIIQQELVRTTAKKGNKRRKFISVSGGQCTKSPPGVEFGHNYIWLQRAKKKKNMLGGKHRSFVCPL

SEQ ID NO: 3667 - protein, 390 aa, Oryza sativa
MSVLTCVLDNMGSSCSRSHSLSEAETTKNAKSADIDRRILQETKAEQHIHKLLLLGAGESGKSTIFKQIKLLFQTGFDEAELRSYTSVIHANVYQTIKILYEGAKELSQVESDSSKYVISPDNQEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDIFEKKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 3668 - protein, 197 aa, Oryza sativa
MSFTLSYHQEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEFVKKKFEELYFQSSKPDRVDRVFKIYRTTALDQKLVKKTFKLIDESMRRSREGT

SEQ ID NO: 3669 - protein, 794 aa, Oryza sativa
  unsure (1)..(794): unsure at all Xaa locations
XVDDARLPLSRIVPIPSNQLNLYRIVIILRLIILMFFFQYRVTHPVRDAYGLWLVSVICEIWFALSWLLDQFPKWYPINRETYLDRLALRYDREGEPSQLAPIDVFVSTVDPLKEPPLITANTVLSILAVDYPVDKVSCYVSDDGSAMLTFEALSETAEFARKWVPFCKKHNIEPRAPEFYFAQKIDYLKDKIQPSFVKERRAMKREYEEFKVRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIVVKSCCGGRKKKSKSYMDSKNRMMKRTESSAPIFNMEDIEEGIEGYEDERSVLMSQKRLEKRFGQSPIFIASTFMTQGGIPPSTNPASLLKEAIHVISCGYEDKTEWGKEIGWIYGSVTEDILTGFKMHARGWISIYCMPPRPCFKGSAPINLSDRLNQVLRWALGSVEILLSRHCPIWYGYNGRLKLLERLAYINTIVYPITSIPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGXLMGRQNRTPTIVIVWSILLASIFSLLWVKIDPFISPTQKAVALGQCGVNC

SEQ ID NO: 3670 - protein, 1076 aa, Oryza sativa
MAANAGMVAGSRNRNEFVMIRPDGDAPPPAKPGKSVNGQVCQICGDTVGVSATGDVFVACNECAFPVCRPCYEYERKEGNQCCPQCKTRYKRHKGSPRVQGDEEEEDVDDLDNEFNYKHGNGKGPEWQIQRQGEDVDLSSSSRHEQHRIPRLTSGQQISGEIPDASPDRHSIRSGTSSYVDPSVPVPVRIVDPSKDLNSYGINSVDWQERVASWRNKQDKNMMQVANKYPEARGGDMEGTGSNGEDIQMVDDARLPLSRIVPIPSNQLNLYRIVIILRLIILMFFFQYRVTHPVRDAYGLWLVSVICEIWFALSWLLDQFPKWYPINRETYLDRLALRYDREGEPSQLAPIDVFVSTVDPLKEPPLITANTVLSILAVDYPVDKVSCYVSDDGSAMLTFEALSETAEFARKWVPFCKKHNIEPRAPEFYFAQKIDYLKDKIQPSFVKERRAMKREYEEFKVRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNNSKALREAMCFMMDPALGRKTCYVQFPQRFDGIDLHDRYANRNIVFFDINMKGLDGIQGPVYVGTGCCFNRQALYGYDPVLTEADLEPNIVVKSCCGGRKKKSKSYMDSKNRMMKRTESSAPIFNMEDIEEGIEGYEDERSVLMSQKRLEKRFGQSPIFIASTFMTQGGIPPSTNPASLLKEAIHVISCGYEDKTEWGKEIGWIYGSVTEDILTGFKMHARGWISIYCMPPRPCFKGSAPINLSDRLNQVLRWALGSVEILLSRHCPIWYGYNGRLKLLERLAYINTIVYPITSIPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAVALGQCGVNC

SEQ ID NO: 3671 - protein, 203 aa, Oryza sativa
MEECKGGGMSPSSSMDSSTHPALSTTSSAATARRDLSTDLRLGLSLSTSSSSSLLQAAAAAAAADDSIPSTPRNSQVHADWPPIKPFLRSALQKASAAGGGGARRRRTLFVKVYMEGVPIGRKLDLLLLDGYDSLLIKLCHMFKTPITYADVMECHQQVPGQKAAHVLTYKDQDGDWMMVGDVPWELFLSSVKKLRIARMDKC

SEQ ID NO: 3672 - protein, 480 aa, Oryza sativa
  unsure (1)..(480): unsure at all Xaa locations
SSAVADVLSCAYAVLLSSIGSGRSWSRGISIVRDVRDSFGSLSRRSFEVRISGLPGLSGHHRGKSLGSLSELRDRPVVVDQSRWVGLPPELLRDVMKRLEEGESNWPSRKDVVACAAVCRTWREICKDIVQSPEICGKLTFPVSLKQPGPRDGLIQCFIKRDKSKLTYYLYLCLSPAVLSENGKFLLAAKRNRRATSTEXYIISVDSKNISRSSNGYVGKMRSNFLGTKFVVYDTQPPYNAGSLMSCQHGSRRISSRRVSPKLPTGSYPIAHVKYELNVLGTRGPRRMLCTMHSIPASAVDPEGVVPGQPEQLLPGPFEESFRSTNTSSRFSFMDRSLDFSSSRFSEISGSANQQGEDDIPEAKERPLVLRNKVPRWHEQLQCLCLNFRGPVTLGXSVKNFQLIAAAAFXSSQLEQQQNHASSSFWHSXHGKVILQFGKVAXDMSPLDYRXPFLTFQGFAICLTAFXTKPAWEYIHQPFL

SEQ ID NO: 3673 - protein, 224 aa, Oryza sativa
  unsure (1)..(224): unsure at all Xaa locations
MAAAAGGGTREEMVYMAXXGGQAERYEEMVEFMEKVVTAAAAGGGGELTVEERNLLSVAYKNVIGARRASWRIVSSIEQKEEXRGAAGHVVXLKMKGDYHRYLAEFKTGAERKDAADATLAAYQAAQDIAMKELSPTHPIRLGLALNFSVFYYEILNSPDRACTLAKQAFDEAISELDTLGEESYKDSTLIMQLLRDNLTLWTSDMQDDGGDEMRDATKPEDEH

SEQ ID NO: 3674 - protein, 266 aa, Oryza sativa
  unsure (1)..(266): unsure at all Xaa locations
MAAAAGGGTREEMVYMAKLAEQAERYEEMVEFMEKVVTAAAAGGGGELTVEERNLLSVAYKNVIGARRASWRIVSSIEQKEEGRGAAGHAAAARSYRARVEAELSNICAGILRLLDERLVPAAAAVDAKVFYLKMKGDYHRYLAEFKTGAERKDAADATLAAYQAAQDIAMKELSPTHPIRLGLALNFSVFYXYEILNSPDGAWTVXAKQAFDEAISELDTLGEESYKDSTLIMQLLRDNLTLWTSDMQDDGGDEMRDATKPEDEH

SEQ ID NO: 3675 - protein, 132 aa, Oryza sativa
  unsure (1)..(132): unsure at all Xaa locations
XGKRXXGGLRKGSGXMRXKGQXGSDMARXEVLIHSIHHGGXXSPXGTKXSGGXXWKQRGXRVWRKSLSFWVHLXAKFPLVFIFFFIVLYAIPASAAVLLLNILITVLFALPSFLILYFAYPSLDWLVREIFA

SEQ ID NO: 3676 - protein, 256 aa, Oryza sativa
  unsure (1)..(256): unsure at all Xaa locations
PTSSAPPPTCTSPTTHPPPPPPPPTRSRLLPSTRPPPPPPPRRPTSSPPPPQEQGRRRHYRGVRQRPWGKWAAEIRDPKKAARVWLGTFDTAEDAAIAYDEAALRFKGTKAKLNFPEXFQGPASSSPVASPPPPPTVAATTPPPAAGACPPPRQQQTVVPYPDLMRYAQLLQGGVGGSYMPFGGAATMSSSTVSSSSAPQILDFSTQQLIRAGPPSPMPSSGSGSATAAASSTTSASSPGAWPYGGSERKKKDSSS

SEQ ID NO: 3677 - protein, 408 aa, Oryza sativa
MASMAARSSRKRRSPPPRGLGDLHDDVLERVLARLPPATFFRLRAVCRRWSAAAASPTFLRACARVPSRDPWFLMLSGARPRPPLAFDAAGRSWIPCRAAPGGSDGGADAAVPVASSGGLVLYRAPGTGELLVANPLTGASRALPSPPGAHGGAPRLHAIAMYGSPYRVALFADELPDLSMSVFDSSRGSWEGPVALSRRPDAAALLPDDAPSQGGADDTVYFLSKSGDVVATNMQRSASKQYSSVVVAASSDGGDAVAYFLSHSGTVVACDTARRTFAELPRILPVYFEYSIDVVACDGAAYAVVLAEYLDTASLRVWGFAGGAWRQVAAMPPAMSHAFHGKKADINCVGHGGRLMVCVSSGEANGCFMCDVGSNQWEELPKCVNGDGEVNDFLAAFSFEPRLEISV

SEQ ID NO: 3678 - protein, 425 aa, Oryza sativa
  unsure (1)..(425): unsure at all Xaa locations
MDSSSGGAGGGGGAQIKGMGTHGGRYVLYNVYGNFFEVSSKYAPPIRPIGRGAYGIVCAAVNSENGEEVAIKKIGNAFDNHIDAKRTLREIKLLRHMDHENIIAIKDIIRPPRRDNFNDVYIVSELMDTDLHQIIRSNQPLTDDHCQYFLYQLLRGLKYVHSANVLHRDLKPSNLFLNANCDLKIADFGLARTTTETDLMTEYVVTRWYRAPELLLNCSQYTAAIDVWSVGCILGEIVTRQPLFPGRDYIQQLKLITELIGSPDDSSLGFLRSDNARRYMKQLPQYPRQDFRLRFRNMSAGAVDLLEKMLVFDPSRRITVDEALHHPYLASLHDINEEPTCPAPFSFDFEQPSFTEEHIKELIWRESLAFNPDPPYXELRAIYQCWHLKIGSSRKAKSPCFVHLLILCPLVGRMSMDYCYSDNFS

SEQ ID NO: 3679 - protein, 209 aa, Oryza sativa
MGRGKIEIKRIENSTNRQVTFSKRRSGILKKAREISVLCDAEVGVVIFSSAGKLYDYCSPKTSLSRILEKYQTNSGKILWDEKHKSLSAEIDRIKKENDNMQIELRHLKGEDLNSLQPKELIMIEEALDNGIVNVNDKLMDHWERHVRTDKMLEDENKLLAFKLHQQDIALSGSMRDLELGYHPDRDFAAQMPITFRVQPSHPNLQENN

SEQ ID NO: 3680 - protein, 293 aa, Oryza sativa
  unsure (1)..(293): unsure at all Xaa locations
MFNHLELSDTLYNALSENSIYNYFNCVDKSALPDLLTNKAASEPQLDFSSVELLRQPIDVEQQIREKISQQTEDNAFFIVNLSDIIRKKKQWNNCLPRVEPFYAVKCNPDIEIIKCLAVMGVNFDCASRGEIDLVMSIGVTADRIIYANPCXPKAHLNYAREVGVNMSVFDGEAELYKIKECHPNLKVVMRIATDDRNSMCAFFVKFGARGNPSTAFLMVAKSLNPSXIGVAFHVGSGXCLDWDTYKSSFRRVSRFFQNGEELGLTMNLLGHLGGFPXDIVLFLEIISALIFS

SEQ ID NO: 3681 - protein, 146 aa, Oryza sativa
  unsure (1)..(146): unsure at all Xaa locations
LSKRRPVTPRALPLARADLTKPYQICAPPWTPPPAVAASXAIRLPYRHLRDAEMELXXASTAAPPAEAPPRTPTPRTSRGPPPPVPPPXRKLVLACMVAAGVQFGWALQLSLLTPYIQTFGNGNGSPIYAWLDAPFSVXLLTQPYX

SEQ ID NO: 3682 - protein, 354 aa, Oryza sativa
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQLSLSVLLFGVGVATVTDLQLNAVGSVLSSLAIITTCIAQIMTNTIQKKFKVSSTQLLYQSCPYQSLTLFLIGPFLDGFLTNQNVFAFDYTSQVVFFIVLSCLISVSVNFSTFLVIGKTSPVTYQVLGHLKTCLVLIFGYVLLHDPLSWRNILGILIAVVGMVLYSYFCTLEGQQKNAEVSPQQAKEGDSAPLISDSLSKVENGGGVVDDEPLKVPMWSSKYSRA

SEQ ID NO: 3683 - protein, 520 aa, Oryza sativa
MGNSLGCSASGERLVSAARDGDAVEARMLLELSPALARYSTFGGLNSPLHFAAAKGHLDIVTLLLEKGADVNVRNYCGQTALMHACRHGHWEVVQMLLLFRCNVTRADYLSGRTALHFAAHDGLVRCVRLLLADFVPSAPLEDGASSTVDGGECQTNSGSSPCSSLGLKFNESARLRYINKPADGGVTALHMAALNGHFDCMQLLIDLGANVSAVTFPYGTTANLIGAGSTPLHYAAGGGNAECCQLLLSKGASKLTLNCNGWLPIDVARMFGRRFLEPLLSPNSNSSIPAYQPSNYLALPFMSILNIAREFGLLHTVASVDDSDLCAVCLERSCSVAAEGCCHEFCIKCALYLCSTSNTRVEFTGPPGSIPCPLCRNGIMSFTKLPSTPTEGLKSSSALTFCNPCMLNTRSVDSPATISKAEIRRNRVAAVSSELVCPLTCSPFPSSALPTCRCSDDDPCDAIETQDGSEVQSPQPSHCASMEMDKREQQDLDRTSCSGMFWSRRSCHREEQCNAEINA

SEQ ID NO: 3684 - protein, 151 aa, Oryza sativa
  unsure (1)..(151): unsure at all Xaa locations
XSFXHHACLRFSMPNXNDVRDDAVRYHYDGTARPFFEGWNFKVSIPECRQSFCFMYFCLXNPLFRDGMSDLDRFIHGSRFTGVGAHILGAFDKYICQFTEKFNNFWGSRHELMLGNTFIPNNGSTPPEGEVPPRQXSFYTKEGLXYVAPYF

SEQ ID NO: 3685 - protein, 319 aa, Oryza sativa
  unsure (1)..(319): unsure at all Xaa locations
MEGAGAARKRSRPDTANGGAAGGKRSRETESFQTGLSSKLKPCTKFFSTIGCPFGEGCHFSHFVPGGYQAVAKTLNLGNPAVPAPARAPMDHAAGDSHPASSGKTRMCTKYNTAEGCKFGDKCHFAHGERELGKPAYMSHESAMAPPMGGRYGGRPEPPPPAAMGPPAGNFGASATAKISVDASLAGGIIGKGGVNTKQICRVTGVKLSIRDHESDSNLKNIELEGNFDQIKQASNMVGELIATISPSTPAKKPAGSAAGAAPAGRGGPGGRSNYKTKLCENFVKGTCTFGDRCHFAHGENEQRKGAAXEPKRILGAAH

SEQ ID NO: 3686 - protein, 428 aa, Oryza sativa
  unsure (1)..(428): unsure at all Xaa locations
XCRNSARGLHXPSLXTLTRELGSAQLTSHPDPNAPTSHNAAGSXPSSPSSPPQPPSPPPRXESPELLPFAVGAAPEGCDVGEGEWVFDEAARPWYAEEECPYIQPDLTCQAHGRPDAAYQRWRWQPRDCSLPSFNATGMLEMLRGKRMLFVGDSLLRGQYTSLLCLLHRGAPGGGGGSRSFETVDSLSIFRAKDYDATIEFYWAPMLAESNSDGAAVXXDDRLIRGAPMNKHSSFWKGADVLVFNSYLWWMTGDKIQILRGADEDMSKDIVEMEAAEAYRLVLHQVTRWLEGNVDPKSARVFFVTASPSHAGAGGECYDQTTPVGAADAASYCGSTSRRMVQVAGEVLXXASRVPVGVVNVTRMSELRRDAHTQVYREQRWAKPTAEQLAADPRSYADCTHWCLPGVPDAWNELLYWKLFFPARDEAI

SEQ ID NO: 3687 - protein, 741 aa, Oryza sativa
MALLARRARKAVMAKAPAPLLQKRGGGAAAELAIPAHFRCPISLDLMRDPVTAPTGITYDREGIEAWLDTGRAVCPVTHAPLRHEDLVPNHAIRRVIQDWCVANRSRGVERIPTPKIPVTPVQASELLFDVAAAARRGAAGRAAGAVARVRALARDSERNRRCFVSVGTGRVLAAAFESLAAAGEAGVLEDVLAALVCMMPLDEEAARVLASSSSMGSLVAIAKHGSLAGRLNAVLAIKEAVSRDGAFVEADDKVDKVVDALVVIIKAPICPQATKAAMVATYHLASSDERVAARVASTGLVPTLIEALVDADKSVSEKALAVLDAMLASKEGRASARGHALAMPALVKKMFRVSDVATELAVSAMWRLGCKASSGDAGCLVEALRVGAFQKLLLLLQVGCRDATKEKAPELLKMLNKHKGQPNRGAESGRPRVDRPSPFSHDAVAGHNRPPLAGIRISRGREGKGREGRKVRADMSAAPIPREWVGLQQFPAATQTKLHELLGKLKEENVSTLTILVMGKGGVGKSSTVNSIVGERVATVSAFQSEGLRPMMCSRTRAGFTLNIIDTPGLIEGGYINEQAVEIIKRFLLGKTIDVLLYVDRLDAYRMDTLDDQDFPLPIALVENSGRCKTNENGEKVLPDGTPWIPNLMKEITTVVSNGSKSIHVDQKLIDGPNPNNRWKMFIPLILMVEYFLVVKGIRRAIHADISNGKLDDWEQRYRDLVGSKDPVDQKGSSSGNRKA

SEQ ID NO: 3688 - protein, 233 aa, Oryza sativa
MVRGRTELKRIENPTSRQVTFSKRRNGLLKKAFELSVLCDAEVALIVFSPRGRLYEFASAPSLQKTIDRYKAYTKDHVNNKTIQQDIQQVKDDTLGLAKKLEALDESRRKILGENLEGCSIEELRGLEMKLEKSLHNIRLKKTELLERQIAKLKEKERTLLKDNENLRGKHRNLEAAALVANHMTTTTAPAAWPRDVPMTSSTAGAADAMDVETDLYIGLPGTERSSNRSETG

SEQ ID NO: 3689 - protein, 233 aa, Oryza sativa
MVRGRTELKRIENPTSRQVTFSKRRNGLLKKAFELSVLCDAEVALIVFSPRGRLYEFASAPSLQKTIDRYKAYTKDHVNNKTIQQDIQQVKDDTLGLAKKLEALDESRRKILGENLEGCSIEGLRARGMKLEKSLHNIRLKKTELLERQIAQLKEKERTLLKDNENLRGKHRNLEAAALVANHMTTTTAPAAWPRDVPMTSSTAGAADAMDVETDLYIGLPGTERSSNRSETG

SEQ ID NO: 3690 - protein, 581 aa, Oryza sativa
  unsure (1)..(581): unsure at all Xaa locations
MGEVAEDIYTQDGTVDVKGNPATKKNTGNWRACPYILANECCERLAYYGMSTNLVNYMKTRLGQESAIAANNVTNWSGTCYITPLLGAFLADAYMGRFWTIASFMIIYILGLALLTMASSVKGLVPACDGGACHPTEAQTGVVFLALYLIALGTGGIKPCVSSFGADQFDENDEGEKRSKSSFFNWFYFSINIGALVASSVLVYVQTHVGWGWGFGIPAVVMAVAVASFFVGTPLYRHQRPGGSPLTRIAQVLVASARKWGVEVPADGSRLHETLDRESGIEGSRKLEHTGQFACLDRAAVETPEDRSAANASAWRLCTVTQVEELKSVVRLLPIWASGIVFATVYGQMSTMFVLQGNTLDASMGPHFSIPAASLSIFDTLSVIVWVPVYDRLIVPAVRAVXTGRPRGFTQLQRMGIGLVISVFSMLAAGVLDVVRLRAIARHGLYGDKDVVPISIFWQVPQYFIIGAAEVFTFVGQLEFFYDQAPDAMRSMCSALSLTTVALGNYLSTLLVTIVTHVTTRNGAVGWIPDNLNRGHLDYFFWLLAVLSLINFGVYLVIASWYTYKKTADSPDDKAEHAGAN

SEQ ID NO: 3691 - protein, 570 aa, Oryza sativa
  unsure (1)..(570): unsure at all Xaa locations
MVLTTKFGKPRVIIGLESVSALASRNQPTRVIKSPAVGFLEDLVKEIDLFKEAYLEETEFKKDAAWQIFTLSTGGIWHLTLGCIGFRSLAKGRLVSTGLYCYFITSSSADCLYISRLLKPYRYRLVSASAIISYRLELLHRLISQSAVLSVVCISCQLQDQTDWHARISSRFGLAQELSRSPMPTNVYIEFKSTTELIRLTLQCDFNLVRTHQTNESTPPLSLLFLACSARGGGGGGGGAMARSVGGGWWRSRKTLVGLGLGQLVSLLVTATGFASSELSRRGINVPTSQSLLNYVLLGVVYGSILLYRRKXFAVVKAYQYTSLTSVMLLDCWAIPAVIFLTWMFLKTNYRFRKYSGVAICVSGLVLVVFSDVHAGDRAGGTSPVKGDILVIAGATLYAISNVSEEFLVKVGDRVELMGMLGLFGAIISAXVVPFIGFAVAMFMFYSLVPILLKQLNXAFAFQVDWMYYVAFGAVAIGLVIYSGDSNSDDGRRGQVAEATDVEGKLPDEEEAAVHPKCQGAASSGIRKFDDEHSGNKKENRTRRDFVNADNYVCVEGNGPYHALSNEELS

SEQ ID NO: 3692 - protein, 224 aa, Oryza sativa
MARSVGGGWWRSRKTLVGLGLGQLVSLLVTATGFASSELSRRGINVPTSQSLLNYVLLGVVYGSILLYRRKSLQVIGQTIYNYGGTSPVKGDILVIAGATLYAISNVSEIMARSSGSTMLNLSLLTSDMWAILIRLFAYHEKVDWMYYVAFGAVAIGLVIYSGDSNSDDGRRGQVAEATDVEGKLPDEEEAAVHPKCQGAASSGIRKFDDGNGPYHALSNEELS

SEQ ID NO: 3693 - protein, 124 aa, Oryza sativa
  unsure (1)..(124): unsure at all Xaa locations
XTLNLAETPFLLAAXSDWARPPVLEKRIKISGSTMLNLSLLASDMWAILIRVFAYHEKVDWMYYVAFGVVAIGLVIYSXXDSNSDDGRSGQVAEATDVEXXKLPDEEEAAVHPKCQGAASSFFR

SEQ ID NO: 3694 - protein, 329 aa, Oryza sativa
  unsure (1)..(329): unsure at all Xaa locations
MARSVGGGWWRSRKTLVGLGLGQLVSLLVTATGFASSELSRRGINVPTSQSLLNYVLLGVVYGSILLYRRKSLQMKWYYYLVLALVDVEANYLVVKAYQYTSLTSVMLLDCWAIPAVIFLTWMFLKTNYRFRKYSGVAICVSGLVLVVFSDVHAGDRAGGTSPVKGDILVIAGATLYAISNVSEEFLVKVGDRVELMGMLGLFGAIISACQMXNDPFXYYFLATSQVVPFIGFAVAMFMFYSLVPILLKISGSTMLNLSLLTSDMWAILIRLFAYHEKVDWMYYVAFGAVAIGLVIYSGYSRGQVAEATDVEGKLPDEEEAAVHPKCQG

SEQ ID NO: 3695 - protein, 339 aa, Oryza sativa
  unsure (1)..(339): unsure at all Xaa locations
GGRGGGGGEAKRSEIYTYEAGWHIYGMNWSVRRDKKYRLAIASLLEQHNNHVQVVQLDESSGDIAPVLTFDHPYPPTKTMFVPDPHSVRPDLLATSADHLRIWRIPSPDEAVELRXAALNGNRNSDYCGPLTSFDWNDADPRRIGTSSIDTTCTIWDVEREAVDTQLIAHDKEVYDIAWGGAGVFASVSADGSVRVFDLRDKEHSTIIYESAASPTPLVRLGWNKQDPRYMATIIMDSPKVVVLDIRYPTLPVVELHRHHSPVNAIAWAPHSSCHICTAGDDSQALIWDLSSMGTGTEGGLDPILAYTAGAEIEQLQWSATQPDWVAIAFSTKLQILRV

SEQ ID NO: 3696 - protein, 346 aa, Oryza sativa
  unsure (1)..(346): unsure at all Xaa locations
EQRNGGGRGGGGGEAKRSEIYTYEAGWHIYGMNWSVRRDKKYRLAIASLLEQHNNHVQVVQLDESSGDIAPVLTFDHPYPPTKTMFVPDPHSVRPDLLATSADHLRIWRIPSPDEAVELRCELNGNRNSDYCGPLTSFDWNDADPRRIGTSSIDTTCTIWDVEREAVDTQLIAHDKEVYDIAWGGAGVFASVSADGSVRVFDLRDKEHSTIIYESAASPTPLVRLGWNKQDPRYMAAVIMDSPEGLLRDCRLPSLPGAALHRPPFAPSTAFARAPVSSRPPCTAXGDDSLPLIWDXLSSMGTGTEVGLDPILAYTAGAEIEQLQWSATQPDWVAIAFSTKLQILRV

SEQ ID NO: 3697 - protein, 198 aa, Oryza sativa
  unsure (1)..(198): unsure at all Xaa locations
MPKHYRPAGKKKEGNAAKYITRTKAVKYLQISLATFRKLCILKGVFPRDPKKKVEGNHKTYYHMKDIAFLAHDPLIEKFREIKVHRKKVKKAFAKKNKDLADRLLNRPPTYKLDRLILERYPTFVDALRDLDDCLTMVHLFAALPAVEGERVQVQRIHNCRRLKFKXHFWDLYFKLYHSINVNYPPVLDPRLEALASX

SEQ ID NO: 3698 - protein, 183 aa, Oryza sativa
  unsure (1)..(183): unsure at all Xaa locations
MPKHYRPAGKKKEGNAAKYITRTKAVKYLQISLATFRKLCILKGVFPRDPKKKVEGNHKTYYHMKDIAFLAHDPLIEKFREIKVHRKKVKKAFAKKNKDLADRLLNRPPTYKLDRLILERYPTFVDALRDLDDCLTMVHLFAALPAVEGERVQVQRIHNCRRCVVPVHVFWKSPWKFRTCWTX

SEQ ID NO: 3699 - protein, 680 aa, Oryza sativa
MTEIYKLRENVLLNDRKSTPRYLQNSDTNSYYLCPTKINLELDLPYSSTMNIDKEEYVLSVKQTLTGRLPPPKSPVFTSSQSHAAAAAAAMPKHYRPAGKKKEGNAAKYITRTKAVKYLQISLATFRKLCILKGVFPRDPKKKVEGNHKTYYHMKDIAFLAHDPLIEKFREIKVHRKKVKKAFAKKNKDLADRLLNRPPTYKLDRLILERYPTFVDALRDLDDCLTMVHLFAALPAVEGERVQVQRIHNCRRLSHEWQAYISRTHSLRKTFISVKGIYYQAEVQGQKITWLTPHALQQVLTDDVDFNVMLTFLEFYETLLGFINFKLYHSINVNYPPVLDPRLEALASELYALCRYIPGNSEPAGLIEDKEGEDNKESSKTDESELRLAQLQHQLPTNEPGALMHLVQESTAADADDADAKECRSLFKNLKFYLSREVPRESLLFIIPAFGGTVSWEGEGAPFDETDEDITHQIVDRPTQSHVFLSREYVQPQWIYDCVNARIILPTEGYIVGRVPPPHLSPFVDNDAEGYIPEYAETIKRLQAAAQSQVLPLPSLGDEDMENSLVEAIIDRSESNEIADKKRKLEMLEKQYHDELRMEYEGKKPDVVDKSDTKEADDHMEDSHKQAEKDAADISKTLMSRKQRGLLQAIEINQERKKDKVNLLKKRKKNADSSASAKGR

SEQ ID NO: 3700 - protein, 217 aa, Oryza sativa
  unsure (1)..(217): unsure at all Xaa locations
NFVYIKHXVMTIGLNTWGLVLYNNLEAFMLFPLEMLLTGELNQMKGDNAKVTNWLSSDVILPVAXSCLFGLSISFFGFSCRRAISATGFTVLGIVNKLLTVVINLLIWDKHASFVGTIGLLICMSGGVLYQQSTXXKPKAPKAEPKEENDEEQQKLLEMQQGLESSSIRSKRHLKPGRKFGVDILLSTSRRLPCIILWDAKEESFGQRMFVRHARIL

SEQ ID NO: 3701 - protein, 189 aa, Oryza sativa
  unsure (1)..(189): unsure at all Xaa locations
NFVYIKHVVMTIGLNTWGLVLYNNLEAFMLFPLEMLLTGELNQMKGDNAKVTNWLSSDVILPVALSCLFGLSISFFGFSCRRAISATGFTVLGIVTKLLTVVINLLIWDKHASFVGTIGLLICMSGSVLYQQSTXXKPKAPKAEPKEENDEEQQKLLEMQQGHESSSIRSKHHLKPGRKFGIDILRQLP

SEQ ID NO: 3702 - protein, 358 aa, Oryza sativa
MEASTLSTYLPLLAMVLVQLGLAGLNVMSKLTMASGMSPYVLLAYRNFIAAAFLAPIAFLVERATLNQVLYFVGLKYSSPTVASALNNTLPAVTFLLAALLKMEPVAGRAGRAKVAGTALCVAGSMLMTFYRGPLVRTLASPVHWPYVQGTMAAEAAAHAGGHAVVLGAVLVIGSNVAWAIWFIIQKNLSKSFACPYTSTALMALIASVQCAAIAGAAERRFSAWELGLDIRLVGALYAGIVASGMVCTVMSWCIQERGPVFVSMFSPLMLIVVAVVGWGILGEKIHVGSVIGAVIIVVGLYTVLWGKGRDLDGAAVAIASLPGDEEMNGVVGADDTTGRAPPVGQTRHDSCQRKVAA

SEQ ID NO: 3703 - protein, 139 aa, Oryza sativa
  unsure (1)..(139): unsure at all Xaa locations
XKVEAPSTDTICPEGQEKLKLKSLFPISFTEENTDQKNKKSVEKSYMCPSCKSTLTNTMSLVTISTCGHVFCKKCSDKFLVTDKVCLVCNKPCKERNFVPLEKGGTGFAAHDERLEARDFKHLGSGSGLGLVKPAPKNY

SEQ ID NO: 3704 - protein, 578 aa, Oryza sativa
  unsure (1)..(578): unsure at all Xaa locations
KRRRGKEGEREREREERRGARCEGSRIERGNARERFLSPRDSILPVQRMYKMMYPSWNDISVXTYLSIGLLFATVIFASVTGVTIYYTVNQLNKNISLSLMKAIRARARKYKKLKDKVPASSHIWRKELGSRSKGLKCCVCLKSVSSPQYXXGGVIHQCDICGATAHPSCSGNAHKDCKCVSMVGFEHVIHQWAVQWIDTSDRSEEDSFCCYCDESCNGAFLAGSPIWYCMWCQRLVHVDCHNNLSIETGDICDLGPLKRLILSPLCVKELHWTGAAGLISSITHGANELASNVRERIRSRGKKYRKGTISVDSDSSGTIDPPSDIEGDSQETNNAAKRREDHANGELPEVHESSESENDKQLLXQKTQLAYRTANMRXSHVHNNQKYEIVDVPSDSRPLLVFINKRSGAQCGDSLRQRLQILLNPIQVFELGKQQGPEVGLTLFRKVPHFRVLVCGGDGTVAWVLDAIEKQKFEAPPPVAILPAGTGNDLARVLSWGGGLGIVEKQGGLFSVLKDVEHAAVTVLDRWKITIKDNQGKLMSQPKYMNNYFGVGCDAKVALDIHNLREENPERFYSQFX

SEQ ID NO: 3705 - protein, 185 aa, Oryza sativa
KNRKKKKSNKTEEGESLGRRSSSRSMEVGAKVPKKAGAGGRRGGGGPKKKPVSRSVKAGLQFPVGRIGRYLKQGRYSQRIGTGAPVYLAAVLEYLAAEVLELAGNAARDNKKNRIIPRHVLLAIRNDEELGKLLAGVTIAHGGVLPNINPVLLPKKTGSAAAKEAKEAKSPKKATTKSPKKAAAA

SEQ ID NO: 3706 - protein, 299 aa, Oryza sativa
  unsure (1)..(299): unsure at all Xaa locations
MGMEAECDRIKGPWSPEEDEALRRLVERHGARNWTAIGRGIPGRSGKSCRLRWCNQLSPQVERRPFTAEEDAAILRAHARLGNRWAAIARLLPGRTDNAVKNHWNSSLKRKLATATDGGEIDRPCKRVSPGPGSPTGSERSDSATAAAEAEAEVFRPVPRPXXASTPSARRTSCGRRGGGTTTTTTATTTRSPRCPSPSPSRGSTTTAXRSHFQELPSPSRSPSPPPSPPAASPSAYPFNADLVSAMQEMIRTEVRNYMAGVGLRAGCGPGAVAESFMPQLVDGVMRAAAERVGVVTRQ

SEQ ID NO: 3707 - protein, 200 aa, Oryza sativa
  unsure (1)..(200): unsure at all Xaa locations
MEVATNTATRSPVKLMLVLTLSPASKVIAKGGGGVKRVHLDGGAFQCRTCGRRFSTFQALGGHRTSHKRPRVRADGLDLLLXRAPRQARRRPSTPVVHRCDMCGKVFATGQALGGHMRRHRPLVSRNGTMSTTWTAAAAAAATMSGSSSEERDDDDDDDVHNYNFIHFLFCYVIIGGFHDMIVMIFVIISAVRRPCLSRF

SEQ ID NO: 3708 - protein, 384 aa, Oryza sativa
  unsure (1)..(384): unsure at all Xaa locations
MPVMAPTASLLLSPRPLPASRRVPSLPALSASGRLRLRRARADTRLRVAAPPSVPGEADQAPGETEPSTSSADEKFVWRDHWYPVSLVEDLDPSVPTPFQLLNRDLVIWKDPKSGEWVALDDRCPHRLAPLSEGRIDETGCLQCSYHGWSFDGSGACTRIPQAAPEGPEAKAVRSPKACAIKFPTLVSQGLLFVWPDENGLPKEFEDPAFSTVTIQRDLYYGYDTLMENVSDPSHIEFAHHKVTGRRDRARPLPFKMESSGAWGYSGSNSGNPRISATFVAPCYALNKIEIDTKLPIFGDQKWVIWICSFNIPMAPGKTRSIVCSARNFFQFSMPGKAWWQVSAIFVALSIYLLFNLLVSALFRKTAVKIPALLKIRVNFMLSX

SEQ ID NO: 3709 - protein, 550 aa, Oryza sativa
  unsure (1)..(550): unsure at all Xaa locations
PTRARFSPSIHGNLSERGRSNGLKSASLNCVGSPPRKNNNATQYRMFVATWNVGGRTPNKRLNLQDFLQVEESPDIYVLGFQEIVPLTAGNVLVLEDNEPAARWLALIHQALNMPQEPADGDEPSPSPSSSTTTSESSNGARTRRRDAVSRSASGNLFFHTPSLKMLSNSYRVDSALVKTCNCSPEHSSVRRRAAEVRESVYLADAPAPAGETAAPAADEDDAPTTEAQCEAGCGGGGGMSYCLIASKQMVGLFLSVWVRKELVEHVGHLRVDCVGRGIMGWLGNKGCIAISMTLHHTSLCFVCSHLASGEKEGDELRRNADVAEILKSAHFPRACRPAPAAARRVPERILDHDRMIWLGDLNYRMSLSYDETRTLLEDNDWDALLEKDQLLIEREAGRVFRGWNEGKICFAPTYKYTHNSDAYAGETAKSKKKRRTPAXCRCDRILWQGDGIEQLQYLRGESRFSDHRPVCGVFAVEVDGGDGDGGGAAGKIMKGYYSLNARIGGDRSQCHQGDVSXTDYIFHPLLQVCNDRVLCIRRFITKNRGYCRY

SEQ ID NO: 3710 - protein, 230 aa, Oryza sativa
  unsure (1)..(230): unsure at all Xaa locations
MAVLPESRRLSLLLMAACFLPLSAHAITRHYKFNVVMRNMTRLCSTKPILTVNGKFPGPTLYAREGDNVLVKVVNHVAHNVTIHWHGVRQIRTGWYDGPAYITQCPIQPGSSFLYNFTITGQRGTLLWHAHINWLRATVHGAIVILPKLGVPYPFPAPHKEAVIVLGEWWKEDTETVINQAMQLGVGPNISDSHTINGHPGPLSECASYGFKLSVENGKTYMLRIIPAAX

SEQ ID NO: 3711 - protein, 213 aa, Oryza sativa
  unsure (1)..(213): unsure at all Xaa locations
XSGSPGCRPXKYWMGFFLTLGAAALYGLILPLVELAYKHAAGGGRAVTYALVMEMQLVMGFFATAFCTVGVIVNKDFQAIPREAKQYELGEARYYVVLVFNAVLWEFFFVGAVGVIFCVHTLLAGIIIAVFIPITEVLGVIFLHEKFSSEKGVALVLSLWGLASYSYGEYADAKAKKKAALEAEEASXESVCIYCLLCFCCASGHGFISFYRP

SEQ ID NO: 3712 - protein, 614 aa, Oryza sativa
MAPAAVAAAEAGSKAAAVAGKAVAACERDAEKLEFIEEMTRGFDAVQERVLAAILARNNGAEYLRRHGMEGRTDREAFKARVPVVTYEDLRPEIERIANGDRSNIISSHPITEFLTSSGTSAGERKLMPTIEDELDRRQMLYSLLMPVMNLYVPGLDKGKGLYFLFIKSETKTPGGLPARPVLTSYYKSDHFKHRPFDPYNVYTSPTAAILCTDAFQSMYAQMLCGLVARAEVLRVGAVFASGLLRAIRFLQLHWRELAHDIRTGTLSAKVTEPSIRDAVAEVLAAPDAELAAFVEAECGKDKWEGIITRMWPNTKYLDVIVTGAMAQYIPTLKFYSGGLPMACTMYASSECYFGLNLRPMCDPSEVSYTIMPNMGYFELMPHDPDAPPLPRDAPPPRLVDLADAEVGREYELVITTYAGLCRYRVGDILQVTGFHNAAPQFRFVRRKNVLLSIDSDKTDEAELQAAVERASALLSPYGASIVEYTSQADATTIPGHYVVYWELMVREGGAWPPPAEEEGRGVFERCCLEMEEALNAVYRQGRNGEAIGPLEIRVVRAGTFEEVMDYAISRGASINQYKAPRCVSFGPIIELLNSRVISKHFSPACPKYSPHKK

SEQ ID NO: 3713 - protein, 274 aa, Oryza sativa
  unsure (1)..(274): unsure at all Xaa locations
RSIPYRWTLAGATALVTGGSKGIGHAIVEELAGFGARVHTCARNAAXXWRRAGGGGRSGGSXVTATVCDVSARGDRERLVAAAAAEFGGRLDILVNNVGRTMFRAAAACSGEDFPVLVATNLESCFHLSQLAHPLLLAAGGARGGGGGCVVNISSVAGSVGMPALAVYSMTKGGMNQLTRSLAAEWAGDGIRVNCVAPGGVKTDICQDETIXXPGADXXSEMDRLPMRRLAEPEKVAATVAFLCMPAASYITGQVVGVDGGRTISXLINQTNSS

SEQ ID NO: 3714 - protein, 343 aa, Oryza sativa
MTVEVEAVTMAKEEQPEEEEVIEKLVEKITGLAAAIGKLPSLSPSPEVNALFTELVMTCIPPSSVDVEQLGAEAQDMRGRLIRLCADAEGHLEAHYSDVLAAHDNPLDHLALFPYFNNYIQLAQLEYALLARHLPAAPPPSRLAFLGSGPLPLSSLVLAARHLPAASFHNYDICADANRRASRLVRADRDLSARMAFHTSDVAHVTTDLAAYDVVFLAALVGMAAEEKARMVEHLGKHMAPGAALVVRSAHGARGFLYPVVDPEEIRRGGFDVLAVHHPEGEVINSVIIARNRPWPAPALEGGDAHAHGHGAVVSRPCQRCEMEARAHQKMEDMSAMEKLPSS

SEQ ID NO: 3715 - protein, 487 aa, Oryza sativa
  unsure (1)..(487): unsure at all Xaa locations
MATSGGEDPSGSASSSASALDSLPFSSGNPRIEETRGVVLLHPEPPAASSSSLLPVSHPVGRKPRVCVPGVPNHLTYADFGRFCASWASHILETRIIRIDGVEDQYGVLIKFDTQSFTDSFYMSFNGNRFSSLEGNVCRVRFVEDVHYTQFXIEHAHSSVTSSAEPTXTCPSMVLXLDQDPGGXILTTVCTHSFHYSCMSKWADSSCPVCRXYCQQEPEKSSLFQCGTXRNLWXCVICGHVGCGRYKGGHAIEHWKETQHCYSLELETQKVWDYAGDNYVHRLIQSKTDGNLVEYNFYGDHSVDGMCSTCNGDAGISEALLDSKMEAIVEEYNDLVTSQLEKQRNYYESLLLEVKEDNEKEIAAATEKAVGIKVQKLQAKLDKCMEETGFLNDIHENLVKNMEMWRERIQKVKEREQAAIRLKDEKIEKLEEELRDLIAHFERQNTVAEASESMSSDINGSTILSVPSESSASSNSSIRNXDXDLLP

SEQ ID NO: 3716 - protein, 120 aa, Oryza sativa
  unsure (1)..(120): unsure at all Xaa locations
MSSSWLLTSPFTIDTVECKNLVPASVALXRKRRSPPTRGXGDLHDGVLERVLARLPPDTFFRLRAICCRWSAAAASPXTCGRIPSPTPTASPQXQLVQXAASPRPMLPALLVKRTWCWPX

SEQ ID NO: 3717 - protein, 132 aa, Oryza sativa
  unsure (1)..(132): unsure at all Xaa locations
PWLLRLQCRGGLAPLFCPLFSGFAFSAVHVFLCYLAEQAERYQEMVXFMENVANTTDVGELTAEERNPLSVAYKNVIGARRAFLRNIPFIEHNEESRGNEAYVASTXESPSRIETELNKICDGIPKPLXSHL

SEQ ID NO: 3718 - protein, 171 aa, Oryza sativa
  unsure (1)..(171): unsure at all Xaa locations
XFYSSYFSFMLQYVHHLQKKYSLGSFNLLGHTAPAQAASLLILGPFVDFWLTNRRVDTFNYTTIVTFFIVLSCTIAVGTNLSQFICIGRFTAVSFQVLGHMKTILVLTLGFLFFGKEGLNFHVVLGMMLAVIGMIWYGNASSKPGGKERQIYSVPSEKTQKSSQSELDQKV

SEQ ID NO: 3719 - protein, 230 aa, Oryza sativa
MVRGKTQMKRIENPTSRQVTFSKRRNGLLKKAFELSVLCDAEVALIVFSPRGKLYEFASASTQKTIERYRTYTKENIGNKTVQQDIEQVKADADGLAKKLEALETYKRKLLGEKLDECSIEELHSLEVKLERSLISIRGRKTKLLEEQVAKLREKEMKLRKDNEELREKCKNQPPLSAPLTVRAEDENPDRNINTTNDNMDVETELFIGLPGRSRSSGGAAEDSQAMPHS

SEQ ID NO: 3720 - protein, 440 aa, Oryza sativa
  unsure (1)..(440): unsure at all Xaa locations
MSFRSIVRDVRDGFGSLSRRGFEVRILGHRRGKSHGAVHELHDPVPVIQSSCWASLPPELLRDIIERLEESEATWPSRKHVVACAGVCRTWREMCKEIVKNPELCGKITFPISLRQPGPRDGTMQCFIRRDKSTQTYYLYLSLGSAVLVDNGKFLLSAKRNWHATCTEYVISMNANNLSRSTNTNIGKLRSNFLGTKFVIYDTHTPYNATSDSQSGKTSRRFSNKGTAKHPCSTYSIANISYELNVFGTRGPRRMCCLMHSIPASSLEAGGTVPSQPDSILAHSLNESSFRSVSFSKSSVMDHSMHFSSAQFSDISIGDCPRRGQVLSDDEECKETPLILQNKAPRWHEQLQCWCLNFRGRVTVASVKNFQLIAAXXQPAAGAPTPSQPVPPPPPEHDKVILQFGKVAKDMFTMDYHYPLSAFQAFAISLSSFDTKLACE

SEQ ID NO: 3721 - protein, 188 aa, Oryza sativa
  unsure (1)..(188): unsure at all Xaa locations
MEAAVGYAADSLIKATELRLGLPGTADDLPSTPRGKKRAAAAEDNNANAAAADDDEHDAVAPPCRAQVVGWPPVRSYRKSCFQQQSAAASKSNGSLVKVSMDGAPYLRKIDLRMYKGYRELREALEAMFVCFSGXXADGANPSEFAITYQDKDGDLMLVGDVPFDMFTSTCKKLRIMKRSEATGLGSP

SEQ ID NO: 3722 - protein, 219 aa, Oryza sativa
  unsure (1)..(219): unsure at all Xaa locations
MSVLMSNLELELLSRRAAIKLALLQTLPPHLITANASSSFLSIDRLSSSQPHRSSPASRRARSAPPXAEDNNANAAAADDDEHDAVAPVAKAQVVGWPPVRSYRKSCFQQQSAAASKSNGSLVKVSMDGAPYLRKIDLRMYKGYRELREALEAMFVCFSGXXADGANPSEFAITYQDKDGDLMLVGDVPFDMFTSTCKKLRIMKRSEATGLGSPRQMKI

SEQ ID NO: 3723 - protein, 327 aa, Oryza sativa
  unsure (1)..(327): unsure at all Xaa locations
MGECSEHRCWDELLPDALGLIFRKLSLKDVLTVVPRVCKSWGRVVAGPYCWQEIDIQEWSQQQSKPDQLKRMVRMLVARSGGSFHRISVSGLPGDPLFTLPRVRARSLKTMELPRSDISDSLVENVAPRWSNVTFLXDISSCTXKIGARALEAFGKHCKSLXRDFXRVMHPTDVVGRASQHDEARAIACNMPKLRHLEIGYMLIATKGLLRIASPCHDLNSLDLXRGCWNXXTINYWQENYPGLXKVVGPHVEXDWLXETPSWEECXPMNSEXSLLLGNLLGDDYYAGGSDDEGIWDDGQGLEGLEVRFYGGGFSESHAGFDWPPSP

SEQ ID NO: 3724 - protein, 383 aa, Oryza sativa
  unsure (1)..(383): unsure at all Xaa locations
XGRALLLSSPSQHPLLLPPPTCDLSRGRWVFDNTSLPAYREKECTFLTKQVSCLANGRPDDLWQYWRWQPNNCSLPTFDARRFMEKMRGKRMMFVGDSLNRNQWESLVCLVQPILSKGRKKIVKRGSFNIFYAKEYRATLEFYWAPFLVESNFDNPNFHXTIDQRIISPERIESHANNWKDVDYLIFNTYIWWMNNEDIKVSRRPNSTSWSDHDEVPRIETYGRVFKTWSTWLEQNVDPARTSVFFMTISPLHNSPAQWGNPNGIKCVKETLPVLNYTKPLDLNHDMRMYDLVAKVAKNMKNVPVSLIDITRMSDYRKDAHTSLYSIRQGKLLTPEQKADPQKYADCIHWCLPGVPDVWNQILYTRILSKSFPPSTHPSLPPQ

SEQ ID NO: 3725 - protein, 559 aa, Oryza sativa
  unsure (1)..(559): unsure at all Xaa locations
MTLSAMGAEAITRQYLFDVQTTSVTRLCSTKSIVTVNGQYPGPTLFAREGDHVEVTVVNHSPYNMSIHWHGIRQLLSGWADGPSYITQCPIQPGGSYVYRFTITGQRGTLWWHAHISWLRATVHGPMVILPPAGVGYPFPAPHEEVPIMFGEWWNNDTEAVISQALQTGGGPNISDAYTLNGLPGPLYNCSAQDTFKLKVKPGKTYMLRLINAALNDELFFSIANHTLTVVDVDALYVKPFTVDTLIIAPGQTSNVLLTAKPTYPGASYYMLARPYTTTQGTFDNTTVAGVLEYDDPCPTTAAGKIVPIFSPTLPQINDTNAVSNFTAKLRSLASAGYPAAVPQQVDHRFFFTVGLGTHPCAVNGTCQGPNGSRFAASINNVSFVLPATALLQSHFAGKSKGVYASNFPYYPLNPFNYTGTPPNNTNVMNGTKVLVLPYGANVELVMQDTSILGAESHPLHLHGFNFFVVGQGFGNFDPINDPAKFNLYDPVERNTVGVPAGGWVAIRFHADNPGMXVWFMHCHLEVHMSWGLKMAWLVLDGSRPDQKLPPPPLDLPKC

SEQ ID NO: 3726 - protein, 207 aa, Oryza sativa
  unsure (1)..(207): unsure at all Xaa locations
ASXVFVCXVTGXGGXCXGLLXAGVAVWSTALQLXVVHHLQKKXSLGSFNLLGHTAPAQAASLLXLGPFVAFWLPXXRVDAFNCAAVVTFFIXLSCPVAVGTYLCQFLCVGRFTAVSFRVLGHLKTILVLXLGFLFFGIVGLCFHVVLGLLLAVIGLFWCGNASFCPVVLGGSVFSVPCVLSPFSFRSYLCPKVLRLCCLPFFSGSFA

SEQ ID NO: 3727 - protein, 198 aa, Oryza sativa
RKRERAGAGAGAGDEIPIDPSIRRRRSLLSPPSPMPPRSLTLSRLPVAALGLPFSSCSPPPPRLRFPFAARRARSLATRASSSSPDSSFGSRMEDSVKRTLADNPVVIYSKSWCSYSMEVKALFKRIGVQPHVIELDQLGAQGPQLQKVLERLTGQSTVPNVFIGGKHIGGCTDTVKLHRKGELATMLSELDIDVNNS

SEQ ID NO: 3728 - protein, 455 aa, Oryza sativa
  unsure (1)..(455): unsure at all Xaa locations
MAGNDNWINSYLDAILDAGKAAIGGDRPSLLLRERGHFSPARYFVEEVITGYDETDLYKTWLRANAMRSPREEHAXLENMTWRIWNLARKKKEFEKEEACRLLKRQPEAEKLRTDTNADMSEDLFEGEKGEDAGDPSVALHGLVRGENMELGRDSDTGGQEKGENSGAYIIRIPFGPKDKYLAKEHLWPFIQEFVDGALGHIVRMSKTIGEEIGCGHPVWPAVIHGHYASAGIAAALLSGSLNIPMAFTGHFLEELSLDASEIVIASTRQEIEEQWNLYDGFEVILARKLRARVKRGANCYGRYMPRMVTLIMGNREAISKMNNMSAAVLTSVLTLIDEYDLYGQVAYPKHHKHSEVPDIYRLAARTKGAFVNVAYFEQFGVTLIEAAMNGLPIIATKNGAPVEINQVLNNGLLVDPHDQNAIADALTVILKGEQLAGRCKAGEHTGVRAWPTRQ

SEQ ID NO: 3729 - protein, 1013 aa, Oryza sativa
  unsure (1)..(1013): unsure at all Xaa locations
MLRHFSALAPSPLLFLLFLPFPWLRLHSSAHSSPPPRSRRDLHGGGGGMAGNDNWINSYLDAILDAGKAAIGGDRPSLLLRERGHFSPARYFVEEVITGYDETDLYKTWLRVXANAMRSPREEHAXLENMTWRIWNLARKKKEFEKEEACRLLKRQPEAEKLRTDTNADMSEDLFEGEKGEDAGDPSVAYGDSTTGSSPKTSSIDKLYIVLISLHGLVRGENMELGRDSDTGGQVKYVVELAKALSSSPGVYRVDLLTRQILAPNFDRSYGEPTEMLVSTSFKNSKQEKGENSGAYIIRIPFGPKDKYLAKEHLWPFIQEFVDGALGHIVRMSKTIGEEIGCGHPVWPAVIHGHYASAGIAAALLSGSLNIPMAFTGHFLGKDKLEGLLKQGRHSREQINMTYKIMCRIEAEELSLDASEIVIASTRQEIEEQWNLYDGFEVILARKLRARVKRGANCYGRYMPRMVIIPPGVEFGHIIHDFEMDGEEENPCPASEDPPIWSQIMRFFTNPRKPMILAVARPYPEKNITSLVKAFGECRPLRELANLTLIMGNREAISKMNNMSAAVLTSVLTLIDEYDLYGQVAYPKHHKHSEVPDIYRLAARTKGAFVNVAYFEQFGVTLIEAAMNGLPIIATKNGAPVEINQVLNNGLLVDPHDQNAIADALYKLLSDKQLWSRCRENGLKNIHQFSWPEHCKNYLSRILTLGPRSPAIGGKQEQKAPISGRKHIIVISVDSVNKEDLVRIIRNTIEVTRTEKMSGSTGFVLSTSLTISEIRSLLVSAGMLPTVFDAFICNSGSNIYYPLYSGDTPSSSQVTPAIDQNHQAHIEYRWGGEGLRKYLVKWATSVVERKGRIERQIIFEDPEHSSTYCLAFRVVNPNHLPPLKELRKLMRIQSLRCNALYNHSATRLSVVPIHASRSQALRYLCIRWGIELPNVAVLVGESGDSDYEELLGGLHRTVILKGEFNIPANRIHTVRRYPLQDVVALDSSNIIGIEGYSTDDMKSALQQIGVLTQ

SEQ ID NO: 3730 - protein, 230 aa, Oryza sativa
  unsure (1)..(230): unsure at all Xaa locations
XGSGLPSPALPRSPSSPAPRRRPASAVAAETPPPHARAEEEEEXPPRPWAAARRXRFEWLDQWYPVAPVCDLDPRKPHGKMVMGLRVVAWFDXRRRRQWRVVDDACPHRLAPLSEGRVDGKGRLQCAYHGWCFDGHGSCQFIPQAPALGPPVHKNSKACVASYPSVVQNNILWFYPRSEPEYKEILQRKRPPYFPDLDDPSFNTVFGVRDLFYGTDDLATSYGQKSSVPX

SEQ ID NO: 3731 - protein, 327 aa, Oryza sativa
  unsure (1)..(327): unsure at all Xaa locations
MAAAIDMYKYNTSTHQIASSDQELMKALEPFIRSASSSSASSPXATTTTLLLLPXAKILTCPPXSYPTSSITTAAATTTSSFSQLPPLMGLTHLGPAQIQQIQAQXXLAQQQQQRALAGAFLRPRGQPMKQSGSPPRAGPFAAVAGAAQSKLYRGVRQRHWGKWVAEIRLPKNRTRLWLGTFDTAEDAALAYDKAGXFRLRGDLARLNFPTLRRXRGAHARXXPLHASVDAKLTAICQSLATSSSKNTPAESAASAAEPESPKCSASTEGEXXSVSAGSPPPPTPLSPPVPEMEKLDFXXEAPWDESETFHLRKYPSWEIDWDSILS

SEQ ID NO: 3732 - protein, 405 aa, Oryza sativa
SSLRKGGRLPVYVAGVFFVIFVIIMYGEDIRSLTLDPIARAGTTPARIVEPPETCDLSKGEWVFDNTSYPLYREEQCEFLTSQVTCMRNGRRDDTYQKWRWQPKDCSMPRFDAKLFMERLRGKRFMFVGDSLNRNQWESMVCLVQSAMSPGKKYVTWEDQRVVFRVQEYNATVEFYWAPFLVESNSDDPKIHSIQHRIIKADAIAAHAQNWRGVDYLVFNTYIWWMNTLNMKIMYAKFTLHDIEHDEVVRIEAYRKVLTTWASWVNDNIDPARTSVFFMSISPLHISPEVWGNPGGIRCAKETMPLLNWHGPIWLGTDWDMFHAAANVSRTAATRVPITFVDVTTMSERRKDGHTSVHTIRQGKVLTPEQQADPGTYADCIHWCLPGVPDIWNLILYTRIMSRPQ

SEQ ID NO: 3733 - protein, 588 aa, Oryza sativa
  unsure (1)..(588): unsure at all Xaa locations
GASSGCRRHGQPAQVLAGGGRRRRRGVRPVRHETGRVVAXRKGGRLPVYVAGVFFVIFVIIMYGEDIRSLTLDPIARAGTTPARIVEPGXLREERHVARVNPPRREVSSAEKAAALPLDVDERPKLATPTPTEAAKEVPKVEKIXEAEETQDDEEEAEEAPETCDLSKGEWVFDNTSYPLYREEQCEFLTSQVTCMRNGRRDDTYQKWRWQPKDCSMPRFDAKLFMERLRGKRFMFVGDSLNRNQWESMVCLVQSAMSPGKKYVTWEDQRVVFHAVEYNATVEFYWAPFLVESNSDDPKIHSIQHRIIKADAIAAHAQNWRGVDYLVFNTYIWWMNTLNMKIMYAKFTLHDIEHDEVVRIEAYRKVLTTWASWVNDNIDPARTSVFFMSISPLHISPEVWGNPGGIRCAKETMPLLNWHGPIWLGTDWDMFHAAANVSRTAATRVPITFVDVTTMSERRKDGHTSVHTIRQGKVLTPEQQADPGTYADCIHWCLPGVPDIWNLILYTRIMSRPQLFPAFFCMRFVAVAKLAYPLCRGKMLLLRQGPLPESKVSPASEKKRRSPELEEKARSMNIEANPVSQNLQDLDM

SEQ ID NO: 3734 - protein, 103 aa, Oryza sativa; identical to SEQ ID NO: 683

SEQ ID NO: 3735 - protein, 407 aa, Oryza sativa
MDALCDFCREQRSMVYCRSDAASLCLSCDRNVHSANALSRRHTRTLLCDRCVGQPAAVRCLEENTSLCQNCDWNGHGAASSAAGHKRQTINCYSGCPSSAELSRIWSFSMDIPTVAAEPNCEEGINMMSINDNDVNNHCGAPEDGRLLDIASTALMSDLPTGDKFKPLIGSSSGDGMNLLPLNSDQPAEPVSTTPKAPCVTDKDMFNDGSVYGDFCVDDADLTFENYEELFGTSHVQTEQLFDDAGIDSYFEMKDVPADESNEQPKPVQPECSNVASVDSGMSNPAARADSSHCIPGRQAISNISLSFSGLTGESSAGYFQDCGVSSMILMGEPPWHPPGPESSSAGGSRDNALTRYKEKKKRRKFDKKIRYASRKARADVRKRVKGRFVKAGEAYDYDPLSQTRSY

SEQ ID NO: 3736 - protein, 444 aa, Oryza sativa
MAAAPSAGGVGEGSSSSAAAAAAAAAATIGPHVVDEEAMWQMNLGEAMEAGPYPERIGEPDCSYYMRTGLCRFGMTCKFNHPADRKMAVAAARMKGEYPQRIGQPECQYYLKTGTCKFGATCKFHHPREKAAIATRVQLNALGYPLRPNEKECAYYLRTGQCKFGSTCKFHHPQPSNTMVAVRGSVYSPGQSVTSPSQHTYPGAVTNWPLSRSASFIASPRWPGHSSYAQVIVPPGLVQVPGWNPYAAQIGSSSSDDQQRTAGGAQYYTGSRHSETPNMGDQGMFSSYQAGSVPLGLYTVQRESIFPERPDQPECQFYMKTGDCKFGAVCKFHHPKERIIPTPNCALSSLGLPLRPGEPICTFYSRYGICKFGPNCKFDHPMGTVMYGLATSPTGDVSARRMLAPVPAHSEVSPDNVSGRSRRITHSDSQQIPSGERGTEREAS

SEQ ID NO: 3737 - protein, 466 aa, Oryza sativa
MPPRWVLIQFGAFIVLCGATHLINLWTFTTHTKTVAMVMTVAKVSTAVVSCATALMLVHIIPDLLSVKTRELFLKNKAEQLDREMGLIRTQEETGRHVRMLTHEIRSTLDRHTILKTTLVELGGTLGLEECALWMPSRSGSSLQLSHTLRHQITVGSTVSINLPVVNQVFSSNRAIIIPHTSPLARIRPLAGRYVPPEVAAVRVPLLHLSNFQINDWPELSAKSYAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMSFIKPIAAIKRLSVSVMLAPDLPLCAIGDEKRLMQTILNISGNAVKFTKEGHITLVASVVKADSLREFRTPDFHPTASDDNFYLKVQ

SEQ ID NO: 3738 - protein, 636 aa, Oryza sativa; identical to SEQ ID NO: 903

SEQ ID NO: 3739 - protein, 661 aa, Oryza sativa
MAEHRGGRAFSNFFLADCRVGQKARNSARASEPKMTNTTPCNFFTDNECDSSDDVAVVVCVVNFFYAFSDCFLADNECDSGDDVAAVDSKPARTDATNRPKPPGIVQVSDSYLHKTVLNMSKTGIRYPNKLLLHLTKQPERRIQITIAELYCPSYYRMHAALLPTDNTVFSQDKMSPRCGASPEHRPEYTRTTYSTYGREAATMLWKRSTWSTADESAAANITKYHTKTKPNRRKRDTAVLGAKRERRLRRDTRAMEAAVDGRWTRVRTLGRGASGAVVSLAADDRSGALFAVKSAAAAAAAEQLVREGRILSGLRSPHVLPCLGFRAEAGGECQLFLEFAPGGSLADVVARSGGRLDECAIRAYAADVARGLAYLHGMSLVHGDVKGRNVVVGADGRAKIADFGCARTVGSDRPIGGTPAFMAPEVARGEEQEPAADVWALGCTVIEMATGRAPWSDMEDILSAVRRIGYTDAVPEVPEWLSAEAKDFLARCFARNPRERWTSSQLLEHPFLASAGCSVKTGEAAPQWVSPKSTLDVAFWESDTDDEEDDMPASPAERIKALACPCSALPDWDSDEGWIQVLNESSEACDTAVAKVEAEGKGRVLIEALETINESSGGDAECVDPEGTVRLITVASSSRKCSAWVSLMTHLYFLLIKALP

SEQ ID NO: 3740 - protein, 655 aa, Oryza sativa
  unsure (1)..(655): unsure at all Xaa locations
APRPYLLSPHHLQDISPPPPPPPPWSPASSQATASASPSPPPTTATTRPRRRTSSASGGAASPPPHSGSGSTSPRRPRSASPPRSRSAXSLPPLRAAAASAAAPEPVGSASPKFLGVETKTLKKIVPLGLMFFCILFNYTILRDTKDVLVVTAKGSSAEIIPFLKTWVNLPMAIGFMLLYTKLADVLSKEALFYTVIFPFIAFFGAFGYLLYPMRDAIHPTALADRLLAALGPSFLGPVAILRVWSFCLFYVMAELWGSVVISVLFWGFANQITTVEEAKEFYPLFGLGANVALIFSGRTVKYFSNMRQNLGPGVDGWAISLRGMMSIVVLLGLVIAGIYWGVNKFVIDKSAAPVVERKKKDKPKLSMGESLKVLVSSRYVRDLATLVVAYGISINLVEVTWKSKLKAQYPSPNEYSSFMGDFSTATGIATFTMMLLGRVILRKFGWGVAATITPAVLLLTGVGFFSLILFGEPLTPLMATLGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDSQFSPLAKQELEKEKMLKAKTXSKQLLKLLGQEMVLSKXTLASENSANGSAIKVSQEPESTTSEKSGQQSQ

SEQ ID NO: 3741 - protein, 223 aa, Oryza sativa
  unsure (1)..(223): unsure at all Xaa locations
XPRVRPRVRPRVRSQRLVTSRSRRPRRRRRXRKTAYRGIRRRPWGRWAAEIRDPRKGARVWLGTYATAEEAARAYDVVARDIRGAKAKLNFPPXHPPPPXPPPXPRSDAKPPPRRTTTTTTTSRRAQAPRRRRRCLPPRRRPXEHQLRECMSGLEAFLGLXXEEEDDGGAGEPWDAVDMMLEXARREWQRCHAHASKLIHACSSKIYNFSTTTMLITTYCVGK

SEQ ID NO: 3742 - protein, 239 aa, Oryza sativa
  unsure (1)..(239): unsure at all Xaa locations
AAASRRRRRRXASPAWPYMIERPELRWAFIRKVYAIVATQLVVTVAIAAAVYSVPAIRRFFLARTPAFAAFVLVIVAPLIVMLPTMFLRKKHPINLILLALFTICMSCAIGLGCLSSTGIAIIEAASLTFGLVFGLTLYTFWAAKRGHDFSFLRPFLVAAFLVLVLYGLIQMLVPTGKVATTVYGCVAALVFSGFIIYDTDNLIKRHAYDEYVTAAISLYLDTVNIFIAIFTALDASDS

SEQ ID NO: 3743 - protein, 207 aa, Oryza sativa
  unsure (1)..(207): unsure at all Xaa locations
XLNRSPHLKRLVMPAWNRITKFGICQAIQRWEELESLTMPTIGHPPYIMEEIARSCKNFAELKVMGSFDDLFASAIATHLPKLKVLSLRCSKVTMSALLWLLDNMANLEVLNISHCXLLFEIVANGRRQVIHELDDQTLQKASRLREFHHCQSRSCLACQRMMADEGIMRWYRYEDWFWRRDEVSSLDLQDYGKLFDAECEALTAVE

SEQ ID NO: 3744 - protein, 126 aa, Oryza sativa
MSAMETDINAPPPPAPAPAGAGEGSSSAAGPSSRKPNKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 3745 - protein, 168 aa, Oryza sativa
  unsure (1)..(168): unsure at all Xaa locations
XRRRGSQLMRGPVNDVKCMRYLLCERFGFPNDCVLILTDEEKDPCRLATKENIRMAMNWLVQGCSSGDSLVFHFSGIGVQVPDDDXDEVDVYDEAICPMDSFSQGPILDDEINEAIVRLLVHGAKLTLVVDAEHSSTVLDLPFLCCLSSRXXAGWQWEDPPPATGAYX

SEQ ID NO: 3746 - protein, 334 aa, Oryza sativa
  unsure (1)..(334): unsure at all Xaa locations
SKEQXNIAASKDTVGQYESHIAFTLPGLYRVVHGIDVFDPKFNIVSPGADMSVYFPYTEADKRLTAFHPEIEELLYSEVENDEHKCVLKDKNKPIIFSMARLDRVKNMTGLVEMYGKNAHLRDLANLVIVCGDHGNQSKDREEQAEFKKMYGLIDQYKLKGHIRWISAQMNRVRNGELYRYICDTKGVFVQPAFYEAFGLTVIEAMTCGLPTIATCHGGPAEIIVDGVSGLHIDPYHSDKAADILVNFFEKCKQDSTYWDNISQGGLQRIYEKYTWKLYSERLMTLTGVYGFWKYVSNLERRETRRYIEMFYALKYRSLASAVPLAVDGESTSK

SEQ ID NO: 3747 - protein, 593 aa, Oryza sativa
  unsure (1)..(593): unsure at all Xaa locations
GARASDVADQAAPACERDAEKLEFIEEMTRGFDAVQERVLAAILARNNGAEYLRRHGMEGRTDREAFKARVPVVTYEDLRPEIERIANGDRSNIISSHPITEFLTSSGTSAGERKLMPTIEDELDRRQMLYSLLMPVMNLYVPGLDKGKGLYFLFIKSETKTPGGLPARPVLTSYYKSDHFKHRPFDPYNVYTSPTAAILCTDAFQSMYAQMLCGLVARAEVLRVGAVFASGLLRAIRFLQLHWRELAHDIRTGTLSAKVTEPSIRDAVAEVLAAPDAELAAFVEAECGKDKWEGIITRMWPNTKYLDVIVTGAMAQYIPTLKFYSGGLPMACTMYASSECYFGLNLRPMCDPSEVSYTIMPNMGYFELMPHDPXXRLVDLADAEVGREYELVITTYAGLCRYRVGDILQVTGFHNAAPQFRFVRRKNVLLSIDSDKTDEAELQAAVERASALLSPYGASIVEYTSQADATTIPGHYVVYWELMVREGGAWPPPAEEEGRGVFERCCLEMEEALNAVYRQGRNGEAIGPLEIRVVRAGTFEEVMDYAISRGASINQYKAPRCVSFGPIIELLNSRVISKHFSPACPKYSPHKK

SEQ ID NO: 3748 - protein, 596 aa, Oryza sativa
  unsure (1)..(596): unsure at all Xaa locations
IYLFILRDATCCLSDLVRWFRLKWFFFXXQDANLYTGDGSVDIKGRPALKHATGNWRACFFILGDECCERLAYYGIAKNLVTYLKTNLHQGNLEAARNVTTWQGTCYLTPLIGALLADSYWGKYWTIAAFSAIYFIGLVALTLSASVPALQPPKCSGSICPEASLLQYGVFFSGLYMIALGTGGIKPCVSSFGADQFDDSDPADRVKKGSFFNWFYFCINIGAFVSGTVIVWIQDNSGWGIGFAIPTIFMALAIASFFVASNMYRFQKPGGSPLTRVCQVVVAAFRKWHTEVPHDTSLLYEVDGQTSAIEGSRKLEHTSELEFFDKAAIISSDDAKSDSFTNPWRLCTVTQVEELKILIRMFPIWATTIIFNPVYAHNSSMSIEQGMVLDNRVGSFIVPPASLSTFDVISVIIWIPFYGRVLVPIARKFTGREKGFSELQRIGIGLALSILAMLSAALVELRRLGIARSEGLIHEXDVAVPMSILWQIPQYFLVGAAEVFAAIGQVEFFYNEAPDAMRSLCSAFALVTVSLGSYLSSIILTLVSYFTTQGGDPGWIPDNLNEGHLDRFFSLIAGINFVNLLVFTGCAMRYRYKKAX

SEQ ID NO: 3749 - protein, 667 aa, Oryza sativa
QERRTIDLEEGWAFMQKGITKLKNILEGKPEPQFSSEDYMMLYTTIYNMCTQKPPHDYSQQLYDKYRESFEEYITSMVLPSLRDKHDEFMLRELVKRWSNHKIMVRWLSRFFFYLDRYFISRRSLIPLEQVGLTCFRDLIDKEREGEQIDRALLKNVLGIFAEECLKKEKERVGHYLHISSEQKLLEKVQNELLAQYATPLLEKEHSGCFALLRDDKVEDLSRMYRLFSKINRGLEPIANMFKTHVTNEGTALVKQAEDSASNKKVFVWKIIELHDKYVAYVTECFQGHTLFHKALKEAFEVFCNKGVSGSSSAELLATFCDNILKKGCSEKLSDEAIEDALEKVVRLLAYISDKDLFAEFYRKKLARRLLFDKSANDEHERSILTKLKQQCGGQFTSKMEGMVTDLTVARDHQTKFEEFVAAHQELNPGIDLAVTVLTTGFWPSYKTFDINLPAEMVKCVEVFKEFYQTRTKHRKLTWIYSLGTCNINAKFEAKTIELIVTTYQAALLLLFNGSDRLTYSEIVTQLNLSDDDVVRLLHSLSCAKYKILNKEPANRSISPNDVFEFNSKFTDRMRRIKIPLPPVDEKKKVVEDVDKDRRYAIDASIVRIMKSRKVMGHQQLVAECVEQLSRMFKPDFKAIKKRIEDLITRDYLEREKDNANVYRYLA

SEQ ID NO: 3750 - protein, 705 aa, Oryza sativa
MAGQERRTIDLEEGWAFMQKGITKLKNILEGKPEPQFSSEDYMMLYTTIYNMCTQKPPHDYSQQLYDKYRESFEEYITSMVLPSLRDKHDEFMLRELVKRWSNHKIMVRWLSRFFFYLDRYFISRRSLIPLEQVGLTCFRDLIYQEIKGQVKGAVIALIDKEREGEQIDRALLKNVLGIFVEIGLGSMECYENDFEDFLLKDTTDYYSLKAQSWILEDSCPDYMIKAEECLKKEKERVGHYLHISSEQKLLEKVQNELLAQYATPLLEKEHSGCFALLRDDKHVTNEGTALVKQAEDSASNKKVFVWKIIELHDKYVAYVTECFQGHTLFHKALKEAFEVFCNKGVSGSSSAELLATFCDNILKKGCSEKLSDEAIEDALEKVVRLLAYISDKDLFAEFYRKKLARRLLFDKSANDEHERSILTKLKQQCGGQFTSKMEGMVTDLTVARDHQTKFEEFVAAHQELNPGIDLAVTVLTTGFWPSYKTFDINLPAEMVKCVEVFKEFYQTRTKHRKLTWIYSLGTCNINAKFEAKTIELIVTTYQAALLLLFNGSDRLTYSEIVTQLNLSDDDVVRLLHSLSCAKYKILNKEPANRSISPNDVFEFNSKFTDRMRRIKIPLPPVDEKKKVVEDVDKDRRYAIDASIVRIMKSRKVMGHQQLVAECVEQLSRMFKPDFKAIKKRIEDLITRDYLEREKDNANVYRYLA

SEQ ID NO: 3751 - protein, 618 aa, Oryza sativa
MAGQERRTIDLEEGWAFMQKGITKLKNILEGKPEPQFSSEDYMMLYTTIYNMCTQKPPHDYSQQLYDKYRESFEEYITSMIDKEREGEQIDRALLKNVLGIFVEIGLGSMECYENDFEDFLLKDTTDYYSLKAQSWILEDSCPDYMIKAEECLKKEKERVGHYLHISSEQKLLEKVQNELLAQYATPLLEKEHSGCFALLRDDKEEDLSRMYRLFSKINRGLEPIANMFKTHVTNEGTALVKQAEDSASNKKPEKKDMVGMQEQVFVWKIIELHDKYVAYVTECFQGHTLFHKALKEAFEVFCNKGVSGSSSAELLATFCDNILKKGCSEKLSDEAIEDALEKVVRLLAYISDKDLFAEFYRKKLARRLLFDKSANDEHERSILTKLKQQCGGQFTSKMEGMVTDLTVARDHQTKFEEFVAAHQELNPGIDLAVTVLTTGFWPSYKTFDINLPAEMAALLLLFNGSDRLTYSEIVTQLNLSDDDVVRLLHSLSCAKYKILNKEPANRSISPNDVFEFNSKFTDRMRRIKIPLPPVDEKKKVVEDVDKDRRYAIDASIVRIMKSRKVMGHQQLVAECVEQLSRMFKPDFKAIKKRIEDLITRDYLEREKDNANVYRYLA

SEQ ID NO: 3752 - protein, 285 aa, Oryza sativa
  unsure (1)..(285): unsure at all Xaa locations
MAGQERRTIDLEEGWAFMQKGITKLKNILEGKPEPQFSSEDYMMLYTTIYNMCTQKPPHDYSQQLYDKYRESFEEYITSMVLPSLRDKHDEFMLRELVKRWSNHKIMVRWLSRFFFYLDRYFISRRSLIPLPRVRLTCFRDLIYQEIKGQVKGAVIALIDKEREGEQIDRALLKNVLGIFVEIGLGSMECYENDFEDFLLKXSWFYDXRKXQSXXXEDAXPADGRKAEEXXKKEKERXXHNKQKXREQXGREKGQKEGRAQXATPRGEKEXXGGXAXXREDKEED

SEQ ID NO: 3753 - protein, 294 aa, Oryza sativa
MVNWFLPDTCLVRVATVGQPGAMRRITVHYVNLLPVAGAGEAHVDGAANYSGKQRSSVMELIHRWSMDINAWEAKERLDQKLRNQMEAVIKRHHSTGSIKLNRASSGGGRSTVTAAMGVQRAVYSKKGVMRRLMRWSRLRSGRREGGGQRGRRRQRRRGAAGGVSPRPLPPRSGRRREGGAARATATTTAATAHVIWPEEGGGRPTAARTAWSSGGDDDDGGSGGDGGDDDGGGDGGDDDGGGGSPPLPSQIRPGEGGGGEARGGGDGPLPRLRKLSIFTVVVLQADLPPACEN

SEQ ID NO: 3754 - protein, 246 aa, Oryza sativa
MRPKEEQADLSGSRHRQPDHATLPVASAHTTRAHRALPVAPAMLEALLVRGAQKLETHELTQLDDGTRGGGGRGAGVVACRRRSPLPWSDTGVEKVNWFLPDTCLVRVATVGQPGAMRRITVHYVNLLPVAGAGEAHVDGAANYSGKQRSSVMELIHRWSMDINAWEAKERLDQKLRNQMEAVIKRHHSTGSIKLNRASSGGGRSTVTAAMGVQRAVYSKKGVMRRLMRWSRLRWDAAEQAECTCA

SEQ ID NO: 3755 - protein, 129 aa, Oryza sativa
  unsure (1)..(129): unsure at all Xaa locations
XAAALRFDLQSGHTKCISDDIKVGAMAVGKYHVVVPEGGPLLPESHRVSLRVTSPHGHSLHYSENVQSGNFAFTASEAGDYLACFWAPDHRPTATVGFEFDWRSGVSARDWTNVAKKGQVDVMELHASX

SEQ ID NO: 3756 - protein, 187 aa, Oryza sativa
  unsure (1)..(187): unsure at all Xaa locations
MADGPGSPGGGGGSHESGSPRGGGGGGGGGGGGGPRVRQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSNXR

SEQ ID NO: 3757 - protein, 221 aa, Oryza sativa
PHPPPSPTVQSCRRRRPPPPPPRPVASSATTILRLPRGLLPPPPPPPASSSPRARGASSGHSESTTRPLGLPPTAARAQSAAAAGYQPESEFYKVEAILRPWRVPYVSSGLLQMGIRGVTVSDVRGFGAQGGSTERHEGSEFAEDTFIDKVKMEIVVSKDQVEAVVDKIIEKARTGEIGEGKIFLIPVSDVIRIRTGERGERAERMAGGLADKLSSAMPIS

SEQ ID NO: 3758 - protein, 415 aa, Oryza sativa
  unsure (1)..(415): unsure at all Xaa locations
MEPKNAIALDEHVLDSTIRKRKRVGATQCAEANDAPNLSQNGPKQNLALFPDSTGHKKSKMMCSADDILERYNNFKISGMPVRVMSHQHGGWRDFPEDVVNSVQQSFQLKRPITSAVFQNRHILLDFMQMVCLDSVMAISKPIAWIDDHXXLSDVQEVNNVVEDXXQKVLNESGEVSGENKKGHLSHMNEXLLMGPCKLLXNNQSVQRADSAVRNLLFQGSGHLFTEKDIIGIYRTPMLDQLGRSRYSLFQKEVQVTKNQRGNANERYAWLACTKGTMEEMMMNGALEIAKPLQGPMYGVGAHLAPANSSNICVGLSDIDENGIIRMMLCRVIMGNVEVVFPGSNQCQPTSESFDSGVDDLQRPKHYIIWDANVHKHIYAEYAVIIKVPYMNKDTASNISEIRNSGALDNPTKAX

SEQ ID NO: 3759 - protein, 585 aa, Oryza sativa
  unsure (1)..(585): unsure at all Xaa locations
MEPKNAIALDEHVLDSTIRKRKRVGATQCAEANDAPNLSQNGPKQNLALFPDSTGHKKSKMMCSADDILERYNNFKISGMPVRVMSHQHGGWRDFPEDVVNSVQQSFQLKRPITSAVFQNRHILLDFMQMVCLDSVMAISKPIAWIDDHGKCFSPXFMCWSNTIXXPLQHGKNEFLKSFHDLSSSYEAHEHDGTAAESSSSASFDAVLSDVQEVNNVVEDKQKVLNESGEVSGENKKGHLSHIETADGAMQAPRNNQSVQRADSAVRNLLFQGSGHLFTEKDIIGIYRTPMLDQLGRSRYSLFQKEVQVTKNQRGNANERYAWLACTKGTMEEMMMNGALEIAKPLQGPMYGVGAHLAPANSSNICVGLSDIDENGIIRMMLCRVIMGNVEVVFPGSNQCQPTSESFDSGVDDLQRPKHYIIWDANVHKHIYAEYAVIIKVPYMNNGDTASNISEIXXNSGALDNPTKDDSLQTIASSGDEQQACMLGRAPSPRSPSSPWMPFSMLFAAISAKVPRSDMDLVHKYYEEFKRRKISRPDLVKQLRQIVGDKLLVSTVVRLQQKXXKLPRSREAYHKGLRQGVLFVL

SEQ ID NO: 3760 - protein, 155 aa, Oryza sativa
  unsure (1)..(155): unsure at all Xaa locations
VFGGRRGDGGRGAHESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREVIGDSKLSSKAGDGSVKKDTMPVYSEQFSHIGSSXQSFA

SEQ ID NO: 3761 - protein, 205 aa, Oryza sativa
  unsure (1)..(205): unsure at all Xaa locations
SSPHHAFPPLSPLLSATPSTPARARFFFFVRVFGGRRGDGGRGAHESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMXXGAYTQGMGYMQPQYHNGDTXR

SEQ ID NO: 3762 - protein, 137 aa, Oryza sativa
  unsure (1)..(137): unsure at all Xaa locations
XSNMVAFIEAIVDRHSCFRYLRDNGIGVLLPPNYKVVPLEVDKGRVLLESSRVALLGYGXSVQYCLATASLVDXEHGLKVSVMTXWFCKQLDHTLISRLASSLXVLLTVEXGSIGGLGSHVVQFLALDVLLVGKLKX

SEQ ID NO: 3763 - protein, 183 aa, Oryza sativa
  unsure (1)..(183): unsure at all Xaa locations
MGGCCCCSSRGSETDRAPVHIYRQQNQEEHEPLSSAYDGSSPASAIVAVDTNLDTSTPDTYRAPPAPLPYDVSLPVPENPDLEKSDLKSKTDEQEESLEVDEFKSCEKCVAEDKPDEEDVCPICLEEYDAENPRSLTKCEHHFHLCCILEWMERSDTCPVCDQITLIDDMYEXHWSMGLLCLV

SEQ ID NO: 3764 - protein, 467 aa, Oryza sativa
MAPEVWMDCLLWARWSYWSGCMWQMPPGDEHGDRGSDHCEDRAHAVRPRVRPRVEPIEGKKKRKRKEKKEEEERTRTLAYHFAPLRKQSTTASAARAHRRRAMCGGAIIHHLKGHPEGSRRATEGLLWPEKKKPRWGGGGRRHFGGFVEEDDEDFEADFEEFEVDSGDSDLELGEEDDDDVVEIKPAAFKRALSRDNLSTITTAGFDGPAAKSAQRKRKNQFRGIRHRPWGKWAAEIRDPRKGVRVWLGTFNSAEEAARAYDAEARTIRGKKPKVNFPEAPTTAQKRRAGSTTAKAPKSSVEQKPTVKPAFNNCANAMAFVYPSANFTSNKPFVQPDNMPFVPAMNSAAPIEDPIINSEQGSNSFGCSDFGWENDTKTPDITSIAPISTIAEVDESAFIKSSTNPMVPPVMENSGVDLPDLEPNMRFLLDDGGGDSIDSLFNLDGSQDVVSNMDLWSFDDMPVSDFY

SEQ ID NO: 3765 - protein, 260 aa, Oryza sativa
MASDGSASPASCGGAACGVCGGAATVYCAADAAALCVPCDAAVHAANPLASRHDRVPLAVAMAAASSGVYDHLFAPDDDAASSWAAAAAAGAAVQGQGQGSPNDSSSSFTNDSAGGGGGGAERSLFDLLSDVDIMSCGGGGLASSFDGAAAPLGLAPRPARRVDAVKTIRYASRKAYAEARPRIKGRFVKRATTAAASSSSDDDSTAAAGVSGAGGAGAAATKEAKFWLSFSDDGRADGVGFYMDSTTAATAAYGVVPTF

SEQ ID NO: 3766 - protein, 303 aa, Oryza sativa
MMASDGSASPASCGGAACGVCGGAATVYCAADAAALCVPCDAAVHAANPLASRHDRVPLAVAMAAASSGVYDHLFAPDDDAASSWAAAAAAGAAVQGQGQGSPNDSSSSFTNDSAGGGGGGGAERSLFDLLSDVDIMSCGGGGLASSFDGAAAPPLWLHPGQLAALTPWSPADSVVVPTSAAGAVAAAAAAREERVRRYREKRKNRKFQKTIRYASRKAYAEARPRIKGRFVKRATTAAASSSSDDDSTAAAGVSGAGGAGAAATKEAKFWLSFSDDGRADGVGFYMDSTTAATAAYGVVPTF

SEQ ID NO: 3767 - protein, 324 aa, Oryza sativa
MESGSYEGVLLGMGNPLLDISAVVDEAFLAKYNELASKVNVEYIAGGSTQNSIRVAQWMLQIPGATSYMGCIGKDKFGEEMKKDAQTAGAHYYEDDNAPTGTCAVCIVGGERSLVANLSAANCYRSEHLKRPENWTLVEKAKYIYIAGFFLTVSPDSIQLVAEHAAATNKVFMMNLSAPFICEFFRDAQEKALPYADYIFGNETEARTFAKVRGWETENTEEIALKISQLPKASGAHKRITVITQGCDPVVVADDGKVKTFPVIVLPKEKLVDTNGAGDAFVGGFLSQLVQEKSIDECVRAACYAANVIIQRSGCTYPEKPDFN

SEQ ID NO: 3768 - protein, 294 aa, Oryza sativa
  unsure (1)..(294): unsure at all Xaa locations
MDGRMESGSYEGVLLGMGNPLLDISAVVDEAFLAKYDIKPGNAILAEEKHLPMYNELASKVNVEYIAGGSTQNSIRVAQAHYYEDDNAPTGTCAVCIVGGERSLIXXVEKAKYIYIAGFFLTVSPDSIQLVAEHAAATNKVFMMNLSAPFICEFFRDAQEKALPYADYIFGNETEARTFAKVRGWETENTEEIALKISQLPKASGAHKRITVITQGCDPVVVADDGKVKTFPVIVLPKEKLVDTNGAGDAFVGGFLSQLVQEKSIDECVRAACYAANVIIQRSGCTYPEKPDFN

SEQ ID NO: 3769 - protein, 344 aa, Oryza sativa
MESGSYEGVLLGMGNPLLDISAVVDEAFLAKYDIKPGNAILAEEKHLPMYNELASKVNVEYIAGGSTQNSIRVAQWMLQIPGATSYMGCIGKDKFGEEMKKDAQTAGVNAHYYEDDNAPTGTCAVCIVGGERSLVANLSAANCYRSEHLKRPENWTLVEKAKYIYIAGFFLTVSPDSIQLVAEHAAATNKVFMMNLSAPFICEFFRDAQEKALPYADYIFGNETEARTFAKVRGWETENTEEIALKISQLPKASGAHKRITVITQGCDPVVVADDGKVKTFPVIVLPKEKLVDTNGAGDAFVGGFLSQLVQEKSIDECVRAACYAANVIIQRSGCTYPEKPDFN

SEQ ID NO: 3770 - protein, 223 aa, Oryza sativa
  unsure (1)..(223): unsure at all Xaa locations
MNLDELLKSVFPDGAEGLQRQGSITMPPELSKKTVDEVWKGIQDVPKRGAEEGGRWRRERQPTLGEMTLEDFLVKAGVVXGSERFARKHGLXLNAGAQWLQQYXXQQALEPQHPSIGAPYMITSPVLGALSDPQTPGRKRGATGEIADKLVERRQKRMIKNRESAARSRARKQAYTNELENKVLRLEEENERLKKQKELDEILNAAPPPEPKYQLRRTSSAAF

SEQ ID NO: 3771 - protein, 380 aa, Oryza sativa
MGRESLPTLAMVMVQLGFAGMNVVSKLALDTGMSPYVLIAYRNIIAAVFLAPFAYYFERYTKSGMVITKKVLVQIFFSSIFGATLNQVLYFVGLKSTTPTVACALSNTLPALTFAMAAAFRMESVRLSAAAGQAKVFGTVVCVGGSMIMPFYKGPLLRLWASPIHWRFAESAASGAAAPAAGGAAVLGDVLIILSCAAWAVWFIIQTKMSERFSAPYTSTTIMCLMAGVQCAGVSAAMDRSVAVWKLGFDIRLYSVLYIGVVGSGIAFALMSWCIQVRGPLFVSMFSPLMLVVVAIVGWAILDEKIHVGSAIGSVLIVAGLYMVLWGKAREMGSPSDLDGGGGGGGVVELNGKGADAATTLPVFCTTTNKHETTRNGCSN

SEQ ID NO: 3772 - protein, 175 aa, Oryza sativa; identical to SEQ ID NO: 3461
  unsure (1)..(175): unsure at all Xaa locations

SEQ ID NO: 3773 - protein, 338 aa, Oryza sativa
  unsure (1)..(338): unsure at all Xaa locations
XETPPPPPPEGGEERWARLLPELMSEVVRRVEASGGERWPARKDVVSCACVCRRWRDAAVAVVRPPAESGKITFPSSLKQPGPREFPMQCFIKRNKKNSTFYLYLGLTNATVDKGKFLMAARRFRRGPHTEYIVSLDADDLSQGSNAYMGKLRSDFWGTNFKIYDSKPPYDGAKASSSRSSRRFGSRRISPQVSAGNYEVGQVSYKYNLLKSRGPRRMYCALECPSTQETWENCLKTKFRKPTGNTVLRNKAPRWHEHLQCWCLNFHGRVTVASVKNFQLVAAADPNDPASSKDEETVLLQFGKVDDNIFTMDYRQPLSAFQAFAISLSSFGTKLACE

SEQ ID NO: 3774 - protein, 406 aa, Oryza sativa; identical to SEQ ID NO: 720

SEQ ID NO: 3775 - protein, 339 aa, Oryza sativa
  unsure (1)..(339): unsure at all Xaa locations
MEAQNQEVAALVEKIAGLHAAISKLPSLSPSAEVDALFTDLVTACVPASPVDVAKLGPEAQAMREELIRLCSAAEGHLEAHYADMLAAFDNPLDHLARFPYYGNYVNLSKLEYDLLVRYVPGIAPTRVAFVGSGPLPFSSLVLAAHHLPDAVFDNYDRCGAANERARRLFRGADEGLGARMAFHTADVATLTGELGAYDVVFLAALVGMAAEEKAGVIAHLGAHMADGAALVVRRHGARGFLYPIVDLEDIRRGGFDVLAVYHPDDEVINSVIVARKADPRRGGGLAGARGAVPVVSPPCKCCKMEASAXXQKAEEFAANKEPIRLTAGRSKGARILWQ

SEQ ID NO: 3776 - protein, 552 aa, Oryza sativa
  unsure (1)..(552): unsure at all Xaa locations
HSAMVCVTTLKKMSRAXAPPRKRHGFPSPALPRSPSSPAPRRRPASAVAAETPPPHARAEEEEEXPPRPWAAARRXRFEWLDQWYPVAPVCDLDPRKPHGKMVMGLRVVAWFDXRRRRQWRVVDDACPHRLAPLSEGRVDGKGRLQCAYHGWCFDGHGSCQFIPQAPALGPPVKQIKTKFKXKQQHFLKINRVLGSINXQVHKNSKACVASYPSVVQNNILWFYPRSEPEYKEILQRKRPPYFPDLDDPSFNTVFGVRDLFYGYRTTTDSVQLFIXLSTVESDQEGGYPVKIRTEQAKIDGFLSVQEDGYMKFDAPCXRSMASPFAPKNHRYLPPSGKEKKKKKQPEAMTVFLCVPVAPGRSRLIWAFPRNVDAWLDNIIPRWLYHIVTNIVLDSDSYLLHIEERNFATVGLDNWHKACYVPTSSDNMVITFRNWFRKYCKHQIGWATPMXXNQLPPTPTKDQVLERYRSHVMQCTSCSAALKKMKALEVALQVASVAIVGFLAVAKGSLAPSVVRRAAAVSTAVLCFAASRWLASFIEKSFYFQDYVHAYK

SEQ ID NO: 3777 - protein, 533 aa, Oryza sativa
  unsure (1)..(533): unsure at all Xaa locations
XGSGLPSPALPRSPSSPAPRRRPASAVAAETPPPHARAEEEEEXPPRPWAAARRXRFEWLDQWYPVAPVCDLDPRKPHGKMVMGLRVVAWFDXRRRRQWRVVDDACPHRLAPLSEGRVDGKGRLQCAYHGWCFDGHGSCQFIPQAPALGPPVHKNSKACVASYPSVVQNNILWFYPRSEPEYKEILQRKRPPYFPDLDDPSFNTVFGVRDLFYGTKKIQADMFIIYHDMISFNSSVYCTHEHATELVPFCNVPAAPTTDIEXXDQEGGYPVKIRTEQAKIDGFLSVQEDGYMKFDAPCXRSMASPFAPKNHRLCSTKSKEKKKKKQPEAMTVFLCVPVAPGRSRLIWAFPRNVDAWLDNIIPRWLYHIVTNIVLDSDSYLLHIEERNFATVGLDNWHKACYVPTSSDNMVITFRNWFRKYCKHQIGWATPMXXNQLPPTPTKDQVLERYRSHVMQCTSCSAALKKMKALEVALQVASVAIVGFLAVAKGSLAPSVVRRAAAVSTAVLCFAASRWLASFIEKSFYFQDYVHAYK

SEQ ID NO: 3778 - protein, 312 aa, Oryza sativa
  unsure (1)..(312): unsure at all Xaa locations
MAVDLMGFSPRGGCRPSVETEQLAFQEAAAAGLRSLELLVSSLSAGGEKQSSPPLGEIADQAVSRFRKVISILDRXTGHARFRRGPVVGAAAAEAAAAAASASPSSSPVSPPLPPVTTQPAAXXVKSLTLDFTNPAKVAAASVTSTSFFSSVTAGGDGSVSKGRSLVSSGKPPLAGGVKRKQPCAAAGDGHGHGAGHAHAHGGCHCSKKRKQRVRRTVRVAAASARVADIPADEYSWRKYGQKPIKGSPYPRGYYRCSTVKGCPARKHVERAADDPATLVVTYEGDHRHSQGAGERSLSSSRPNGLTAARFA

SEQ ID NO: 3779 - protein, 339 aa, Oryza sativa
  unsure (1)..(339): unsure at all Xaa locations
NPSPPPQPRSHLTISPSTHHPTQLKHLLLLHRQTQQRRARSRLRLRRPMAVDLMGFSPRGGCRPSVETEQLAFQEAAAAGLRSLELLVSSLSAGXGAPPPPXRPQEKQSSPPLGEIADQAVSRFRKRQLRRRLPRRRRRHRRRPCLAASPXPVTTQPAAAVKSLTLDFTNPAKVAAASVTSTSFFSSVTAGGDGSVSKGRSLVSSGKPPLAGGVKRKHPHPPCAAAGXXGHGHGAGHAHAHGGCHCSKKRKQRVRRTVRVAAASARVADIPADEYSWRKYGQKPIKGSPYPRGYYRCSTVKGCPARKHVERAADDPATLVVTYEGDHRHSPXAAAACLX

SEQ ID NO: 3780 - protein, 239 aa, Oryza sativa
  unsure (1)..(239): unsure at all Xaa locations
MQLMEMWSSDSRAVGDRSCDVFDGSWVPDRRYPLYNSSDCPFVERGFNCLANGRKDTGYLKWRWKPRGCDLPRFSARDVLERLRGKRVVFVGDSMSRTQWESFICMLMAGVENPKTVYEVNGNQISKTIRFLGVRFASFNLNVEFFRSVFLVQQSPAPRSSPKRVRAILKLDKMDNISRKWENADVLIFNSGHWWTPSKLFDMGCYFEAGGLLKLGTSINSAFKMALETWASWVKEKKX

SEQ ID NO: 3781 - protein, 620 aa, Oryza sativa
  unsure (1)..(620): unsure at all Xaa locations
MVWESESFSNFPYRRSGCPSRYDVAITKGTGVKRYFVQLHGTSNLAGSDVAMLGKTSYGENFYCQLWRTSWSLLMLQIRTSGGVDKLGLLLLNRMGHLHPNKVVVVSPPLPLSLGADIVSAVIVIVGAASIPDTPNSFTLRGRLNEARDLLWRIRRAGAATADVDAELKDIGALPRRTGGTSRARCGGFFVASTGHTWAWAAPATRVLIGASVTVAFLLLLAFFFIILPRGGTPPEVVSSSKEGGISCDVFDGSWVPDRRYPLYNSSDCPFVERGFNCLANGRKDTGYLKWRWKPRGCDLPRFSARDVLERLRGKRVVFVGDSMSRTQWESFICMLMAGVENPKTVYEVNGNQISKTIRFLGVRFASFNLNVEFFRSVFLVQQSPAPRSSPKRVRAILKLDKMDNISRKWENADVLIFNSGHWWTPSKLFDMGCYFEAGGLLKLGTSINSAFKMALETWASWVKEKVDLKRTHVFFRTYEPSHWSDQKVCEVTEFPTAEAKGDDRSEFGDILAGVVVNMSVPATILNVTLMGAFRSDAHIGIWSHPSTILDCSHWCLPGVPDAWNELVISHLXXQMVRSFTLSFFXHIIXSXSVLMALKLIGVCHLGXSKLSKCIFKSXX

SEQ ID NO: 3782 - protein, 1319 aa, Oryza sativa
METPVDGFSADANLPSPRRSDCEVALAISKFETAEREREEDEEAPRQLAPHASAVTRRRGMEEARARVVASAVARMKPPRATVTHATPAAVLAPPVGDVPHAGWRGLPDDVVARVLVHLPVVDLFRLGYLFSPRWLDIWRAEPLYLHDRQFVSPRIAAADVADAIANVLELHVGDGVQFSGSDDDDDDDDDDDDDDDDEDDDDDDDDDDDDDGDGGGGNEVVGADGHDLGVVVHPWREDDDDDSDDHDGGPDDAEDEAAVQDAGVVDDSGPGVAVELEHEAADQGGGVRVVDDSDGEGAAGRCRLRFPGGIGADDGVISDDDLYGHDDIPDGGYEIGRVYSFRVETTRWRADQLHRWCAALQRGRVREVTLTNLTMEGFPDLPQGILDCGTSLKGLHVFFFTVEADHIDPLVNLRVLGVYGCSGMITRALRPESEIRVLTIDFNHLGDVVVQTTRLRSLWMFNNVVQGTVIVNDALQFRDLHLLPPTRPSRIFIGDAPSLRSIGSLDLFNTVFVIKGIVIQAGMVQRPPKMRSVRILGLRVNYTDMGHRVPREIEQILKCFPCLEKLEIMRDDEVTPEEGLLKADGEHIYQGNNFFRDLGCFSHHLRWIYLTTFRGGKYELALGKAILDEARAGTIFRMYTSCREISSPNEIAHAVEKLCISLFSSVGGSCRRRAPPLALPLTVFFSHQVHADRSAGRRRPPAKSPERARWPERMDHESIVASDLSIYPLPPGTRTLATPRVVLAPPPVTVVNQPHADWRGLPDAAVSRVLDRLPVVDLFRLGYLFSPRWLHIWRARPLYLHDRQFTTPPIPAANVANAITNVLHHHVGEGVQLLPVQGGGGGGGGQGEGALVGGGDADEAVTSDDEIYEDEGIIQNAGHEIGRVYCLRVETTRWSLDHLVRWCAELQRGGARVLMLANLAIPEHPELPQAILNCGASHLGLHVFFFTVEAYHIAALVELRALGLYGCIEGHGMIDRVLHPESPIRKLAIHGGMGRTFAVAGATRLRSLVLFDNQVGTVAVDGAARFRNLYMSDTKPSRIRIGAAPRLRRILSLDIFNTVLVIQGLAIQIGMMEPPPQIRSVRHLCLRVNYTEMDVRLPRLMEQILKSFPRVKSLDIMRCDDVTQAEGLLQWNDAHYDGNNFFDGLESFNYHLRWIYLEDFRGGKCEVALMKAMLDKASVLRQLMIQYSTSSVPQLTLNQLDLSLQNFKLHTLNGAIRGNLVSFVAADASGSCRDDEVTVAEGLLKATDEHIYKGNNFFHGLRGFRGGKRELALIKAILDEARAGTRLRMEYSTRSNPELTMDQLDQLVSPDFRAAHSK

SEQ ID NO: 3783 - protein, 146 aa, Oryza sativa
  unsure (1)..(146): unsure at all Xaa locations
HKFRTKIANPALISFQAFPFLGFALAMFLFYSTVPTVLKICGATMLNLSLLTSDMWAVLIRIFAYHEKVDWIYFVAFAGTAAGLLIYSYKSSKEAEEXRRRSPELVTSRAKRAMKRPECRTPRELKLRCLHLHRHRHDLSLTRDHR

SEQ ID NO: 3784 - protein, 354 aa, Oryza sativa
  unsure (1)..(354): unsure at all Xaa locations
XGCGAGGEXRRDQFPVGMRVLAVDDDPVCLKVLETLLLRCQYHVTTTNQAAIALKMLRENRDMFDLVISDVHMPDMDGFKLLELVGLEMDLPVIMLSVNGETKTVLKGITHGACDYLLKPVRIEELRNIWQHVIRRKXXSTRDRANPNADSDHVHGHVTCGSPDQSGRPSKKRKEYCSEEEDEGEVNTQDIDDPSAPKKPRVVWSVELHRKFVAAVNQLGIDKAVPKRILELMNVEKLTRENVASHLQKYRLYLKRLSAVASQQVSIVAALGGRDPFLHMGGFEGLQGYQAFXPLPQLYHLSPHGLLTRNNPAALGTQGVPASKSIQTMSGSHTLSHSINDVGAYINADIVXHK

SEQ ID NO: 3785 - protein, 264 aa, Oryza sativa
  unsure (1)..(264): unsure at all Xaa locations
GGGGMGSPPLGPPPPPRSDCHMAYFKAYSHIGVHEEMLKDHVRTNTYRNAIMHHQDLISGKVVLDVGCGTGVLSIFCAFAGAARVYXAVDASXDIGLNRREIVEKXNELSDKVIVLHGRIEDVEIEEKVDVIISEWMGYMLLYESMLGSVIFARDKWLKPGGLILPSHASLYLAPITNSHRYQDSVYFWQDVYGIKMSSMMPLAKQCAFMEPSVETISGENVLTWPSVQVAQVDCYTIQAPELETITATFNYTSMLQAPLHGFA

SEQ ID NO: 3786 - protein, 393 aa, Oryza sativa
  unsure (1)..(393): unsure at all Xaa locations
FQLRNSMKFNSNAGLPPTPXRRCSPPSASAQGGGGGLPPRKAHRRSSSDVPFGYLAGXAPAPAAQGGGRVGPPRXXGAGGAAAADDLFNAYLNLEGLDGLNSSDXXRHDEGDSRGSSIKTNGADSSENESEECADDTRGGIRLWSADGGERREGVKRNAAGAATAPLARHARSLSMDSLIGKFNFTAGTXRRLRGTVSRWGRTXFSLEFGSGEFTPSEMKKIMADEKLAEMALADPKRVKRSSSGDRVLANRQSAARSKERKMRYIAELEQKVQILQSEATNLSAQLTMMQRDSAGLATQNNELKFRLHAMEQQAQLRDALNEALTTEVQRLKLATAELGDSCSSSSLAQQIQLNAQNQMXXQLQQQQATQIPFYQLQQSQQNGAAKNNESKE

SEQ ID NO: 3787 - protein, 752 aa, Oryza sativa
  unsure (1)..(752): unsure at all Xaa locations
MSTSRVAASFARDIYRYVRTRPDRPRLAPPPLVRALRRPRLGGSRISTPPRAFRVPANADAHVLSVRRDGDLLDRLIDRLASARRGERQGIIRRIDIVGCYELLLNCSYVDRGCSHIWSWLAGHRAHTGGCRLMLLLRVGDVHYIISAQWRSPNPVQDQCGDKTDGDITESADRSIPCVALDHRYAFTTARRGRHRLTASTGEGVTGSYARTPPIVVASASRLLDTHRSQHAADTDRTGRTYVRPRLASGKCAALRRVATERNAPHMHRIRFVASALPVAAKIAIPWPCTARSRSRLILQHRARSRSRGGRKLVLLAIMNGGIGDALMQPQHVQVMSSSLPMVASTFVAEPAAAANKPRAAGLPPTPPQVFAAQRAAAAAGGDVCMEEMSTSRSAQGGGGGLPPRKAHRRSSSDVPFGYLAGXAPAPAAQGGGRVGPPRXXGAGGAAAADDLFNAYLNLEGLDGLNSSDXXRHDEGDSRGSSIKTNGADSSENESEECADDTRGGIRLWSADGGERREGVKRNAAGAATAPLARHARSLSMDSLIGKFNFTAGTXRRLRGTVSRWGRTXFSLEFGSGEFTPSEMKKIMADEKLAEMALADPKRVKRVLANRQSAARSKERKMRYIAELEQKVQILQSEATNLSAQLTMMQRDSAGLATQNNELKFRLHAMEQQAQLRDALNEALTTEVQRLKLATAELGDSCSSSSLAQQIQLNAQNQMXXQLQQQQATQIPFYQLQQSQQNGAAKNNESKE

SEQ ID NO: 3788 - protein, 247 aa, Oryza sativa
  unsure (1)..(247): unsure at all Xaa locations
XELGWECDXYAGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEVPLSVCEWFKDYQPIAPGKQEVEHAYEFVKKKFEELYFQSSKPDRVDRVFKIYRTTALDQKLVKKTFKLIDESMRRSREGT

SEQ ID NO: 3789 - protein, 376 aa, Oryza sativa
  unsure (1)..(376): unsure at all Xaa locations
XTLRLRRGFDPIDSRPGGLAGGGRGAAMDMASIECVSYSDSMDDDDDDGVGVGGVSHLPRPILVKPSSAAAAVNVVVVSAGSGGGAGGGGGGVGVVAGAPAVPPATSVHELLECPVCTNSMYPPIHQCQNGHTLCSTCKTRVHNRCPTCRQELGDIRCLALEKVAESLELPCKYYSLGCPEIFPYYSKLKHESQCNFRPYNCPYAGSECSVVGDIPFLVAHLRDDHKVDMHSGCTFNHRYVKSNPREVENATWMLTVFHCFGQYFCLHFEAFQLGVAPVYMAFLRFMGDENDARNYSYSLEVGANGRKMIWEGTPRSIRDSHRKVRDSHDGLIIQRNMALFFSGGERKELKLRVTGRIWKEQQNPDSGACIPNLFS

SEQ ID NO: 3790 - protein, 454 aa, Oryza sativa
  unsure (1)..(454): unsure at all Xaa locations
MAAGAGAGGGGGEGDSNGGGTSPGGVSAAAPAIGPHHLGVAAAEEAMWQMTLGGGESMESTPYPERIGEPDCSYYMRTGLCRFGMTCKFNHPPNRKLAVAAARMNGEYPYRVGQPECQYYLKTGTCKFGATCKFHHPREKAALANRVQLNVLGYPMRPNEKECAYYLRTGQCKFASTCKFHHPQPSNTMVAVRNSMYSPGQSATSPGQHTYPGAVTNWTLSRSASFIASPRWPGHSGYAQVIVPQGLVQVPGWNPYAAQMGSSSPDDQQRTPVTTQYYGSRQSETGGMGDHGMYQSYQGGSVPVGVYTVQGENIFPERPDQPECQFYMKTGDCKFGAVCKFHHPKERLVPAPNCALNSLGLPLRPGEPVCTFYSRYGICKFGPNCKFDHPMGTLMYGSATSXKRXCVIYALSVVTLTRASRNIVDGGSGRSHRVPQSDSQQIPSGDGNAEREAS

SEQ ID NO: 3791 - protein, 277 aa, Oryza sativa
  unsure (1)..(277): unsure at all Xaa locations
MMMLIDCSGCRTPLQLPHGAPCIRCAICGAVTYVAAAAPPPAHGDPARGAAGPVAVAPQHQAPGWGPSPPPAHGRKRAVICGIFYKFSRHELKGCINDAKCMRYLLTTSFHFPDDSIIMLTEXXQTDPYKISTKHNIRLAMYWLVQGCQPGDSLVFHYSGHGAQQRNYSGDEVDGMDETLCPLDFETQGMIVDDEINTALVRPLTPGVKLHALIDACHSGTALDLPFLCRMNRSGQYVWEDHRPRSGVWKGTSGGEXXTTYGSILTSMRSTIRSTGX

SEQ ID NO: 3792 - protein, 378 aa, Oryza sativa
MMMLIDCSGCRTPLQLPHGAPCIRCAICGAVTYVAAAAPPPAHGDPARGAAGPGAVAPQHQAPGWGPPPPPAHGRKRAVICGISYKFSRHELKGCINDAKCMRHLLTTRFHFPDDSIIMLTGNYPILPPYWLNSGSEEQTDPYKIPTKHNIRMAMYWLVQGCQPGDSLVFHYSGHGAQQRNYSGDEVDGMDETLCPLDFETQGMIVDDEINTALVRPLTPGVKLHALIDACHSGTALDLPFLCRMNRSGQYVWEDHRPRSGVWKGTSGGECISFSGCDDDQTSADTSALSKITSTGAMTFCFIQAIERGQGTTYGSILTSMRSTIRSTGDSMGSGGGAVTSLITMLLTGGSVSSGGLKQDPQLTANEPFDVYAKPFSL

SEQ ID NO: 3793 - protein, 76 aa, Oryza sativa
  unsure (1)..(76): unsure at all Xaa locations
MLNLSPLLLTSDMWAVLIPIFPYHEKVDWIYFVGFAGTAAXGLLIYSYKSYKEAEEXSDEQGKAGDEEAGMQNPAX

SEQ ID NO: 3794 - protein, 191 aa, Oryza sativa
  unsure (1)..(191): unsure at all Xaa locations
YHLLSPLSSPQTPTHHRRRAGMEPRFRGVRKRPWGRYAAEIRDPARKARVWLGTFDTAEAAARAYDSAALHFRGPKAKTNFPVASSSRDTPAAAPVAAAAKAQVPASPSLDLSLGMXGHGGRPAVPVPRPQXVAVTVAVAAPVPRRPAVVSVKKEVARLDEQSDTGSSSSVVDASPAVGVGLDLNLPPPIE

SEQ ID NO: 3795 - protein, 224 aa, Oryza sativa
  unsure (1)..(224): unsure at all Xaa locations
CWEVKKMKEREKVVRLAKLAEQAERYDDMVEFMKTLARMDVDMSAEERLLFSVGFKKTIGARRASWRILESLEQKVTAGDQPGVTINGYKKKVEDELRAVCNEVLSIIAIHCLPLANSGENVVFFYKMKGDYYRYLAEFSTGTEKKAATDQSLMAYQHAMVGACSELSPAHQLRLGLALNFGDFXEIMNSAERASQVAKQALDEATAEINSAGVVGYKGSVLMM

SEQ ID NO: 3796 - protein, 488 aa, Oryza sativa
  unsure (1)..(488): unsure at all Xaa locations
XLDEKCDDRSELLDSSPAVRKSFSGTQFDTREYRVFVGTWNVAGKPPNSSLNLEDFLQIEGLPDIYVLGFQEIVPLNAGNVLVIEDNEPAAKWLGLIYQALNKPQDQSSGDELSQTSDSRQGGGSGSRDSIPKSSSGGMLFFQKPSLKMLSKNYRVDSALVKTCTCLTDPSTMQRRAREMREFXSTASRRRRRRRWRRRRRRPTKTGARTPAASXARSSVNYCLIASKQMVGIFLSVWVRRELVQYIGHLRVDSVGRGIMGRLGNKVLDAGCIAMSMTLHQTSVCFVCSHLASGEKEGDEVRRNSDVAEIIKSTQFPRICKVPGQRIPDKILDHDRVIWLGDLNYRVALSYDETKTLMGENDWDTLLEKDQAGRVFKGWKEGKIYFAPTYKYKQNSDSYAGETAKSKKKRRTPAXXCDRILWHGQGIEQLQYIRGESRFSDHRPVCSVFVIEADVDNGSMIRKGYSTLDSRIHFESPIPQRHSFYDDF

SEQ ID NO: 3797 - protein, 516 aa, Oryza sativa
  unsure (1)..(516): unsure at all Xaa locations
XRVPTFRSRFAGKKKSELLDSSPAVRKSFSDRHCATKIESLTLSCLDSPHRQXXDTREYRVFVGTWNVAGKPPNSSLNLEDFLQIEGLPDIYVLGFQEIVPLNAGNVLVIEDNEPAAKWLGLIYQALNKPQDQSSGDELSQTSDSRQGGGSGSRDSIPKSSSGGMLFFQKPSLKMLSKNYRVDSALVKTCTCLTDPSTMQRRAREMREFXSTASRRRRRRRWRRRRRRPTKTGARTPAASXARSSVNYCLIASKQMVGIFLSVWVRRELVQYIGHLRVDSVGRGIMGRLGNKGCIAMSMTLHQTSVCFVCSHLASGEKEGDEVRRNSDVAEIIKSTQFPRICKVPGQRIPDKILDHDRVIWLGDLNYRVALSYDETKTLMGENDWDTLLEKDQLMIERQAGRVFKGWKEGKIYFAPTYKYKQNSDSYAGETAKSKKKRRTPAXXCDRILWHGQGIEQLQYIRGESRFSDHRPVCSVFVIEADVDNGSMIRKGYSTLDSRIHFESPIPQRHSFYDDF

SEQ ID NO: 3798 - protein, 154 aa, Oryza sativa
  unsure (1)..(154): unsure at all Xaa locations
PHSYFSHYTLIMGNRDVIDEMSSTNSAVLTSILKLIDKYDLYGQVAYPKHHKQSEVPDIYRLAARTKGVFINCAFIEPFGLTLIEAAAYGLPMVATRNGGPVDIHRVLDNGILVDPHNQNEIAEALYXLVSDKQLWAQCRQNGLKNIHQFSWPX

SEQ ID NO: 3799 - protein, 262 aa, Oryza sativa; identical to SEQ ID NO: 951

SEQ ID NO: 3800 - protein, 325 aa, Oryza sativa
  unsure (1)..(325): unsure at all Xaa locations
EEAHQQQPKIQKTRRGPGVLXGXXSLPAVTMEQKDEAEMEEVDEEEEEEVDEDMAASCGLGEKKRRLALEQVRALERSFDTDNKLDPDRKARIARDLGLQPRQVAVWFQNRRARWKTKQLERDFAALRARHDALRADCDALRRDKDALAAEIRELREKLPTKPGGHGGIGEGRKPAXDAGPTVCKDGSSDDSDSSVVFNDEASPYSGAAFIGFGPSFLVDDASAATVGCSSSLPALESKWHGPYSDDSCKXXGVYGFTEDGSPCSGEMAGNXXPPASSPTSTPPTSTSVGIASSPSALAQRCPGSTSAWMDTATPSLSSPMIMVA

SEQ ID NO: 3801 - protein, 417 aa, Oryza sativa
  unsure (1)..(417): unsure at all Xaa locations
MGVGIMNDAKPYLAMILLQVGFAGMYVVAVASLKRGMSHFVLVVYRNLFATAVMAPFALWFERRVRPRLTLIIFLKIMGLAILEPVLDQNLYYMGANLTSAGFASALINVLPAVTFVMALVLRFRMEKVKLKSVHSQAKIAGTLFTVAGAVLMVLYHGPVVQFPWTKGQHHDGGSGAGGAAGGGFLQGTIFIVVACVCWSGFFVLQSNTXLQSYPAELSLTTLICLMGSVLSGTVALVAERHNTHAWLIGFDTRLFTCVYAGIVCSGVAYYVQGIVSRQRGPVFVTAFNPLCMIITAIMGSIILKEEINLGSVIGAVIIVIGLYALIWGKGADKVEQTDAGAAAAGSNKGGGELPLTAVPNGHGSKXTATAAMSTTSRRRRRRTGTTSLSTCSSSPSSSAVHCKLVVVRSTIDRSRA

SEQ ID NO: 3802 - protein, 142 aa, Oryza sativa
  unsure (1)..(142): unsure at all Xaa locations
ENDHKLDAWYXRDTTLYVTLEPCAMCAGAILQARVDTVVWGAPNKLLGADGSWVRLFPGDGQTSSLDSAKGPGPVHPFHPKISIRRGIXLSAECSEIMQQFFHLRRKKQKPESPPHAHPQGRNHPVKFFSKMHHMFGTIFCL

SEQ ID NO: 3803 - protein, 601 aa, Oryza sativa
  unsure (1)..(601): unsure at all Xaa locations
MDSVPAAGVGVGGGGAGAGYPESTESSPRSRGGDSWDEPFPSSAAAAAAAAGGGRLRLMCSFGGRIVPRPTDKSLCYLGGETRIVAVERNASLADVHARLSRSLLGGQPFTLKYQLPNEDLDSLISVSTDEDLDNLVDEYDRIAATSSGGGSSRTSRIRLFLFPAKPESSSSLGSLLDDSSKSESWFVDALNSAISGSLDGIPRGISTDSASVNCLLGLEDDSSTHSRGGPPNSSPAEEQRANQQKLAAAAAVAAARHPHDVQSVPDSPMIDKNSSFGSTSSAPSLSNLPPIRVRPEDRPPDSRLAPQVPVEDHFAQMGISDQPVQPVIGGYMQPPPQVPIPNMAVPSISPSDASSRVFSDDDKSDHGGGGGRKPQPPKPEVPPVADPTNRAMYYNDRSPPAELKRDMPVGTDAASYRVPVPAQDAAAAAAAAAAAAQQPPAGYVYAQMHAPPPQQQPPPPQQQQPVPQQYVTAQNQHFIHNPATGTFIPIQSYYHHPVPQQAPQPPMPQPVPQPQQSHAFDPNTGMYYIPMRTNAPQAYSMPPGAAAVPPPTLVDTTPKPTVPIPQMAVKQPELQQPGSGTTNIATSVSAHGLARCWPGX

SEQ ID NO: 3804 - protein, 731 aa, Oryza sativa
MVEPFLLVNGGIGKENRSSLLRVYIPRPLRQKPLFRSSSSSPKNLIKIPSPKNPSHPNFLMDSVPAAGVGVGGGGAGAGYPESTESSPRSRGGDSWDEPFPSSAAAAAAAAGGGRLRLMCSFGGRIVPRPTDKSLCYLGGETRIVAVERNASLADVHARLSRSLLGGQPFTLKYQLPNEDLDSLISVSTDEDLDNLVDEYDRIAATSSGGGSSRTSRIRLFLFPAKPESSSSLGSLLDDSSKSESWFVDALNSAISGSLDGIPRGISTDSASVNCLLGLEDDSSTHSRGGPPNSSPAEEQRANQQKLAAAAAVAAARHPHDVQSVPDSPMIDKNSSFGSTSSAPSLSNLPPIRVRPEDRPPDSRLAPQVPVEDHFAQMGISDQPVQPVIGGYMQPPPQVPIPNMAVPSISPSDASSRVFSDDDKSDHGGGGGRKPQPPKPEVPPVADPTNRAMYYNDRSPPAELKRDMPVGTDAASYRVPVPAQDAAAAAAAAAAAAQQPPAGYVYAQMHAPPPQQQPPPPQQQQPVPQQYVTAQNQHFIHNPATGTFIPIQSYYHHPVPQQAPQPPMPQPVPQPQQSHAFDPNTGMYYIPMRTNAPQAYSMPPGAAAVPPPTLVDTTPKPTVPIPQMAVKQPELQQPGLYRTTAAPTPVPASNAPAYAGMGYHHVIQTHHHPAPQPAATVAGNFGYDYGDPTRAQVFYSQAAAPPTLPPQYQPMGSPDAGQADLKQARAS

SEQ ID NO: 3805 - protein, 365 aa, Oryza sativa
  unsure (1)..(365): unsure at all Xaa locations
MHNCDRLRIHDLDVRSPGVRPCPLLHSTHAHAQAKQQAAAPMRGGVAGPTAGEPPGTEAEAEEVEESSAGDDEELELGLSLGSKXTAAAAACAGGGGGGGEEXXEGPTATTSPGTVASGHPHSSFGVVGWPPIRQFRMNSLXXNQAKENTSETDTKKTATNESDVQKDKEEGEKKGRVAGWVKVNMDGEVIGRKVDLNAHRSYKTLALALELMFTKPSIGLCASHNTNSLKLLDNSAEYQLTYEDRDGDWMLVGDVPWESAIPGNSQNHCFNKRQILRACDKEKSYTAATLNSDPPGFLIRSRIRTKACQPPLPLPAKQQSNQTTSPASFLPPILAPVNAEDSCKQQHMRMLQLLLITHYQMRCD

SEQ ID NO: 3806 - protein, 274 aa, Oryza sativa
  unsure (1)..(274): unsure at all Xaa locations
MRGGVAGPTAGEPPGTEAEAEEVEESSAGDDEELELGLSLGSKKQQQQGPAAGGGAVTGLLRVVVIPPAAAAGGKRAEGPTGHHLAWDXVASGHPHSFGVVGWPPIRQFRMNSLXXNQAKENTSETDTKKTATNESDVQKDKEEGEKKGRVAGWVKVNMDGEVIGRKVDLNAHRSYKTLALALELMFTKPSIGLCASHNTNSLKLLDNSAEYQLTYEDRDGDWMLVGDVPWEMFVSSVKRLRIMRTSDANGLGQRYQGIHXEPLLQQEADPESV

SEQ ID NO: 3807 - protein, 403 aa, Oryza sativa
  unsure (1)..(403): unsure at all Xaa locations
TGAGAGGAASPSGLRRYGFRFSASSLLQAPLAALLEYSGVVPSGPSSSSEADGLLSAAAAGDGEVSIRIQGGPGEADAAGVAGAASSGEDSIEATAAGDVDPASAAAGRGGGADAEASGGGADGASGSGDRAYQRYDVHHVARWIEQILPFSLLLLVVFIRQHLQGFFVTIWIAAVMFKSNDILRKQTALKGERKIAVLVGITVIFMIHVFGVYWWYRNDDLLRPLFMLPPKEIPPFWHAIFIIMVNGTDASLKGFLNLLACISPLSDSEGQMLTLVEYLLLLYRALLPTPVWYRFFLNKEYGSLFSSLTTGLYLTFKLTSVVEKVQSFLAAVKALSRKDVHYGSYATAEQVNXCAICQEKMHVPVLLRCKHIFCEDCVSEWXILFLFYTFLHALFGSLGLCX

SEQ ID NO: 3808 - protein, 553 aa, Oryza sativa
  unsure (1)..(553): unsure at all Xaa locations
LQAIFSLPRPPRHCQSTAAPGLLLSSSPSPSRAVVLVVVVVCGRAGAARVPVTLLPSAAASAFHAAWARRRGLGVGGGRIGGTARVAVVQGKQVPVYNSGGGGGGLDRGIGDAGQRRRRMGQQAAEAQPLLLQGDQVDAEWGCRPHRIVLFVEPSPFAYISGYKNRFQNFIKHLREMGDEMLVVTTHKGAPEEFHGAKVIGSWSFPCPLYQNVPLSLALSPRIFSAVAKFKPDIIHATSPGVMVFGARFIAKMLSVPMVMSYHTHLPAYIPRYNLNWLLGPTWSLIRCLHRSADLTLVPSVAIAEDFETAKVVSANRVRLWNKGVDSESFHPKFRKHEMRIKLSGGEPEKPLIIHVGRFGREKNLDFLKRVMERLPGVRIAFXVGDGPYRAELERMFTGMPAVFTGMLQGEELSQAYASGDLFAMPSESETLGQVVLESMASGVPVVAARAGGIPDIIPKDKEGKTSFLFTPGDLDECVRKIEQLLSSKVLRESIGRAAREEMEKCDWRAASKTIRNEHYCTATLYWRKKRQNXLGFAYRFRNRSPPSPPSYC

SEQ ID NO: 3809 - protein, 122 aa, Oryza sativa
  unsure (1)..(122): unsure at all Xaa locations
VFAFLGACQAWGVLLVARCGGANKRKGEGLGEMHDDVLERVLARLPPASYFRLRGVCRLWSDAASSPTFLAACGRVPARDPWMLMLTGGRGRSGVFRPYAFDASQGEWARCGGAPXARDAGX

SEQ ID NO: 3810 - protein, 272 aa, Oryza sativa
  unsure (1)..(272): unsure at all Xaa locations
MAEAVASGAAGRWTLRGKTALVTGGTRGIGHAVVDELAALGAAVHTCSRKEAELGERLREWEGKGFRVTGSVCDVSVREQRERMLREVAGLYGGKLDILVNNVGTNFSKQTTEYSADDYSFIMATNLESAYHLCQLAHPLLKSSGSGSVVFISSVSGVVAVSSGSVYAMTKGAMNQLAKNLACEWAKDNIRTNSVAPWYMKTSLVEDELARKDFADSVVRRTALKRVGEPEEVSSLVAFLCMPGASYITGQTISVDGGMTINGLYPTQDXTE

SEQ ID NO: 3811 - protein, 161 aa, Oryza sativa
  unsure (1)..(161): unsure at all Xaa locations
MAAPDVEYRCFVGGLAWATDDRSLEAAFSTYGEILESKIINDRETGRSRGFGFVTFSSEQAMRDAIEGMNGKELDGRNITVNEAQSRRSGSGSGGGYGQRGGSGSYGGGGYGGGGGGGGYCQRRESGYRGGGGYRGGRGGGNYRGGYGSRGGGNSXGNWXN

SEQ ID NO: 3812 - protein, 398 aa, Oryza sativa
  unsure (1)..(398): unsure at all Xaa locations
IDLIVNLLFKSNSSSILRTPGFSLLTGRALEELRGSLYNEFHTSEGAKRQQQRFCGPSVALTFNFFVAVGIIMANKMVMGAVGFNFPVALSLIHYIAAWVLMAVLKAFYLLPIAPPSKSTPFSSLFALGAVMSFSTGLANISLKHNSVGFYQMAKIAVTPTIVAAEFILFKKKVSLRKVITLAVVSCGVAVATVTDLEFNLFGACVAVAWIIPSAVNKILWSNLQQSGNWTALALMWKTTPITVFFFLVLMPLLDPPGLLSFNWNIQNSSAIMISALFGFLLQWSGALALGATSALAHVVLGQFKTIVIMLSSYLVFNSDPGFTSLCGAIIALGGMSVYTYLGLKESASGGKRAPSTSRQNSHLLKSKVIVDGEKPETSIDSVXVEELPFILVFLKIH

SEQ ID NO: 3813 - protein, 210 aa, Oryza sativa
  unsure (1)..(210): unsure at all Xaa locations
MAGAVATVSVGLAWLGLMAAAASATQFRVGGGRGWSVPDANAEPYNSWAGRMRFQIGDQLLFVYPKEMDAVVVVDQGAYDACNTSSSVAGGGGGRYDDGNTVFTFDRSGPFFFISGNEANCRAGEKLVVVVMADRGGAPSPSVSPMAPAPAPTTSTPSSPPAPAAMAPSPSTTPXXRPNDRSGAAAAAPVVAGVVVTSLGAYIGYAMLAI

SEQ ID NO: 3814 - protein, 269 aa, Oryza sativa
  unsure (1)..(269): unsure at all Xaa locations
NRSLVVVVSTIKCARRNGGSSGNCQWGLAWLGLMAAAASATQFRVGGGRGWSVPDANAEPYNSWAGRMRFQIGDQLLFVYPKEMDAVVVVDQGAYDACNTSSSVAGGGGGXRYDDGNTVFTFDRSGPFFFISGNEANCRAGEKLVVVVMADRGGRHAPPPSPPAVPPPVAPVPMPSPSPSVSPMAPAPAPTTSTPSSPPAPAAMAPSPSTTPGGVAQPPPPPGTDGANATTPAAPAANDRSGAAAAAPVVAGVVVTSLGAYIGYAMLAI

SEQ ID NO: 3815 - protein, 910 aa, Oryza sativa; identical to SEQ ID NO: 855

SEQ ID NO: 3816 - protein, 219 aa, Oryza sativa
  unsure (1)..(219): unsure at all Xaa locations
LLLKTPAMASAAMLVPLVLVLCTAAASAAVVEHTFKVGGTKITQLCMNSVIYTANQQLPGPTIEVTEGDTLVVHAVNDSPYPLSLHWHGVYQLRSGWNDGANKITQCPIQPSGNFTYRFNITGQEGTLWWHAHSSLLRATIYGALIIKPRNGPSGYPFPEPYEEIPILLGEWWNRNVDDVENDGYLTGLGPQISDALTINGMPGDQNRCSTAPPARIRX

SEQ ID NO: 3817 - protein, 524 aa, Oryza sativa
  unsure (1)..(524): unsure at all Xaa locations
MPEYTAVPTVIHNTDLFGHASHSLVIDSSRKLVQSFGIGFIISLCLILLINISTSDVRETKIIQTEVLAGIHARRVGDGLAWPIWGDSSGVRRSDGASGASARIPVRRVPACKAWRAQRDGCVGLIGPPATRVRTRRSPIGPHRQLARRVMTTTTAEGGGGVAPFVAKTYRMVDDPATDGVIAWGRDSNSFVVADPFAFSQTLLPAHFKHSNFSSFVRQLNTYVRSRFPSIPGFRKVDPDRWEFAHVSFLRGQTHLLRRIVRRSSGGGGAKRKEEAGGCGGGGEAAAGDVDEESAVVALEVARLRREQREIEGRVAAMWRRVQETERRPKQMLAFLVKVVGDPHAAPPRRQGQHQRRRLQRRRLPSSGQEAAPPPPRPPPPPPTATATSSXAAADGXSTPAAAARRPQLPPRSCRTTRSTSPASXTGGDGFGNAVVDAGVDYPPAYAFPVVDSGYXSCNRFEIRALVADPTICVRSSIFRFSLPSPKCLDEVAVNGEGRKLGSSPSSHVGFFPPCWGFLVSVCA

SEQ ID NO: 3818 - protein, 350 aa, Oryza sativa
MLGQVLRRLRPATAAAADAARAYSAAAKEMTVREALNSALDEEMSADPSVFLMGEEVGEYQGAYKISKGLLDKYGPERVLDTPITEAGFTGIAVGAAYQGLRPVVEFMTFNFSMQAIDHIINSAAKSNYMSAGQISVPIVFRGPNGAAAGVGAQHSQCYAAWYAHVPGLKVLVPYSAEDARGLLKAAIRDPDPVVFLENELLYGESFPISAEVLDSSFALPIGKAKIEREGKDVTITAYSKMVGYALQVINLRSIRPLDRATINASVRKTNRLVTIEESFPQHGIGAEICMSVVEESFEYLDAPVERIAGADVPMPYAANLERMAVPQVDDIVRAAKRACYRAVPMAATA

SEQ ID NO: 3819 - protein, 376 aa, Oryza sativa
MLGAARRQLGSGPMLGQVLRRLRPATAAAADAARAYSAAAKEMTVREALNSALDEEMSADPSVFLMGEEVGEYQGAYKISKGLLDKYGPERVLDTPITEAGFTGIAVGAAYQGLRPVVEFMTFNFSMQAIDHIINSAAKSNYMSAGQISVPIVFRGPNGAAAGVGAQHSQCYAAWYAHVPGLKVLVPYSAEDARGLLKAAIRDPDPVVFLENELLYGESFPISAEVLDSSFALPIGKAKIEREGKDVTITAYSKMVGYALQAADILSKEGISAEVINLRSIRPLDRATINASVRKTNRLVTIEESFPQHGIGAEICMSVVEESFEYLDAPVERIAGADVPMPYAANLERMAVPQVDDIVRAAKRACYRAVPMAATA

SEQ ID NO: 3820 - protein, 383 aa, Oryza sativa
  unsure (1)..(383): unsure at all Xaa locations
MAALTSYEMAASILLCAEDSSSVLGFGGEEEEEEEDVVAXEEGQVRWSAAAAVRGRPGVDFAVPSEECVARLVETEADHMPREDYAERLRAGGGDGDLDLRVRMDAIDWIWKVHSYYSFAPLTACLAVNYLDRFLSLYQLPDGKDWMTQLLAVACLSLAAKMEETDVPQSLDLQVGEERYVFEAKTIQRMELLVLSTLKWRMQAVTPFSYVDYFLRELNGGDPPSGRSALLSSELILCIARGTECLGFRPSEIAAAVAAAVVGEEHAAFSHVNKERMSHCQEVIQDPKPSSPSRVFVSSSIPRSPTGVLDAAGCLSYRSDDSAVASHYAASSWGYEHDSSPRRGDSGTRQSELGTDTPDVLLTPFPFPTSTHPAPVALFPTGG

SEQ ID NO: 3821 - protein, 362 aa, Oryza sativa
  unsure (1)..(362): unsure at all Xaa locations
MAALTSYEMAASILLCAEDSSSVLGFGGEEEEEEEDVVAXEEGQVRWSAAAAVRGRPGVDFAVPSEECVARLVETEADHMPREDYAERLRAGGGDGDLDLRVRMDAIDWIWKVHSYYSFAPLTAXCLAVNYLDRFLSLYQLPDGKDWMTQLLAVACLSLAAKMEETDVPQSLDLQVGEERYVFEAKTIQRMELLVLSTLKWRMQAVTPFSYVDYFLRELNGGDPPSGRSALLSSELILCIARGTECLGFRPSEIAAAVAAAVVGEEHAAFSHSLSPWFFLCXERMSHCQEVIQDPKPASPSRVFVSSSIPRSPTGVLDAAGCLSYQEXRFQLFPSHYRSKPAGDFEPDSSPVTSQEEEDLAR

SEQ ID NO: 3822 - protein, 274 aa, Oryza sativa
  unsure (1)..(274): unsure at all Xaa locations
XGTALVVRVKTCETSPSLLDTIILSQWEDYAWKGHFGYDVTACNLKVVEGGWSFVVQLNDKXGIHVSSRXHDKFLEPVGCLKPNCMXXSYDELLLCIAQGDKDIPEVVPXXTKPPKDGLLLIANAYPVEYGHIFLVPSATNQLSFFWDKRMFSLIARIASEALSCYVLTGKDVNTLANFVSEVSLTLHDNNTAYSLLISNNGTKVFLFPQVKNLATGCCLSAWECSGYFIYRAKYDFDRASENEISNRMASVTLQDGAFENLKNLCCAVADDLV

SEQ ID NO: 3823 - protein, 348 aa, Oryza sativa
MVSTTEFKGEYSLPSKKSPLDQFEGVKTHLYRLGAEHENGTLKSFAYTDQGSPSLLDTIILSQVVEGGWSFVVQLNDKWNSCVLKEHDKFLEPVGCLKPNCMNSYDELLLCIAQGDKDIPEVVPSTKPPKDGLLLIANAYPVEYGHIFLVPSATNQLSFFWDKRMFSLIARIASEVNSAAFRVFFDSCTSTMPDHMFFQACYFANPLPVESASTVAIYHGKATSAVHLYEIIDYPMKALVLTGKDVNTLANFVSEVSLTLHDNNTAYSLLISNNGTKVFLFPQVKNLATGCCLSAWECSGYFIYRAKYDFDRASENEISNRMASVTLQDGAFENLKNLCCAVADDLVM

SEQ ID NO: 3824 - protein, 346 aa, Oryza sativa
  unsure (1)..(346): unsure at all Xaa locations
MYHLASWICLWSVGSSRKTAPMNSACSSSTTTLTPRHGFLPWRCGWDRARIHTQGPPAPQRGIVAPSAAAPYGRREDEEEADAAATTDEQRAVATSREARKLGGGSVESGRRGGALSRRARYRSPPPDRRTTVSRQLASTGVMSSRRSMGALAAVCVCMFVFVSSARAEDPYRFFDWEVTTGNINPLGVQQQGILINGQFPGPEIDCQTNDNLIVNVHNRLSEPFLLSWNGLQHRKNSWQDGVSGTNCPIPPGQNFTYQMQAKDQIGSFFYFPSLAFHKAAGGFGAIRIRSRPLIPVPFDPPAGEYTMLIGDWYKTSHKAWHCSYTNFINSRWILVLSDCFAVAAX

SEQ ID NO: 3825 - protein, 338 aa, Oryza sativa
  unsure (1)..(338): unsure at all Xaa locations
MIRKYXAPANKAERKAVLDAGAWMFNVVTSVGIIMVNKALMATHGFSFATTLTGLHFATTTLMTLVMKWLGHIQPSYLPLPELVKFVFFANLSIVGMNVSLMWNSVGXFYQIAKLCIIXPVLCILETVWTKVRYSRDTKLSIVLVLVGVAVCTVTDVSVNSKGLLAAVIAVWSTALQQHYVHHLQKKYSLGSFNLLGHTAPAQAASLLILGPFVDFWLTNRRVDTFNYTTIVTFFIVLSCTIAVGTNLSQFICIGRFTAVSFQVLGHMKTILVLTLGFLFFGKEGLNFHVVLGMMLAVIGMIWYGNASSKPGGKERQIYSVPSEKTQKSSQSELDQKV

SEQ ID NO: 3826 - protein, 410 aa, Oryza sativa
  unsure (1)..(410): unsure at all Xaa locations
PTLPVVVLFKSELGFSIVDIFLVVVQILSIVSMVSTTEFKGEYSLPSKKSPLDQFEGVKTHLYRXSVQNMNKSFAYTDQGSPSLLDTIILSQWEDYAWKGHFGYDVTACNLKVVEGGWSFVVQLNDKXGIHVSSRXHDKFLEPVGCLKPNCMNSYDELLLCXXAQGDKDIPEVVPSTKPPKDGLLLIANAYPVXEYGHIFLVPSATNQLSFFWDKRMFSLIARIASEVNSAAFRVFFDSXXTSTMPDHMFFQACYFANPLPVESASTVAICKATSAVHLYEIIDYPMKALVLTGKDVNTLANFVSEVSLTLHDNNTAYSLLISNNGTKVFLFPXGEESXLLDVVFLXWECSGYFIYRAKYDFDRASENEISNRMASVTLQDGAFENLXXIFAALSCCSYGEKKKKKKKKX

SEQ ID NO: 3827 - protein, 757 aa, Oryza sativa
  unsure (1)..(757): unsure at all Xaa locations
MAEEGQRGGYSRLAGDEEVATASGGGGGDYDERKLRLLGYEPQLKRNLSLLSNFAVSFSIVSVLTGITTLFGTGLQFGGPATMVYGWPIAGAMTLVVGLAMAEICSAYPTSGGLYFWSARLCSHRRWGPFASWLTGCESTRLYGSFNKHETGCNQDKAKRGNGVPGYICSVVNFVLCADFESRHPVDTIRQYKSRQEGARLDSSPQHCRRSHHLTWQIRYQRVPVRPAPGASERSAAMTWNKAPAADAEAGGGGDTGHARLRELGYKQELKRDLSVLSNFAFSFSIISVLTGITTLYNTGLSFGGPATMTFGWFVAGAFTMTVGLSMAEICSSFPTSGGLYYWSARLSGKRWAPFASWITGWFNIVGQWAVTTSVDFSLAQLIQVIILLSTGGNNGGGYMASKYVVIAFHAAILLSHAAINSLPITWLSFFGQFAAAWNMLGVFVLMIAVPTVATERASAKFVFTHFNTENNAGIHSNFYIFVLGLLMSQYTLTGYDASAHMTEETKNADRNGPIGIISAIGISIIVGWGYILGITFAVKDIPYLLNPENDAGGYAIAEVFYLAFKSRYGSGIGGIICLGIVAVAIYFCGMSXVTKHSGMGVRVSRDXAMPLSSVWHKVNKHEVPINAVWLSALISLCMALPSLGSLVAFQAMVSIATIGLYVAYALRSLSRVTLARKHFVPGPFNLGRCGVAVGWAAVLWVATITVLFSLPVSYPVTKDTLNYTPVAVGGLFLLVLSSWLLSARHWFKGPITNLDG

SEQ ID NO: 3828 - protein, 482 aa, Oryza sativa
  unsure (1)..(482): unsure at all Xaa locations
SSAAAGGXRLTRVRTLGRGASGAVVSLFAAXXDDELLAVKSAAGPAGAAQLRREAGILASLCSPHVLPCFGFGAVAGGEYGLLLEFAPGGSLADEVARNGGRLEEDDVRAYAADVASGLAYLHGVGMVHGDVKGRNVVIGANGRAKLADFGCARRADSAGPIGGTPAFMAPEVARGEEQGPAADVWALGCTVIEMATGRAPWSGVDDVVAAVRLIGFTDAVPEPPEWLSPEANDFLDKCLRRRAGERWTAAQLLEHPFLALAGCRAVAAEETKPKWVSPKSTLDAAFWESDADDEDDDMPESWAERIMALAVPCSAVPDWESDDGWIDVMSSQSELPIAAAETPAEQTRSEVSESPVASPALETTSYASAWDERSEAVMDADVDDDDDELVHNVRTVDTFVDEQLRQDIYLDFTTSDPIVLHVDVSDERKVGGGCRKAGEMKMMQIRGDTWPKSLDYLTPDRAGFVVDDGCDALQLPPAGQH

SEQ ID NO: 3829 - protein, 391 aa, Oryza sativa
  unsure (1)..(391): unsure at all Xaa locations
MDPWISTQPSLSLDLRVGLPATAAVAMVKPKVLVEEDFLPLKKDPEVAALEAELKRMGAENRQLSEMLAAVAAKYEALQSQFSDMVTASANNGGGGGNNPSSTSEGGSVSPSRXKRKSESLDDSPPPPPPPHPHAAPGYADQTECTSGEPCKRIREECKPKISKLYVHADPSDLSLVVKDGYQWRKYGQKVTKDNPCPRAYFRCSFAPACPVKKKVQRSAEDNTILVATYEGEHNHGQPPPPLQSAAQNSDGSGKSAGKPPHAPAAAPPAPVVPHRQHEPVVVNGEQQAAAASEMIRRNLAEQMAMTLTRDPSFKAALVTALSGRILELSPTKDXRLLLIDAADSIASSCNCGHGHCHPLLSLPLCSWWRQQEHDRRGVHPWRSSIDRLIG

SEQ ID NO: 3830 - protein, 143 aa, Oryza sativa
  unsure (1)..(143): unsure at all Xaa locations
XVIALTIMRDCLTCNPSTFRTMNERLVGGCVETTTCVKRLYQMQETVALLFRSINSNDSVTKSKFDNLSGCRHCIPEGLMRATDVMTVGKVAVLCGYGDDIMGCAAALKRAGALVIDTEMDPICALHALMEGFQVLTLEDVEX

SEQ ID NO: 3831 - protein, 587 aa, Oryza sativa
MGRGGSRAACAAAAPPWHSLPDEVWEHAFSFLPAAADRGAAAGACSSWLRAERRSRRRLAVANCYAAAPRDAVERFPSVRAAEVKGKPHFADFGLVPPAWGAAAAPWIAAAADGWPLLEELSFKRMVVTDECLEMIAASFRNFQVLRLVSCDGFSTAGLAAIAAGCRHLRELDLQENEIEDCSIHWLSLFPESFTSLVTLNFSCLEGEVNITVLERLVTRCHNLKTLKLNNAIPLDKLASLLHKAPQLVELGTGKFSADYHSDLFAKLEAAFGGCKSLRRLSGAWDAVPDYLPAFYCVCEGLTSLNLSYATVRGPELIKFISRCRNLQQLWVMDLIEDHGLAVVASSCNKLQELRVFPSDPFGAGFLTERGLVDVSASCPMLESVLYFCRRMTNEALITIAKNRPNFTCFRLCILEPHTPDYITREPLDAGFSAIVESCRGLRRLSISGLLTDLVFKSIGAHADRLEMLSIAFAGNSDLGLHYILSGCKSLKKLEIRDCPFGDKPLLANAAKLETMRSLWMSSCLLTLGACRQLARKMPRLSVEIMNDPGRSCPLDSLPDETPVEKLYVYRTIAGPRSDTPACVQIV

SEQ ID NO: 3832 - protein, 194 aa, Oryza sativa
  unsure (1)..(194): unsure at all Xaa locations
MPKHYRPAGKKKEGNAAKYITRTKAVKYLQISLATFRKLCILKGVFPRDPKKKVEGNHKTYYHMKDIAFLAHDPLIEKFREIKVHRKKVKKAFAKKNKDLADRLLNRPPTYKLDRLILERYPTFVDALRDLDDCLTMVHLFAALPAVEGERVQVQRIHNCRXLSHEWQAYISRTHSLRKTFISVKGIYYQVSLC

SEQ ID NO: 3833 - protein, 247 aa, Oryza sativa
MGKHGKCDVEACYPGGAPGGGMYPYMIENAQLRWAFIRKVYVIVSVQLLVTVAVAGAVNLVEPIKTFFQARTPEVLVAYVIIIISPLIMMLPMIYFRNKHPINLFFLLLFTVCISFSVGLGCLSKNGTVIFQAAGMTAAIVIGLTCYTFWAAKRGYDFEFLGPFLFAATLVLFLYAIITIFLPMGRTGKLVYGCVAALIFSGFIIYDTDNLIKRYTYDEYVAAAITLYLDIINLFMALVTALQAADG

SEQ ID NO: 3834 - protein, 430 aa, Oryza sativa
MEKCYIGISRCFRRGADGHLYCEGVRVEDAMGAAERTPFYLYSKPQVVRNFTAYRDALEGLRSIVGYAVKANNNLRVLQLLRELGCGAVLVSGNELRLALRAGFDPTRCIFNGNGKTLEDLVLAAESGVFVNIDSEFDLENIVTAARVAGKKVPVLLRINPDVDPQVHPYVATGNKTSKFGIRNEKLQWFLDSIKSYSNDITLVGVHCHLGSTITKVDIFRDAAGLMVNYVDEIRAQGFELEYLNIGGGLGIDYHHTDAVLPTPMDLINTVRELVLSRDLTLIIEPGRSLIANTCCFVNRVTGVKSNGTKNFIVVDGSMAELIRPSLYGAYQHIELVSPSPDAEVATFDIVGPVCESADFLGKDRELPTPDKGAGLVVHDAGAYCMSMASTYNLKLRPPEYWVEDDGSIAKIRRGESFDDYMKFFDNLSA

SEQ ID NO: 3835 - protein, 570 aa, Oryza sativa
  unsure (1)..(570): unsure at all Xaa locations
MARSWSLLLLPFALALVASVAQAAVVEYTFNVGNLSISQLCQQEMIITAVNGQLPGPTIVATEGDTVVVHMVNESPYNMTIHWHGIFQRGTPWADGPAMVTQCPVRPGGNYTYRFNVTGQEGTLWWHSHFSFLRATVYGALIIKPRGGEAYPFPVPDEEVVVILGEWWKTNVYDLQQRSLVTGNPAPHADAYTINGKPGDFYNCSAPNQTHKFELKQNKTYMLRIINAALNTPLFFKVAXNHSFNVVAADACYTKPYKTDVVVISPGQTVDALLVPDAGVAAAVGGRYYMAVIPYNSAVNAADPSFLYSLTNSTAIVEYGGGPATSPPMVPDMPEYNDTATAHRFLSNMTALVPNRVPLAVDTHMFVTVSMGDTFCGPEQTMCXCPIFASSMNNASFILPNTTSMLEAMYNSIDGVYTRDFPDTPPIVFDYTXXDASDDNATLKHTFKSTKVKTLKYNSTVQMVLQNTRLVSKESHPMHLHGFNFFVLAQGFGNYNETTDPAKFNLVDPQERNTVAVPTGGWAVIRFVADNPGVWFMHCHFDAHLEFGLGMVFEVQNGSSPGDRAGPPLP

SEQ ID NO: 3836 - protein, 529 aa, Oryza sativa
  unsure (1)..(529): unsure at all Xaa locations
MRTWRLAVLACLCAAAAAAPAEAKTHHHTWNITYQYKSPDCFRKLAVTINGESPGPTIRAAQGDTLVVTVHNMLDTENTAIHWHGIRQIGSPWADGTAGVTQCPILPGETFTYRFVVDRPGTYMYHAHYGMQRVAGLDGMLVVSVPDGVAEPFAYDGEHTVLLMDWWHQSVYEQAVGLASVPMVFVGEPQSLLINGRGVFNCSPPAASNGGGAACNAFGGECGSTLFTASPGKTYRLRIGSLTSLASLSFEIEGHTMTVVEADGYYVTPVVVKNLFIYSGETYSVLVTADQDPSRSYWAASHVVSXXTPPRRRRAGPSSGXDRVLLLLNTQSKIDNHTKWAINGVSLSFPATPYLVAMKHGLRGEFDQRPPPDSYDHGSLNLSSPPASLAVRHAAYRLALGSVVDVVLQNTAIPPPNGRSETHPWHLHGHDFWVLGYGEGKFVPEVDGPGLNAASARGGAVMKNTVALHPMGWTAVRFRASNPGVWLFHCHLEAHVYMGMGVVFEEGVDVLPRLPASIMGCGRTKGHHY

SEQ ID NO: 3837 - protein, 543 aa, Oryza sativa
  unsure (1)..(543): unsure at all Xaa locations
MRTWRLAVLACLCAAAAAAPAEAKTHHHTWNITYQYKSPDCFRKLAVTINGESPGPTIRAAQGDTLVVTVHNMLDTENTAIHWHGIRQIGSPWADGTAGVTQCPILPGETFTYRFVVDRPGTYMYHAHYGMQRVAGLDGMLVVSVPDGVAEPFAYDGEHTVLLMDWWHQSVYEQAVGLASVPMVFVGEPQSLLINGRGVFNCSPPAASNGGGAACNAFGGECGSTLFTASPGKTYRLRIGSLTSLASLSFEIEGHTMTVVEADGYYVTPVVVKNLFIYSGETYSVLVTADQDPSRSYWAASHVVSXXTPPRRRXXGRAVVVRALPGHVEPPPARPDRVLLLLNTQSKIDNHTKWAINGVSLSFPATPYLVAMKHGLRGEFDQRPPPDSYDHGSLNLSSPPASLAVRHAAYRLALGSVVDVVLQNTAIPPPNGRSETHPWHLHGHDFWVLGYGEGKFVPEVDGPGLNAASARGGAVMKNTVALHPMGWTAVRFRASNPGVWLFHCHLEAHVYMGMGVVFEEGVDVLPRLPASIMGCGRTKGHHY

SEQ ID NO: 3838 - protein, 576 aa, Oryza sativa
  unsure (1)..(576): unsure at all Xaa locations
CAVMRTWRLAVLACLCAAAAAAPAEAKTHHHTWNITYQYKSPDCFRKLAVTINGESPGPTIRAAQGDTLVVTVHNMLDTENTAIHWHGIRQIGSPWADGTAGVTQCPILPGETFTYRFVVDRPGTYMYHAHYGMQRVAGLDGMLVVSVPDGVAEPFAYDGEHTVLLMDWWHQSVYEQAVGLASVPMVFVGEPQSLLINGRGVFNCSPPAASNGGGAACNAFGGECGSTLFTASPGKTYRLRIGSLTSLASLSFEIEGHTMTVVEADGYYVTPVVVKNLFIYSGETYSVLVTADQDPSRSYWAASHVVSRDPTKTAPGRAVVRYASAPXDHPRTPPPTGPRWNDTASRVAQSXVVRALPGHVEPPPARPDRVLLLLNTQSKIDNHTKWAINGVSLSFPATPYLVAMKHGLRGEFDQRPPPDSYDHGSLNLSSPPASLAVRHAAYRLALGSVVDVVLQNTAIPPPNGRSETHPWHLHGHDFWVLGYGEGKFVPEVDGPGLNAASARGGAVMKNTVALHPMGWTAVRFRASNPGVWLFHCHLEAHVYMGMGVVFEEGVDVLPRLPASIMGCGRTKGHHY

SEQ ID NO: 3839 - protein, 105 aa, Oryza sativa
  unsure (1)..(105): unsure at all Xaa locations
MQLNVIYSLLTGRLVREKVDPAVQRVVRSQMNAVDSSPFRESPDLFEIEGTNGMPRASIDKLPXXDFQTGEKVRSLPDCWHVFHVPCIDGWLIKHGSCPLCRRKL

SEQ ID NO: 3840 - protein, 276 aa, Oryza sativa
  unsure (1)..(276): unsure at all Xaa locations
LLHSKIHHRRRRHLHSKICSASSRVIDRSIDRGVRVRCWGKGKWIRRAPSSTXGSPERLECVAGVAGEDXXGGRRMMHRVFRGVITFIFAIAGLFLGAVTGGLIGLATESGLFRGTGIGAITGALVSIEVVDSSIRVWRSRRSGISSICYVLNVIYSLLTGRLVREKVDPAVQRVVRSQMNAVDSSPFRESPDLFEIEGTNGMPRASIDKLPEVRITEEYRRNAIGDLSGCSVCLQDFQTGEKVRSLPDCWHVFHVPCIDGWLIKHGSCPLCRRKL

SEQ ID NO: 3841 - protein, 116 aa, Oryza sativa
  unsure (1)..(116): unsure at all Xaa locations
XVDSDDEEIVGRVPEFGLALPGTSTSGRGSVRVAGDAAATAAGTSSGRRRGRSPADKEHRRLKRSMGEAQQARERKKAYMSELEARVKDLERSNSELEERLSTLQNENQMLRQLTX

SEQ ID NO: 3842 - protein, 160 aa, Oryza sativa
  unsure (1)..(160): unsure at all Xaa locations
MTIKRKDDGQVVKQSVKAVGGGLLERVDSDDEERRVPEFGLALPGTSTSGRGSVRVAGDAAATAAGTSSGRRRGRSPADKEHRRLKRLLRNRVSAQQARERKKAYMSELEARVKDLERSNSELEERLSTLQNENQMLRQVLKNTTANRRGPDSSAGGDSX

SEQ ID NO: 3843 - protein, 169 aa, Oryza sativa
  unsure (1)..(169): unsure at all Xaa locations
REENATRSPEAPAAASSSERSSDSAPNTDDGKGVDSDDEERRVPEFGLALPGTSTSGRGSVRVAGDAAATAAGTSSGRRRGRSPADKEHRRLKRLLRNRVSAQQARERKKAYMSELEARVKDLERSNSELEERLSTLQNENQMLRQVLKNTTANRRGPDSSAGGDSXXP

SEQ ID NO: 3844 - protein, 424 aa, Oryza sativa; identical to SEQ ID NO: 859

SEQ ID NO: 3845 - protein, 529 aa, Oryza sativa
  unsure (1)..(529): unsure at all Xaa locations
XLESDQXPDVLIGDPRRXRQIITNLVGNSMKFTEQGRIFIRVHLIDEVKRKMEALDDTSPENIEVTANSKNTMPYNTLSGLEVANNRKTLESFRMFKDSSDAIDSVNLLVTVEDTGIGITKDAQTRIFTPFMQADGSTSRTYGGTGIGLSITKRTADGVGANRGFVSKPGVSSTFSFTAIFKENRKDPGDIKRYCPEPTPPDFQGGGALVVDGRCTRAEVTMYHLRRLGIQCDLAATSESALSALLESCNSSVKSSLNMVLVDKEAWGEDSGLAFFRCLIDLRLKGTLKSWQTMPKFFLLAGSITPADSDCLRLAGYSNSIRKPLRLSTVAACLSKALGVGLTGRRSRDNSLVLRSVLTGKNILVVDDNAVNRIVAAGALKKYGAIVTCVDSGKEAISRLQPPHKFDACFMDVQMPEMDGFEATRLVRSVESKINDTIQAGEVSSEIYGNKAHWHVPILAMTADVIQATFEGSSAKNPFGDNNVAKQKSYAVNREQKFDWTAIYVSFDPKKKKKNWMKSISTSRLQPCA

SEQ ID NO: 3846 - protein, 368 aa, Oryza sativa
MNREKSPIPGDGGDGLPPQATRRAGPPAAAAAAEYDISRMPDFPTRNPGHRRAHSEILSLPEDLDLCAAGGGDGPSLSDENDEELFSMFLDVEKLNSTCGASSEAEAESSSAAAHGARPKHQHSLSMDESMSIKAEELVGASPGTEGMSSAEAKKAVSAVKLAELALVDPKRAKRIWANRQSAARSKERKMRYIAELERKVQTLQTEATTLSAQLALLQRDTSGLTTENSELKLRLQTMEQQVHLQDALNDTLKSEVQRLKVATGQMANGGGMMMNFGGMPHQFGGNQQMFQNNQAMQSMLAAHQLQQLQLHPQAQQQQVLHPQHQQQQPLHPLQAQQLQQAARDLKMKSPMGGQSQWGDGKSGSSGN

SEQ ID NO: 3847 - protein, 461 aa, Oryza sativa
  unsure (1)..(461): unsure at all Xaa locations
TTPKKHSQTPRETELRASETHHAPSGKAKRRRNGGGGGQGDGGSGRSGGGGVLLVVVGVGDAGVRLVRRGGGAALLPRGRGVPVRPVRRAGARRRVAPRAGVAVRGVRARARRRHVPGGRRGAVRRLRRRHPLGEPARAQARAPPRRALLRPARRRAAALPLLPGAYWGLAARACDACGGEAARLFCRADAAFLCAGCDARAHXXPGSRHARVWLCEVCEHAPAAVTCRADAAALCAACDADIHSANPLARRHERLPVAPFFGALADAPKPGSGAHGGDAAAADDDGSNDAEAASWLLPEPDHGQKDGAVGATDELYADXXDPYLDLDFARSMDDIKAIGVQNGPPELDITGGKLFYSDHSMNHSVSSSEAAVVPDAAAXXGGAPMPVVSRGREREARLMRYREKRKSRRFEKTIRYASRKAYAETRPRIKGRFAKRTNAALMAPGGSDADYGVDGVVPTF

SEQ ID NO: 3848 - protein, 308 aa, Oryza sativa
MCFGSKYKAGRKRNCIVQACYVEELQGHNVQSNEVNECETVNSFSLGFQWLKPGFTVPPKRSHGLAVRTLDPESSNPSSNLGSRVASALPSRSGRTGGRPVGTTVISPLQTYRHRWVGFSSPSRFGSVRVRFDFVFFSSSWGWWESMAAPDVEYRCFVGGLAWATDDRSLEAAFSTFGEILESKIINDRETGRSRGFGFVTFSSEQAMRDAIEGMNGKELDGRNITVNEAQSRRSGGGGGGGYGQRGGGGGYGGGGGYGGGGGGGYGQRREGGYGGGGGYGGGRGGGGGYGGGYGSRGGGNSDGNWRN

SEQ ID NO: 3849 - protein, 136 aa, Oryza sativa
  unsure (1)..(136): unsure at all Xaa locations
LTHSNQYYLFHHKKDDEHDTGXVDSYGGGVYTSNTVTTDVFIGGQNEYKRYKMEEKXHTHKQHLVEAGALVDGAFIMYEKHEAKKDPENAHKHKIMEEIAFTDWFNAGRYTLHEHHEKNKDHTSAEESTGEKKHHX

SEQ ID NO: 3850 - protein, 415 aa, Oryza sativa
  unsure (1)..(415): unsure at all Xaa locations
MDEDKYSFSSGYVQITEDTNDKKIGPDFYSESTKMAIEQERKHFRNIRIQRCTGPPKEAKIAMASCCGGFMEKAKPYFAMICLQFGYAGMNVITKVSLNHGMSHYVLVVYRHAFATISIAPFALILERPVIDQNFYYAGLKFTGPTFACAMSNILPAMTFVMAVIFRMEKLELKKVRCQAKIAGTLVTVAGAMLMTLYKGPLMEMAWSRHAGAGVAEAPAAAAAAISGRDWFLGSMFVIVATLAWASLFILQTHTIKQYSAQLSLTTLICLVGTLQAVVVTFAMERRRPSVWAIGFDMNLLAAAYAGIVTSSIAYYVQGLVIQRTGPVFASAFSPLMMIIVAVMGSFILSEQIYLGGVVGAALIVVGLYSVLWGKHKETQVHLLQPAAATDSVEMGEKTXANGSESXMQIFQTTX

SEQ ID NO: 3851 - protein, 404 aa, Oryza sativa
  unsure (1)..(404): unsure at all Xaa locations
CCGGFMEKAKPYFAMICLQFGYAGMNVITKVSLNHGMSHYVLVVYRHAFATISIAPFALILERKVRPKMTWSIFFQIFILALLGPVIDQNFYYAGLKFTGPTFACAMSNILPAMTFVMAVIFRMEKLELKKVRCQAKIAGTLVTVAGAMLMTLYKGPLMEMAWSRHAGAGVAEAPAAAAAAISGRDWFLGSMFVIVATLAWASLFILQTHTIKQYSAQLSLTTLICLVGTLQAVVVTFAMERRRPSVWAIGFDMNLLAAAYAGIVTSSIAYYVQGLVIQRTGPVFASAFSPLMMIIVAVMGSFILSEQIYLGGVVGAALIVVGLYSVLWGKHKETQEKQADTKLSLPTSKGAAAAAEGGGITGAGEDDGDGVDVAERSKNHRXEGGVGHHRTPMDMELRAVDGH

SEQ ID NO: 3852 - protein, 387 aa, Oryza sativa
MGGRKRALLVGINYPGTKAELKGCHNDVARMRRALVDRFGFDEADIRVLADADRSAPQPTGANIRRELARLVGDARPGDFLFFHYSGHGTRLPAETGQDDDTGYDECIVPSDMNLITDQDFTELVQKVPDDCLFTIVSDSCHSGGLLDKTKEQIGHSTKQKEERSDSGTGGFRSFLKETLKETVRDAFESRGVHIPHQSSRRNDDEDEEPHMGSSSHGGDRIKNRSLPLSTLIEMLKEKTGKDDIDVGSIRMTLFSLFGDDASPKIKKFMKVMLTKLQEGQHGGVMGLVGALAQEFMKAKLEGNQEADVEPAMKQETDQTSADATTPKGVSYGALSNAIQTILSEKSGRVTNKELVLRARELLSKQGYTQQPGLYCSDKHTSVAFIC

SEQ ID NO: 3853 - protein, 359 aa, Oryza sativa
  unsure (1)..(359): unsure at all Xaa locations
GRKRALLVGINYPGTKAELKGCHNDVARMRRALVDRFGFDEADIRVLADADRSAPQPTGANIRRELARLVGDARPGDFLFFHYSGHGTRLPAETGQDDDTGYDECIVPSDMNLITDQDFTELVQKVPDDCLFTIVSDSCHSGGLLDKTKEQIGHSTKRRNDDEDEEPHMGSSSHGGDRIKNRSLPLSTLIEMLKEKTGKDDIDVGSIRMTLFSLFGDDASPKIKKFMKVMLTKLQEGQHGGVMGLVGALAQEFMKAKLEGNQEADVXXEAYAGTTAXXXXXXXXSGCQTDQTSADATTPKGVSYGALSNAIQTILSEKSGRVTNKELVLRARELLSKQGYTQQPGLYCSDKHTSVAFIC

SEQ ID NO: 3854 - protein, 483 aa, Oryza sativa
  unsure (1)..(483): unsure at all Xaa locations
MTTTWHDIGPPPPTLPTTARWDANTQLSTHPQKSKKTQPIRSFPLDAANSASAKKLVYAAASPTSPRRPPPHGLRRRTRALLSSAMGGRKRALLVGINYPGTKAELKGCHNDVARMRRALVDRFGFDEADIRVLADADRSAPQPTGANIRRELARLVGDARPGDFLFFHYSGHGTRLPAETGQDDDTGYDECIVPSDMNLITDQDFTELVQKVPDDCLFTIVSDSCHSGGLLDKTKEQIGHSTKQKEERSDSGTGGFRSFLKETLKETVRDAFESRGVHIPHQSSRRNDDEDEEPHMGSSSHGGDRIKNRSLPLSTLIEMLKEKTGKDDIDVGSIRMTLFSLFGDDASPKIKKFMKVMLTKLQEGQHGGVMGLVGALAQEFMKAKLEGNQEADVEPAMKQEVHSVHEXXGCQTDQTSADATTPKGVSYGALSNAIQTILSEKSGRLTNKELVLRARELLSKQGYTQQPGLYCSDKHTSVAFIC

SEQ ID NO: 3855 - protein, 635 aa, Oryza sativa
  unsure (1)..(635): unsure at all Xaa locations
MPNGDILLLRRGRLLEGLQERPRGRQRGGEEARELERPDDGERPAVVDRGRGRGHRGEEAGPVAREVGGAARRLREPHRRGGARRRRRRQLLQRSLAPSGDGGNSNVVLPQVVMAAAPVVLPPSGCSGFYGPAPKRRRWRLLRHLEQQHVQSNTKKKPKPQAMSTLSLRPSLNPCRPLHMNALQTQRKRTRRGVHAPAPARDQAQRPRGKPGGGGDEEAARQERERGSGELVAHGGSAVASRTSSRVVVVGKLNAELVTVSSPRPVSAFAIATSATPCCCACHSSELCQLGACTVLLPGSVHGQSNIGHGNWSLSFFGTEGVRASYSPYGLEQGAAWFIAPTAILLNVLTTESQTSPPPTTVASCTRFKLKEFSTTSSSAATPVRPARATASHKLPLFFIVNLTNLLHSSCIGQSSQQRSRSKSSQLRDRGKKSRCELRLAQTIVFLVGEEEEEMKIQCDACESAAAAVVCCADKAALCAACDVEVHAANKLAGKHQRLPLEALSARLPRCDVCQEKAAFIFCVEDRALFCRDCDEPIHVPGTLSGNHQRYLATGIRVGFASASPCDGGSDAHDSDHHAPPMGSSEHHHHHQQPAPTVAVDTPSPQFLPQGWAVDELLQFSDYETGDKASTYTNX

SEQ ID NO: 3856 - protein, 369 aa, Oryza sativa
MAMMVDPPNGMGNQGKHYYTMWQTLFEIDTKYVPIKPIGRGAYGIVCSSINRATNEKVAIKKINNVFDNRVDALRTLRELKLLRHLRHENVIALKDIMMPVHRRSFKDVYLVYELMDTDLHQIIKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSEADIEFIDNPKARKYIKTLPYTPGIPLTSMYPQAHPLAIDLLQKMLVFDPSKRISVTEALEHPYMSPLYDPSANPPAQVPIDLDIDENLGVDMIREMMWQEMLHYHPEVVAGVNM

SEQ ID NO: 3857 - protein, 223 aa, Oryza sativa
  unsure (1)..(223): unsure at all Xaa locations
MTTSESVQETLGLDSHPSKPRVLLAASGSVAAIKFESLCRSFSEWAEVRAVATKASLHFIDRTSLPSNIILYTDDDEWSTWKKIGDEVLHIELRKWADIMVIAPLSANTLAKFCSXIAGGLCDNLLTCIVRAWDYSKPLFVAPAMNTFMWNNPFTSRHLETINLLGISLVPPITKRLACGDYGNGAMAEPSVIDSTVRLACKRQPLNTNSSPVVPAGRNLPSS

SEQ ID NO: 3858 - protein, 492 aa, Oryza sativa
  unsure (1)..(492): unsure at all Xaa locations
PPIPSPGLRWTARREEGRTARALLKERSFNIHLVLTEVELPLMSGFLLLSTIMEHDACKNIPVIMMSSNDSVSMVFKCMLKGAADFLVKPIRKNELRNLWQHVWRKQLSSGVLDVPQQEDNLTERHEQKTGVTKAEHVTENVVHKNMGDAQSSCTRSELEADSRQTKMTCSNDINCEKASRDMELVHIIDNQQKNNTHMEMDVARANSRGNDDKCFSIPAHQLELSLRRSDYSRLESQEKNERRTLNHSTSSPFSLYNCRTASSTINAGDAQACSTSATHIDLENKNGDSKTPSQDKRETNQPPIRVVPFPVPVGGLTFDGQPFWNXVHLWHPFSIHXSAPPIWNSKTSTWQDATTQAISLQQNGPKDTDTKQVENVEEQTARSHLSANRKHLRIEIPTDEPRHVSPTTGESGSSTVLDRIAPTESSNVVPENPDGLRHLSQREAALNKFRLKRKDRCFEKKVRYQSRKLLAEQRPRVKGQFVRQDHGVQGS

SEQ ID NO: 3859 - protein, 561 aa, Oryza sativa; identical to SEQ ID NO: 1173

SEQ ID NO: 3860 - protein, 279 aa, Oryza sativa
  unsure (1)..(279): unsure at all Xaa locations
MYENCKVIDLGVTNCRVVESVGEHVEGFAAGDPVVPTFLGQCTECVDCASERSNVCSTYRFAVRPGMPRDGTARFRDRHGAPIHHFLGVSSFSEYTVVDANQVVRVDPAVPPATASLLSCGATTGKKFGVTHFINPQELGDKPVSQAIIEMTDGGADYCFECIGLASVMSDAFRSSREGWGKTIILGVEMHGAPLSIPSLEILNGKCVMGSLFGGVKPKQDIPILADKYLNKIVDTNAMQELELDKFITHEVPLKDINTAFDLLLQGKSLRCTIWMDKX

SEQ ID NO: 3861 - protein, 292 aa, Oryza sativa
  unsure (1)..(292): unsure at all Xaa locations
XVVESVGEHVEGFAAGDPVVPTFLGQCTECVDCASERSNVCSTYRFAVRPGMPRDGTARFRDRHGAPIHHFLGVSSFSEYTVVDANQVVRVDPAVPPATASLLSCGATTGVGAAWKLAKVEPGSSVAIFGLGAVGLAVAEGARICGKKFGVTHFINPQELGDKPVSQAIIEMTDGGADYCFECIGLASVMSDAFRSSREGWGKTIILGVEMHGAPLSIPSLEILNGKCVMGSLFGGVKPKQDIPILADKYLNKELELDKFITHEVPLKDINTAFDLLLQGKSLRCTIWMDKX

SEQ ID NO: 3862 - protein, 414 aa, Oryza sativa
  unsure (1)..(414): unsure at all Xaa locations
SDIHYRATSSLPSRAPRQQKPLYYLLSLASMAGQIPQPIRCKAAVCRAAGEPLAVEEIVVDPPKAHEVRIKIVCTSLCHSDVTFWRMQDFPGVFPRIFGHEAFGVVESVGEHVEGFAAGDPVVPTFLGQCTECVDCASERSNVCSTYRFAVRPGMPRDGTARFRDRHGAPIHHFLGVSSFSEYTVVDANQVVRVDPAVPPATASLLSCGATTGVGAAWKLAKVEPGSSVAIFGLGAVGLAVAEGARICGASTIIGVDLNPEKHELGKKFGVTHFINPQELGDKPVSQAIIEMTDGGADYCFECIGLASVMSDAFRSSREGWGKTIILGVEMHGAPLSIPSLEILNGKCVMGSLFGGVKPKQDIPILADKYLNKELELDKFITHEVPLKDINTAFDLLLQGKSLRCTIWMDKXCG

SEQ ID NO: 3863 - protein, 126 aa, Oryza sativa
  unsure (1)..(126): unsure at all Xaa locations
XPGDPQACPTVIDQLTEMLKETGIPVQVIFSSGKDVDLLPQRSNKGNATQYLQQHLAMEPSQTLVCGDSGNDIGLFETSARGVIVRNAQPELLHWYDQWGDSRHYRAQSSHAGAILEAIAHFDFLS

SEQ ID NO: 3864 - protein, 200 aa, Oryza sativa
  unsure (1)..(200): unsure at all Xaa locations
XSDDEDNDLGREFEGFIRRHRRASTLRRVLDSIHDDLADXXQERDSSILINAFNQALALQGDQGGSTNDDGLLEEYVLGAGLSLLLQHLAESDPSRNGTPPAKKEAVEALPTVKIEEVVSCSVCLDDLEVGSQAKQMPCEHKFHSSCILPWLELHSSCPVCRFELPSEETKDLNEPSNIGRVEDSQEVRADGPGNVSESX

SEQ ID NO: 3865 - protein, 335 aa, Oryza sativa
  unsure (1)..(335): unsure at all Xaa locations
MAEAAITRYWCHECEQAIEEAMVDEIKCPSCGGGFIEEMTDEEXXETDQQAARXRVSRNGTLLSIQEXTMDSDDEDNDLGREFEGFIRRHRRASTLRRVLDSIHDDLXRXTQERDSSILINAFNQALALQGSVLDPDEGQGDQGGSTNDDGLLEEYVLGAGLSLLLQHLAESDPSRNGTPPAKKEAVEALPTVKIEEVVSCSVCLDDLEVGSQAKQMPCEHKFHSSCILPWLELHSSCPVCRFELPSEETKDLNEPSNIGRVEDSHEEVRADGPGNVSESSNRPWAIVPWLNELFSTREAQNAGGVSTDQXITAHFWNQPKCRAQLISAAVAICE

SEQ ID NO: 3866 - protein, 183 aa, Oryza sativa
IILATGSIWGPRIPVLFSNSGRTFGPPHHPLLANPVNHRNIRILPPEHATIMDFSRLYEVSNVVDEHRDMRLDIDSMTYEELLALEEQIGDVNTGLAKSYIVEKLKTSLFVPGSSCMSNKSSESSMENDACIICQEEYQVKECIGTLDCGHRYHEDCIKQWLMVKNLCPICKTTALSTGRRSG

SEQ ID NO: 3867 - protein, 226 aa, Oryza sativa
  unsure (1)..(226): unsure at all Xaa locations
ASRLKELSMPSSGGXXMPALPPGFRFHPTDEELIVHYLMNQAASIKCPVPIIAEVNIYKCNPWDLPGKALFGENEWYFFSPRDRKYPNGARPNRAAGSGYWKATGTDKSILSTPTSDNIGVKKALVFYKGKPPKGVKTDWIMHEYRLTGTSANNTTTTKQRRASSMTMRLDDWVLCRIHKKSNDFNSSDQHEDCDWFSVSERQYVEPSISSEPAATAEQSSADAVX

SEQ ID NO: 3868 - protein, 484 aa, Oryza sativa
  unsure (1)..(484): unsure at all Xaa locations
XWLPFPSSSVPARGLLRFPSVSMAPPVSAAETETETPPVAEEVRAPAAGEERFDWLDQWYPVAPVCDLDPRKPHGKMVLGLRVVAXCAGHGWXFNEHGSGQFIPEALAIGPPDLIYIPASISKQNFSGLSSCWMNXQVHKNSKACVASYPSVVQNNILWFYPRTEPEYRDVLQRKRPPYFPDLDDPSFNTVFGVRDFPYGYRNAHIAMQNIHLLSTVEFDQERGGPVKMKIEEANIDGFLSIQDWGHFRFIAPCTINRSELPLETLAHFDQEKQQQQPQGMLVFLCIPVAPGRSRVIWVFPQSVSAWPDKFIPRWLHHMVTNTVLDSDLYLLHIEERNFAAVGVDKWQKACYVPTLSDNMIITFRNWFRKYCKHQVGWATPMVNQLPTTPTKDQLMERYWSHVMQCTSCSAALKWMRAMEVALQVASVAVVGFLAAGKGTTVVTSAVQRAAVVAAAALCFAASRWLANFIEKSFYFQDYVHAYK

SEQ ID NO: 3869 - protein, 232 aa, Oryza sativa
  unsure (1)..(232): unsure at all Xaa locations
MTLHWSLLLFIAIALVSSVAQAAVVEHTFNVGNFSISQLCQPPLIITAVNGQLPGPTIYAREGDTVVVHLVNTSPYSMTLHWHGVLQRGTPWADGPAMVTQCPVQPGGNYTYRFNVDGQEGTLWWHAHVSFHRATVYGALVIRPRGGEAYPFPKPDKEHVVILGEWWNATVYDMERMAFLTGIPAPHADAYTINGKPGDFYNCSAPNQTAKFEVRQKTYLLRIINAGMNTPX

SEQ ID NO: 3870 - protein, 127 aa, Oryza sativa
  unsure (1)..(127): unsure at all Xaa locations
MPQRHSKNNNDLAFFTYEEKRKLGYGTQRERLGKDSIKPFDACCLCLKPLIHPLCCPKGHTFCKECILECLLAQKKDIKRKLAAHEAQKKLEKEEEDEKRMLQKSKELDAFDQQNHGAVPQYHDRSX

SEQ ID NO: 3871 - protein, 308 aa, Oryza sativa
  unsure (1)..(308): unsure at all Xaa locations
XPFNTFRLEPTNLFENEGLLSLQSDSSGLGFIDIDNDNGNPQMCASYASEIYTNLMASELIRRPRSNYMEALQRDITKGMRGILIDWLVEVSEEYKLVPDTLYLTINLIDRFLSQHYIERQKLQLLGITSMLIASKYEEICAPRVEEFCFITDNTYTKAEVLKMEGLVLNDMGFHLSVPTTKTFLXRQIFKLYFQVPSITLGYLANYLAELTLIDYSFLKFLPSVVAASAVFLARWTLDQSDIPWNHTLEHYTSYKSSDIQICVCALRELQHNTSNCPLNAIREKYRQQKFECVANLTSPELGQSLFS

SEQ ID NO: 3872 - protein, 489 aa, Oryza sativa
  unsure (1)..(489): unsure at all Xaa locations
MAGRKENPVLTACQAPSGRITRAQAAAMDGLGLLPPYHYXARTERKQTAKGKTKRGALDEITSASTATSAPQPKRRTVLKDVTNIGCANSSKNCTTTSKLQVQKSKPTQRVKQIPSKKQCAKKVPKLPPPAVAGTSFVIDSKSSEETQKVELLAKAEEPTNLFENEGLLSLQNIERNRDSNCHEAFFEARNAMDKHELADSKPGDSSGLGFIDIDNDNGNPQMCASYASEIYTNLMASELIRRPRSNYMEALQRDITKGMRGILIDWLVEVSEEYKLVPDTLYLTINLIDRFLSQHYIERQKLQLLGITSMLIASKYEEICAPRVEEFCFITDNTYTKAEVLKMEGLVLNDMGFHLSVPTTKTFLRXFCQIFKLYFQVPSITLGYLANYLAELTLIDYSFLKFLPSVVAASAVFLARWTLDQSDIPWNHTLEHYTSYKSSDIQICVCALRELQHNTSNCPLNAIREKYRQQKFECVANLTSPELGQSLF

SEQ ID NO: 3873 - protein, 542 aa, Oryza sativa
MDAVAANGKRARADERSECFCAFVFVFLLWRWRGIGGVLMMMGGKWFWLDGCVAGIGEVERKAQRSYWEEHSKDLTVEAMMLDSRAADLDKEERPEVLSVLPSYKGKSVLELGAGIGRFTGELAKEAGHVLALDFIESVIKKNENINGHHKNITFMCADVTSPDLTIEDNSIDLIFSNWLLMYLSDEEVEKLVGRMVKWLKVGGHIFFRESCFHQSGDSKRKVNPTHYREPRFYTKIFKECHSYDKDGGSYELSLETCKCIGAYVKSKKNQNQLCWLWEKVKSTEDRGFQRFLDNVQYKTTGILRYERVFGEGYVSTGGIETTKEFVDKLDLKPGQKVLDVGCGIGGGDFYMAENYDAHVLGIDLSINMVSFAIERAIGRKCSVEFEVADCTTKTYAPNTFDVIYSRDTILHIHDKPALFRSFFKWLKPGGKVLISDYCRNPGKPSEEFAAYIKQRGYDLHDVKTYGKMLEDAGFHHVIAEDRTDQFLRVLQRELAEVEKNKEAFMADFTQEDYDDIVNGWNAKLKRSSAGEQRWGLFIATK

SEQ ID NO: 3874 - protein, 112 aa, Oryza sativa
MALAKAKETVASAPVVVYSKSYCPFCVRVKKLFEQLGATFKAIELDGESDGSELQSALAEWTGQRTVPNVFINGKHIGGCDDTLALNNEGKLVPLLTEAGAIASSAKTTITA

SEQ ID NO: 3875 - protein, 217 aa, Oryza sativa
PRPRGARRPISPQSPSPPLRKLGFRAIHLLGDDRDRERFRRARSMAAEGEKKMITLKSSDGEEFEVEEAVAMESQTIRHMIEDDCADNGIPLPNVNSKILSKVIEYCNKHVHAAAAAASKAADDAASAAAAVPPPSGEDLKNWDADFVKVDQATLFDLILAANYLNIKGLLDLTCQTVADMIKGKTPEEIRKTFNIKNDFTPEEEEEIRRENQWAFE

SEQ ID NO: 3876 - protein, 563 aa, Oryza sativa
  unsure (1)..(563): unsure at all Xaa locations
MAEVTVVRAEREEESTLEQGLLAIPEESNQLTYTGDGSVDFSGNPVVKERTGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQVHQKYYFWMGTLLTFPGEPILPASATNLKPGQX

SEQ ID NO: 3877 - protein, 609 aa, Oryza sativa
MAEVTVVRAEREEESTLEQGLLESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILVRMFPVWATTIVFSAVYAQMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAASSCTLYLMLLYILYFLFCRY

SEQ ID NO: 3878 - protein, 593 aa, Oryza sativa
MAEVTVVRAEREEESTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILVRMFPVWATTIVFSAVYAQMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 3879 - protein, 154 aa, Oryza sativa
LIKSTSSVMQGQKNSVEQLADVFGFDHASSSGNPVMDQQGYWNNILGSVESHNLQGYQVNRSDGTIPYGNGVHQNGTFLGFWESGEASASGSSLHFGGSNEIKAEQRNIGGGLRIGERRLVAERNLSLDNVDIGLNINGNDLSGENSNVNGASQ

SEQ ID NO: 3880 - protein, 102 aa, Oryza sativa
  unsure (1)..(102): unsure at all Xaa locations
XDDDQTSADTSALSKIASAGAMTFCFIQAIERGQGTTYGSILTSMRSAIRSTGDSMGSGGGAVTSLITMLLTGGSVSSGGLKQDPQLTANEPFDVYAKPFSL

SEQ ID NO: 3881 - protein, 1240 aa, Oryza sativa
MRSLRRVLLQLVLLAGVAFRGVRFDDAADAAAAAQGSSDLFELPSPSPTLALPGGGDEGASTEIIAAPWPGRHGLFTPPRSTSQPARAVVQPAADFGSQLQFYDNGTIQLVDLLSKLPRWQFSTGPPLSKHITTSKPDLNYVIYLDGSETSDLIEVHNGSGVRLPWKLEEFIAETPYIRDSFVTIGSKVSTTFVVNADSGEIIYKHSLPVALNEVGGPLVEEIPSKLDAARSGTSANIIVVVRTDYSISASDLGEHLFNWTRTSFTANYYARYGHQDMLAQSSCLRGNIPCIRTEGPPIKLYLPDSSSDNAIVLRPVNEVSAVDALEPLLPPKKLPQPAGESNVALDSAQNQTADIALGHFVPADTELTNSVTKFSYRWLFPTFLMLLIMACLVKLADASKYCRQFVIRFLKPFMRDEKLMDPRGKSEGTSKRRKARKKDGLINSTQIFSASDKEGNGTGGSTEAQSNKAHDSTNVELPNGLNGRQIGKLCVYSKEIGKGSNGTVVFEGSYGGREVAVKRLLRSHNDIASKEIENLIASDQDPNIVRMYGFEQDNDFVYISLERCRCSLADLIQLHSVPPFSNTKGTDIELWRQDGLPSAQLLKLMRDVVAGIVHLHSLGIIHRDLKPQNVLISKEGPLRAKLSDMGISKRLQEDMTSVSHHGTGFGSSGWQAPEQLRHGRQTRAIDLFSLGCLIFYCITKGKHPFGEYYERDMKIINNQFDLFIVDHIPEAVHLISQLLDPDPEKRPTAVYVMHHPFFWSPELCLSFLRDTSDRIEKTSETDLIDALEGINVEAFGKNWGEKLDAALLADMGRYRKYSFESTRDLLRLIRNKSGHYREFSDDLKAASGPKPSGALPPVPRMCPLLELPHGHTTSPRLPFSLSGAGRSPAAPAAASARRPAVPSPLPASQLPPLPRLRPRFAGKSSETRPRRQNSGVAATVPPSVASVAAPERRPTSPSPSSTSQHRPLLRLLLCFARTPPCHAGLSIRLAGISPVGPSSTRAPSAAPPPPPASQQQGRPRPRLPFDRTPPVFVVVVIVPPRRLVVSRRRLRRRIRSGVFHTVLVSVQPLPAALVASSPVPVVVLIVVAFVPPSSRSRPSSASVKCAAAAPSSSSSSPPRRQALRRPRLAFVQGSPLKSSPRLSSPSFLAVSAAPVRRCRSLASSRGGKDLSFAAPSSSFRCRPCPLCGCRPRYSCTSVGSRSLVRVVTVLVCPLGSRVVSTCAGRVVSSGVRLSATRLG

(The sequence listing continues in the following parts.)

What is claimed is:

1. A plant cell nucleus with stably integrated, recombinant DNA, wherein said recombinant DNA comprises a promoter that is functional in said plant cell nucleus and that is operably linked to a protein coding recombinant DNA encoding the protein consisting of SEQ ID NO: 1032 or a protein having an amino acid sequence with at least 95% but less than 100% amino acid sequence identity to SEQ ID NO: 1032; and wherein said plant cell nucleus is selected by screening a population of transgenic plants that have said recombinant DNA and an enhanced trait as compared to control plants that do not have said recombinant DNA in their nuclei; and wherein said enhanced trait is selected from the group of enhanced traits consisting of cold tolerance, yield, nitrogen use efficiency, and seed protein.

2. The plant cell nucleus of claim 1 wherein said protein coding DNA encodes the protein having the amino acid sequence of SEQ ID NO:1032.

3. The plant cell nucleus of claim 1 further comprising a DNA expressing a protein that provides tolerance from exposure to an herbicide applied at levels that are lethal to a wild type plant cell of the same species.

4. The plant cell nucleus of claim 3 wherein said herbicide is a glyphosate, dicamba, or glufosinate compound.

5. A transgenic plant comprising a plurality of plant cells with the plant cell nucleus of claim 1.

6. The transgenic plant of claim 5 which is homozygous for said recombinant DNA.

7. A transgenic seed comprising a plurality of plant cells with the plant cell nucleus of claim 1.

8. The transgenic seed of claim 7, wherein said transgenic seed is obtained from a corn, soybean, cotton, canola, alfalfa, wheat or rice transgenic plant comprising said plant cell nucleus.

9. A transgenic pollen grain comprising a haploid gamete of the plant cell nucleus of claim 1, wherein the gamete comprises said recombinant DNA.

10. A method for manufacturing non-natural, transgenic seed, said method comprising the steps of:
(a) providing a population of transgenic plants transformed with a recombinant DNA construct comprising a promoter that is functional in a plant cell and that is operably linked to a protein coding recombinant DNA encoding the protein consisting of SEQ ID NO: 1032 or a protein having an amino acid sequence with at least 95% but less than 100% amino acid sequence identity to SEQ ID NO: 1032, wherein said recombinant DNA construct is stably integrated into the genome of said transgenic plants;
(b) screening the population of transgenic plants provided in step (a) for an enhanced trait and said recombinant DNA, wherein said enhanced trait is selected from the group of enhanced traits consisting of water use efficiency, cold tolerance, heat tolerance, resistance to salt exposure, shade tolerance, yield, nitrogen use efficiency, seed protein and seed oil as compared to control plants of the same species lacking said DNA construct;
(c) selecting one or more transformed plants from said screening of step (b) which exhibit said enhanced trait as compared to said control plants lacking said DNA construct, wherein said enhanced trait is due to the expression of said protein in said selected transformed plants;
(d) verifying that said recombinant DNA is stably integrated in said selected transformed plants;
(e) analyzing tissue of said selected transformed plants to determine the expression of a gene that encodes a protein having the function of a protein having the amino acid sequence of SEQ ID NO:1032; and
(f) collecting seed from said selected transformed plants.

11. A method of producing hybrid corn seed comprising:
(a) acquiring hybrid corn seed from a herbicide tolerant corn plant which also has stably-integrated recombinant DNA construct comprising a promoter that is functional in plant cells and that is operably linked to a protein coding recombinant DNA encoding the protein consisting of SEQ ID NO: 1032 or a protein having an amino acid sequence with at least 95% but less than 100% amino acid sequence identity to SEQ ID NO: 1032, wherein said recombinant DNA construct is stably integrated into the genome of said hybrid corn seed;
(b) producing corn plants from said hybrid corn seed of step a), wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA;
(c) selecting corn plants which are homozygous and hemizygous for said recombinant DNA by treating with an herbicide;
(d) collecting seed from herbicide-treated-surviving corn plants and planting said seed to produce further progeny corn plants;
(e) repeating steps (c) and (d) at least once to produce an inbred corn line; and
(f) crossing said inbred corn line with a second corn line to produce hybrid seed; and wherein said inbred corn line of step (e) and hybrid seed of step (f) comprise said recombinant DNA.

* * * * *